United States Patent 11,098,302 (IDENTIFICATION OF POLYNUCLEOTIDES ASSOCIATED WITH A SAMPLE) - sequence listing, part 40

SEQ ID NO: 135477 - DNA, 253 bp, Homo sapiens; identical to SEQ ID NO: 134746
  misc_feature: GYAE6OF02GMBQG.49.11.A11.1.454.CMB.1.raw
  modified_base (251)..(253): a, c, t, g, unknown or other
  misc_feature (251)..(253): n is a, c, g, or t

SEQ ID NO: 135478 - DNA, 255 bp, Homo sapiens; identical to SEQ ID NO: 134817
  misc_feature: GYAE6OF02G4AH1.49.11.A11.1.454.CMB.1.raw
  modified_base (252)..(255): a, c, t, g, unknown or other
  misc_feature (252)..(255): n is a, c, g, or t

SEQ ID NO: 135479 - DNA, 258 bp, Homo sapiens
  misc_feature: GYAE6OF02GHRR1.49.11.A11.1.454.CMB.1.raw
  modified_base (251)..(258): a, c, t, g, unknown or other
  misc_feature (251)..(258): n is a, c, g, or t
tcagagtcgagagacacgaccggtgctcgatttagctacgactgcagggaacccggccaccctgaccatcagccgggtcgaagacgggatgaggccgactattactgtcaggtgtgggatagtggtagtggtgtcgtcttcggagctgggaccagggtcaccgtcctaggtcagcccaaggccaaccccactgtcactctgttcccaccctcctctctctcgactctgagcgggctggcaaggcgcatagnnnnnnnn

SEQ ID NO: 135480 - DNA, 275 bp, Homo sapiens
  misc_feature: GYAE6OF02HZBFP.49.11.A11.1.454.CMB.1.raw
  modified_base (256)..(275): a, c, t, g, unknown or other
  misc_feature (256)..(275): n is a, c, g, or t
tcagagtcgagagacacgaccggtgctcgatttagctacgactgcagggaacccgggccaccctgaccatcagccggtcgaagacgggatgaggcccgactattactgtcaggtgtgggatagtggtagtggtgtcgtcttcggagctgggaccagggtcaccgtcctaggtcagcccaaggccaaccccactgttcactctggttacccaccctcctcctctctcgactctgagcgggctggcaaggcgcatagnnnnnnnnnnnnnnnnnnnn

SEQ ID NO: 135481 - DNA, 254 bp, Homo sapiens; identical to SEQ ID NO: 134762
  misc_feature: GYAE6OF02GZFCQ.49.11.A11.1.454.CMB.1.raw
  modified_base (252)..(254): a, c, t, g, unknown or other
  misc_feature (252)..(254): n is a, c, g, or t

SEQ ID NO: 135482 - DNA, 255 bp, Homo sapiens; identical to SEQ ID NO: 134817
  misc_feature: GYAE6OF02G5FJD.49.11.A11.1.454.CMB.1.raw
  modified_base (252)..(255): a, c, t, g, unknown or other
  misc_feature (252)..(255): n is a, c, g, or t

SEQ ID NO: 135483 - DNA, 160 bp, Homo sapiens; identical to SEQ ID NO: 135418
  misc_feature: GYAE6OF02HVQNR.49.11.A11.1.454.CMB.1.raw
  modified_base (160)..(160): a, c, t, g, unknown or other
  misc_feature (160)..(160): n is a, c, g, or t

SEQ ID NO: 135484 - DNA, 256 bp, Homo sapiens; identical to SEQ ID NO: 134784
  misc_feature: GYAE6OF02HBT6I.49.11.A11.1.454.CMB.1.raw
  modified_base (252)..(256): a, c, t, g, unknown or other
  misc_feature (252)..(256): n is a, c, g, or t

SEQ ID NO: 135485 - DNA, 255 bp, Homo sapiens; identical to SEQ ID NO: 134817
  misc_feature: GYAE6OF02JDID3.49.11.A11.1.454.CMB.1.raw
  modified_base (252)..(255): a, c, t, g, unknown or other
  misc_feature (252)..(255): n is a, c, g, or t

SEQ ID NO: 135486 - DNA, 272 bp, Homo sapiens
  misc_feature: GYAE6OF02IESSZ.49.11.A11.1.454.CMB.1.raw
  modified_base (225)..(225): a, c, t, g, unknown or other
  misc_feature (225)..(225): n is a, c, g, or t
  modified_base (247)..(272): a, c, t, g, unknown or other
  misc_feature (247)..(272): n is a, c, g, or t
tcagagtcgagagacacgaccggtgctcgatttagctacgactgcagggaaccggccaccctgaccatcagccggtcgaagacgggatgaggccgactattactgtcaggtgtgggatagtggtagtggtgtcgtcttcggagctgggaccaggtcaccgtcctaggtcagcccaaggccaacccactgtcactctgttcccgcctcctctctctcgactctgancgggctggcaaggcgcattagnnnnnnnnnnnnnnnnnnnnnnnnnn

SEQ ID NO: 135487 - DNA, 255 bp, Homo sapiens; identical to SEQ ID NO: 134817
  misc_feature: GYAE6OF02GNCTS.49.11.A11.1.454.CMB.1.raw
  modified_base (252)..(255): a, c, t, g, unknown or other
  misc_feature (252)..(255): n is a, c, g, or t

SEQ ID NO: 135488 - DNA, 255 bp, Homo sapiens; identical to SEQ ID NO: 134799
  misc_feature: GYAE6OF02GCTO7.49.11.A11.1.454.CMB.1.raw
  modified_base (252)..(255): a, c, t, g, unknown or other
  misc_feature (252)..(255): n is a, c, g, or t

SEQ ID NO: 135489 - DNA, 162 bp, Homo sapiens
  misc_feature: GYAE6OF02IBKTO.49.11.A11.1.454.CMB.1.raw
  modified_base (161)..(162): a, c, t, g, unknown or other
  misc_feature (161)..(162): n is a, c, g, or t
tcagagtcgagagacacgaccggtgctcgatttagctacgactgcagggagcttactgactaggccggccttaattaaggtcagcctaaggctgcccccagcgtcactctgttcccgccctcctctctctcgactctgagcgggctggcaaggcgcatagnn

SEQ ID NO: 135490 - DNA, 255 bp, Homo sapiens; identical to SEQ ID NO: 134799
  misc_feature: GYAE6OF02GBFVS.49.11.A11.1.454.CMB.1.raw
  modified_base (252)..(255): a, c, t, g, unknown or other
  misc_feature (252)..(255): n is a, c, g, or t

SEQ ID NO: 135491 - DNA, 263 bp, Homo sapiens
  misc_feature: GYAE6OF02G467A.49.11.A11.1.454.CMB.1.raw
  modified_base (251)..(263): a, c, t, g, unknown or other
  misc_feature (251)..(263): n is a, c, g, or t
tcagagtcgagagacacgaccggtgctcgatttagctacgactgcgagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccacctcctctctctcgactctgagcggctggcaaggcgcatagnnnnnnnnnnnnn

SEQ ID NO: 135492 - DNA, 254 bp, Homo sapiens; identical to SEQ ID NO: 134822
  misc_feature: GYAE6OF02HTE3C.49.11.A11.1.454.CMB.1.raw
  modified_base (251)..(254): a, c, t, g, unknown or other
  misc_feature (251)..(254): n is a, c, g, or t

SEQ ID NO: 135493 - DNA, 263 bp, Homo sapiens; identical to SEQ ID NO: 134865
  misc_feature: GYAE6OF02IX1YF.49.11.A11.1.454.CMB.1.raw
  modified_base (252)..(263): a, c, t, g, unknown or other
  misc_feature (252)..(263): n is a, c, g, or t

SEQ ID NO: 135494 - DNA, 254 bp, Homo sapiens
  misc_feature: GYAE6OF02GAVRG.49.11.A11.1.454.CMB.1.raw
  modified_base (249)..(254): a, c, t, g, unknown or other
  misc_feature (249)..(254): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccatgtcactctgttcccacctcctctctctcactctgagcgggctggcaaggcgcatagnnnnnn

SEQ ID NO: 135495 - DNA, 255 bp, Homo sapiens; identical to SEQ ID NO: 134799
  misc_feature: GYAE6OF02IC1GF.49.11.A11.1.454.CMB.1.raw
  modified_base (252)..(255): a, c, t, g, unknown or other
  misc_feature (252)..(255): n is a, c, g, or t

SEQ ID NO: 135496 - DNA, 255 bp, Homo sapiens; identical to SEQ ID NO: 134817
  misc_feature: GYAE6OF02HH7HR.49.11.A11.1.454.CMB.1.raw
  modified_base (252)..(255): a, c, t, g, unknown or other
  misc_feature (252)..(255): n is a, c, g, or t

SEQ ID NO: 135497 - DNA, 256 bp, Homo sapiens; identical to SEQ ID NO: 134784
  misc_feature: GYAE6OF02IASOI.49.11.A11.1.454.CMB.1.raw
  modified_base (252)..(256): a, c, t, g, unknown or other
  misc_feature (252)..(256): n is a, c, g, or t

SEQ ID NO: 135498 - DNA, 272 bp, Homo sapiens
  misc_feature: GYAE6OF02IXP22.49.11.A11.1.454.CMB.1.raw
  modified_base (253)..(272): a, c, t, g, unknown or other
  misc_feature (253)..(272): n is a, c, g, or t
tcagagtcgagagacacgaccggtgctcgatttagctacgactgcaggggaacccggccaccctgaccgatcagccgggtcgaagacgggatgaggccgactattactgtcaggtgtgggatagtggtagtggtgtcgtcttcggagctgggaccagggtcaccgtcctaggtcagcccaaggccaaccccactgtcactctgttcccgccctcctctctctcgactctgagcgggctggcaaggcgcatagnnnnnnnnnnnnnnnnnnnn

SEQ ID NO: 135499 - DNA, 254 bp, Homo sapiens
  misc_feature: GYAE6OF02IMHWQ.49.11.A11.1.454.CMB.1.raw
  modified_base (252)..(254): a, c, t, g, unknown or other
  misc_feature (252)..(254): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgttcctaggtcagcccaaggccaaccccactgtcactctgttcccacctcctctctctcgactctgagcgggctggcaaggcgcatagnnn

SEQ ID NO: 135500 - DNA, 254 bp, Homo sapiens
  misc_feature: GYAE6OF02JFLE1.49.11.A11.1.454.CMB.1.raw
  modified_base (249)..(254): a, c, t, g, unknown or other
  misc_feature (249)..(254): n is a, c, g, or t
tcagagtcgagagacacgaccggtgctcgatttagctacgactgcagggaacccggccaccctgaccatcagccggtcgaagacgggatgaggccgactattactgtcaggtgtggatagtggtagtggtgtcgtcttcggagctgggaccagggtcaccgtcctaggtcagcccaaggccaaccccactgtcactctgttcccaccctcctctctctcgactctgagcgggctggcaaggcgcatagnnnnnn

SEQ ID NO: 135501 - DNA, 253 bp, Homo sapiens; identical to SEQ ID NO: 134759
  misc_feature: GYAE6OF02ICRY8.49.11.A11.1.454.CMB.1.raw
  modified_base (252)..(253): a, c, t, g, unknown or other
  misc_feature (252)..(253): n is a, c, g, or t

SEQ ID NO: 135502 - DNA, 258 bp, Homo sapiens
  misc_feature: GYAE6OF02HSXGM.49.11.A11.1.454.CMB.1.raw
  modified_base (251)..(258): a, c, t, g, unknown or other
  misc_feature (251)..(258): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccgcctcctctctctcgactctgagcgggctggcaaggcgcatagnnnnnnnn

SEQ ID NO: 135503 - DNA, 282 bp, Homo sapiens
  misc_feature: GYAE6OF02HDZFH.49.11.A11.1.454.CMB.1.raw
  modified_base (254)..(282): a, c, t, g, unknown or other
  misc_feature (254)..(282): n is a, c, g, or t
tcagagtcgagagacacgaccggtgctcgatttagctacgactgcagggaacccggccgaccctgaccatcagccgggtcgaagacggggatgaggccgactattactgtcaggtgtgggatagtggtagtggtgtcggtcttcggagctgggaccagggtcaccgtcctaggtcagcccaaggccaacccactgtcactctgttcccaccctcctctctctcgactctgagcgggctggtcaaggcgcatagnnnnnnnnnnnnnnnnnnnnnnnnnnnnn

SEQ ID NO: 135504 - DNA, 254 bp, Homo sapiens; identical to SEQ ID NO: 134822
  misc_feature: GYAE6OF02IB4K6.49.11.A11.1.454.CMB.1.raw
  modified_base (251)..(254): a, c, t, g, unknown or other
  misc_feature (251)..(254): n is a, c, g, or t

SEQ ID NO: 135505 - DNA, 251 bp, Homo sapiens
  misc_feature: GYAE6OF02GPCLZ.49.11.A11.1.454.CMB.1.raw
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccaccctcctctctctcgactctgagcgggctggcaaggcgcatag

SEQ ID NO: 135506 - DNA, 259 bp, Homo sapiens; identical to SEQ ID NO: 135163
  misc_feature: GYAE6OF02GWFXC.49.11.A11.1.454.CMB.1.raw
  modified_base (252)..(259): a, c, t, g, unknown or other
  misc_feature (252)..(259): n is a, c, g, or t

SEQ ID NO: 135507 - DNA, 278 bp, Homo sapiens
  misc_feature: GYAE6OF02HZKRJ.49.11.A11.1.454.CMB.1.raw
  modified_base (141)..(141): a, c, t, g, unknown or other
  misc_feature (141)..(141): n is a, c, g, or t
  modified_base (253)..(278): a, c, t, g, unknown or other
  misc_feature (253)..(278): n is a, c, g, or t
tcagagtcgagagacacgaccggtgctcgatttagctacgactgcagggaacccgggccaccctgacccatcagccgggtcgaagacggggatgaggccgactattactgtcaggtgtgggatagtggtagtggtgtcgtnttcggagctgggaccagggtcaccgtcctaggtcagcccaaggccaaccccactgtcactctgttcccgccctcctctctctcgactctgagcggctggcaaggcgcatagnnnnnnnnnnnnnnnnnnnnnnnnnn

SEQ ID NO: 135508 - DNA, 255 bp, Homo sapiens
  misc_feature: GYAE6OF02F9T2W.49.11.A11.1.454.CMB.1.raw
  modified_base (253)..(255): a, c, t, g, unknown or other
  misc_feature (253)..(255): n is a, c, g, or t
tcagagtcgagagacacgaccggtgctcgatttagctacgactgcggggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccaccctccttctctctcgactctgagcgggctggcaaggcgcatagnnn

SEQ ID NO: 135509 - DNA, 254 bp, Homo sapiens
  misc_feature: GYAE6OF02HYUY3.49.11.A11.1.454.CMB.1.raw
  modified_base (251)..(254): a, c, t, g, unknown or other
  misc_feature (251)..(254): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaacccactgtcactctgttcccaccctcctctctctcgactctgagcgggctggcaaggcgcatagnnnn

SEQ ID NO: 135510 - DNA, 531 bp, Homo sapiens
  misc_feature: GYAE6OF02IT1UT.49.11.A11.1.454.CMB.1.raw
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagccaccctcggtgtcagtggcccctggacagacggccaggattacctgtgggggaaacgacattggaagtaagactgtgcactggtaccagcagaagccaggccaggccccctgtgctggtcgtctatggtgatggcgaccggccctcaggggatccctgagcgattctctggctccaactctgggaacccggccacctgaccatcagccgggtcgaaggacggggatggaggccgactattactgtcaggtgtgggataggtggtagtggtgtcgtcttcggagcgtgggaccagggtcaccgttcctaggtcagcccaaggcccaacccacgtcgtccactctcgttcccgcctcctcctctctcgatcg

SEQ ID NO: 135511 - DNA, 281 bp, Homo sapiens
  misc_feature: GYAE6OF02HYXIJ.49.11.A11.1.454.CMB.1.raw
  modified_base (252)..(281): a, c, t, g, unknown or other
  misc_feature (252)..(281): n is a, c, g, or t
tcagagtcgagagacacgaccggtgctcgatttagctacgactgcagggaacccggccaccctgaccatcagccgggtcgaagacggggatgaggccgactattactcgtcaggtgtgggatagtggtagtggtgtcgtcttcggagctgggaccagggtcaccgtcctaggtcagcccaaggccaacccactgtcactctgttcccaccctcctctctctcgactctgagcgggctggcaaggcgcatagnnnnnnnnnnnnnnnnnnnnnnnnnnnnnn

SEQ ID NO: 135512 - DNA, 279 bp, Homo sapiens
  misc_feature: GYAE6OF02GGXN8.49.11.A11.1.454.CMB.1.raw
  modified_base (256)..(279): a, c, t, g, unknown or other
  misc_feature (256)..(279): n is a, c, g, or t
tcagagtcgagagacacgaccggtgctcgatttagctacgactgcagggaacccggccaccctcgaccatcagccgggtcgaagacggggatgaggccgacgtacttactgtcaggtgtggggatagtggtagtggtgtcgtcttcggagctgggaccagggtcaccgtcctaggtcagcccaaggccaacccactgtcactctgttcccaccctcctctctctcgactctgagccgggctggcaaggcgcatagnnnnnnnnnnnnnnnnnnnnnnnn

SEQ ID NO: 135513 - DNA, 702 bp, Homo sapiens
  misc_feature: GYAE6OF02JUSCS.49.11.A11.1.454.CMB.1.raw
tcagagtcgagagacacgaccggtgctcgatttagctacgactgcaggggggcctaaggaagcagcactggtggtgcctcagccatggcctggaccgttctcctcctcggcctcctctctcactgcacagactctgtgacctcctatgtgctgactcagccaccctcggtgtcagtggcccctggacagacggccaggattacctgtgggggaaacacattggaagtaagactgtgcactggtaccagcagaagccaggccaggcccctgtgctggtcgtctatggtgatggcgaccggccctcgacgggacttccccgtggacgccggtattccgtcgtcgggcctacccgaacgttccgtacggggaaacccccggcccgaacccgttcggaaccctacgtccgaacggcccggggttacgaaacggaccgggggtatcgggaacgggccgtaacgtacgttacgtgtcgacgttggtcgggaactaggttacgtaggtcgattcgaagttcggtagggttcggttccgggacgggtaacggggaacctaagggtccgttacgggacccgttaccgttacgggtacctacggtaccccggaagggtcccggttaccggtccccccgttacgggttaccctacccggttcccgttaccggttacccccgtacccgttccccgttaccgtccctttacccgg

SEQ ID NO: 135514 - DNA, 270 bp, Homo sapiens
  misc_feature: GYAE6OF02FVMBR.49.11.A11.1.454.CMB.1.raw
  modified_base (251)..(270): a, c, t, g, unknown or other
  misc_feature (251)..(270): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagcctgggaccagggtcaccgtcctaggtcagcccaaggccaacccactgtcactctgttcccgcctcctctctctcgactctgagcgggctggcaaggcgcatagnnnnnnnnnnnnnnnnnnnn

SEQ ID NO: 135515 - DNA, 256 bp, Homo sapiens; identical to SEQ ID NO: 134845
  misc_feature: GYAE6OF02GAAXM.49.11.A11.1.454.CMB.1.raw
  modified_base (252)..(256): a, c, t, g, unknown or other
  misc_feature (252)..(256): n is a, c, g, or t

SEQ ID NO: 135516 - DNA, 253 bp, Homo sapiens
  misc_feature: GYAE6OF02JCEWB.49.11.A11.1.454.CMB.1.raw
  modified_base (251)..(253): a, c, t, g, unknown or other
  misc_feature (251)..(253): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaacccactgtcactctgttcccaccctcctctctctcgactctgagcgggctggcaaggcgcatagnnn

SEQ ID NO: 135517 - DNA, 275 bp, Homo sapiens
  misc_feature: GYAE6OF02G788H.49.11.A11.1.454.CMB.1.raw
  modified_base (252)..(275): a, c, t, g, unknown or other
  misc_feature (252)..(275): n is a, c, g, or t
tcagagtcgagagacacgaccggtgctcgatttagctacgactgcgagggaacccggccaccctgaccatcaggccgggtcgaagacggggatgaggccgactattactgtcaggtgtgggatagtggtagtggtgtcgtcttcggagctgggaccagggtcaccggtcctaggtcagcccaaggccaacccatgtcactctgttcccgcctcctctctctcgactctgagcgggctggcaaggcgcatagnnnnnnnnnnnnnnnnnnnnnnnn

SEQ ID NO: 135518 - DNA, 254 bp, Homo sapiens; identical to SEQ ID NO: 134762
  misc_feature: GYAE6OF02G9XMH.49.11.A11.1.454.CMB.1.raw
  modified_base (252)..(254): a, c, t, g, unknown or other
  misc_feature (252)..(254): n is a, c, g, or t

SEQ ID NO: 135519 - DNA, 277 bp, Homo sapiens
  misc_feature: GYAE6OF02F74EJ.49.11.A11.1.454.CMB.1.raw
  modified_base (252)..(277): a, c, t, g, unknown or other
  misc_feature (252)..(277): n is a, c, g, or t
tcagagtcgagagacacgaccggtgctcgatttagctacgactgcagggaacccgggccaccctgaccatcagccgggtcgaagacgggatgaggccgactattactgtcaggtgtgggatagtggtagtggtgtcgtcttcggagctgggaccagggtcaccgtcctaggtcagcccaaggccaaccccactgtcactctgttcccgccctcctctctctcgactctgagcgggctggcaaggcgcatagnnnnnnnnnnnnnnnnnnnnnnnnnn

SEQ ID NO: 135520 - DNA, 254 bp, Homo sapiens; identical to SEQ ID NO: 134802
  misc_feature: GYAE6OF02HSZ40.49.11.A11.1.454.CMB.1.raw
  modified_base (252)..(254): a, c, t, g, unknown or other
  misc_feature (252)..(254): n is a, c, g, or t

SEQ ID NO: 135521 - DNA, 253 bp, Homo sapiens
  misc_feature: GYAE6OF02H4NJ9.49.11.A11.1.454.CMB.1.raw
  modified_base (251)..(253): a, c, t, g, unknown or other
  misc_feature (251)..(253): n is a, c, g, or t
tcagagtcgagagacacgaccggtgctcgatttagctacgactgcgggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccaccctcctctctctcgactctgagcgggctggcaaggcgcatagnnn

SEQ ID NO: 135522 - DNA, 254 bp, Homo sapiens; identical to SEQ ID NO: 134802
  misc_feature: GYAE6OF02IVR7J.49.11.A11.1.454.CMB.1.raw
  modified_base (252)..(254): a, c, t, g, unknown or other
  misc_feature (252)..(254): n is a, c, g, or t

SEQ ID NO: 135523 - DNA, 521 bp, Homo sapiens
  misc_feature: GYAE6OF02HS189.49.11.A11.1.454.CMB.1.raw
tcagagtcgagagacacgaccggtgctcgatttagctacgactgcaggggggcctaaggaagcagcactggtggtgcctcagccatggcctggaccgttctcctcctcggcctcctctctcactgcacagactctgtgacctcctatgtgctgactcagccaccctcggtgtcagtggcccctggacagacggccaggattacctgtgggggaaacgacatttgaagtaagactgtgcactggtaccagcagaagccaggccaggcccctgtgctggtcgtctatggtgatggcgaccggccctcagggatccctgagcgattctctggctccaactctgggaacccggccaccctgaccatcagccgggtcgaagacggggatgaggccgactatactgtcaggtgtgggataggtggtagtggtgtcgtcttcggagcgtgggaccagggtcaccgtctaggtcagcccaaggccaacccgactcgtcactctcgtcccgcctcctctctctcgactcg

SEQ ID NO: 135524 - DNA, 198 bp, Homo sapiens
  misc_feature: GYAE6OF02GT2CS.49.11.A11.1.454.CMB.1.raw
  modified_base (162)..(198): a, c, t, g, unknown or other
  misc_feature (162)..(198): n is a, c, g, or t
tcagagtcgagagacacgaccggtgctcgatttagctacgactgcagggagcttacgtgactaggccggccttaattaaggtccagcctaaggctgccccagcgtcactctgttcccaccctcctctctctcgactctgagcgggctggcaaggcgcatagnnnnnnnnnnnnnnnnnnnnnnnnnnnnnnnnnnnnn

SEQ ID NO: 135525 - DNA, 265 bp, Homo sapiens
  misc_feature: GYAE6OF02H308W.49.11.A11.1.454.CMB.1.raw
  modified_base (250)..(265): a, c, t, g, unknown or other
  misc_feature (250)..(265): n is a, c, g, or t
tcagagtcgagagacacgaccggtgctcgatttagctacgactgcagggaacccggccaccctgaccatcagccgggtcgaagacgggatgaggccgactattactgtcaggtgtgggatagtggtagtggtgtcgtcttcggagctgggaccagggtcaccgtcctaggtcagcccaaggccaaccccactgtcactctgttcccacctcctctctctcgactctgagcgggctggcaaggcgcatagnnnnnnnnnnnnnnnn

SEQ ID NO: 135526 - DNA, 252 bp, Homo sapiens; identical to SEQ ID NO: 134844
  misc_feature: GYAE6OF02IEA5F.49.11.A11.1.454.CMB.1.raw
  modified_base (252)..(252): a, c, t, g, unknown or other
  misc_feature (252)..(252): n is a, c, g, or t

SEQ ID NO: 135527 - DNA, 256 bp, Homo sapiens
  misc_feature: GYAE6OF02GO4AR.49.11.A11.1.454.CMB.1.raw
  modified_base (251)..(256): a, c, t, g, unknown or other
  misc_feature (251)..(256): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccacctcctctctctcgactctgagcgggctggcaaggcgcatagnnnnnn

SEQ ID NO: 135528 - DNA, 254 bp, Homo sapiens; identical to SEQ ID NO: 134785
  misc_feature: GYAE6OF02GLX3F.49.11.A11.1.454.CMB.1.raw
  modified_base (251)..(254): a, c, t, g, unknown or other
  misc_feature (251)..(254): n is a, c, g, or t

SEQ ID NO: 135529 - DNA, 260 bp, Homo sapiens
  misc_feature: GYAE6OF02G7EEW.49.11.A11.1.454.CMB.1.raw
  modified_base (250)..(260): a, c, t, g, unknown or other
  misc_feature (250)..(260): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccacctcctctctctcactctgagcgggctggcaaggcgcatagnnnnnnnnnnn

SEQ ID NO: 135530 - DNA, 254 bp, Homo sapiens; identical to SEQ ID NO: 134747
  misc_feature: GYAE6OF02H4MEM.49.11.A11.1.454.CMB.1.raw
  modified_base (251)..(254): a, c, t, g, unknown or other
  misc_feature (251)..(254): n is a, c, g, or t

SEQ ID NO: 135531 - DNA, 254 bp, Homo sapiens; identical to SEQ ID NO: 134762
  misc_feature: GYAE6OF02IXSNU.49.11.A11.1.454.CMB.1.raw
  modified_base (252)..(254): a, c, t, g, unknown or other
  misc_feature (252)..(254): n is a, c, g, or t

SEQ ID NO: 135532 - DNA, 254 bp, Homo sapiens; identical to SEQ ID NO: 134762
  misc_feature: GYAE6OF02I7T3U.49.11.A11.1.454.CMB.1.raw
  modified_base (252)..(254): a, c, t, g, unknown or other
  misc_feature (252)..(254): n is a, c, g, or t

SEQ ID NO: 135533 - DNA, 253 bp, Homo sapiens; identical to SEQ ID NO: 134759
  misc_feature: GYAE6OF02FY4CP.49.11.A11.1.454.CMB.1.raw
  modified_base (252)..(253): a, c, t, g, unknown or other
  misc_feature (252)..(253): n is a, c, g, or t

SEQ ID NO: 135534 - DNA, 253 bp, Homo sapiens; identical to SEQ ID NO: 134809
  misc_feature: GYAE6OF02GYYCY.49.11.A11.1.454.CMB.1.raw
  modified_base (252)..(253): a, c, t, g, unknown or other
  misc_feature (252)..(253): n is a, c, g, or t

SEQ ID NO: 135535 - DNA, 249 bp, Homo sapiens
  misc_feature: GYAE6OF02J001L.49.11.A11.1.454.CMB.1.raw
  modified_base (239)..(249): a, c, t, g, unknown or other
  misc_feature (239)..(249): n is a, c, g, or t
tcagagtcgagagacacgaccggtgctcgatttagctacgactgcaggaaccgaccacctgaccatcagccggtcgaagacgggatgaggccgactattactgtcaggtgtggatagtggtagtggtgtcgtcttcggagctggaccagggtcacgtcctaggtcagcccaaggccaacccactgtcactctgttcccgcctcctctctctcgactctgagcggctggcagcgcatagnnnnnnnnnnn

SEQ ID NO: 135536 - DNA, 535 bp, Homo sapiens
  misc_feature: GYAE6OF02HH582.49.11.A11.1.454.CMB.1.raw
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagccaccctcggtgtcagtggcccctggacagacggccaggattacctgtgggggaaacacattggaagtaagactgtgcactggtaccagcagaagccaggccaggcccctgtgctggtcgtctatggtgatggcgaccggccctcagggactcccgtgagcgattctctggctccaactcgtgggaacccggccaccctgaccatcagccgggtcgaaggcggggatggaggccgactattacgtgtcaggtgtgggataggtggtagtggtgtcgtcgttgggagcgtgggacctaggggtccaccgtccgtaggtcacgcccaaggcccaacccactcgcactctcgttcccgcccttctctctctcgactcg

SEQ ID NO: 135537 - DNA, 253 bp, Homo sapiens; identical to SEQ ID NO: 134940
  misc_feature: GYAE6OF02FKD8F.49.11.A11.1.454.CMB.1.raw
  modified_base (251)..(253): a, c, t, g, unknown or other
  misc_feature (251)..(253): n is a, c, g, or t

SEQ ID NO: 135538 - DNA, 255 bp, Homo sapiens; identical to SEQ ID NO: 134799
  misc_feature: GYAE6OF02I9LTL.49.11.A11.1.454.CMB.1.raw
  modified_base (252)..(255): a, c, t, g, unknown or other
  misc_feature (252)..(255): n is a, c, g, or t

SEQ ID NO: 135539 - DNA, 563 bp, Homo sapiens
  misc_feature: GYAE6OF02HGHMH.49.11.A11.1.454.CMB.1.raw
  modified_base (216)..(216): a, c, t, g, unknown or other
  misc_feature (216)..(216): n is a, c, g, or t
  modified_base (517)..(517): a, c, t, g, unknown or other
  misc_feature (517)..(517): n is a, c, g, or t
tcagagtcgagagacacgaccggtgctcgatttagctacgactgcaggggggcctaaggaagcagcactggtggtgcctcagccatggcctggaccgttctcctcctcggcctcctctctcactgcacagactctgtgacctcctatgtgctgactcagccaccctcggtgtcagtggcccctggacagacggccaggattacctgtggggaaacncattggaagtaagactgtgcactggtaccagcagaagccaggccaggcccctgtgctggtcgtctatggtgatggccgaccggccctcgagggactcccgtgagcgattctctggctccaatctcgggaacccgccaccctgacccatccgacggtcccgggtacgaaggaccgggggatcggacgggcccgaacgttattaacgtgtcgagggtggtgggataggtggtagtggtcgtcgtcgttcggagtcgtgggaccgagggtccaccgtcgtaggtcacgcccgaagcccaacccncgtcgtccaccgtctcgttcccacccgtcctcgtcctctcgactcg

SEQ ID NO: 135540 - DNA, 255 bp, Homo sapiens; identical to SEQ ID NO: 134817
  misc_feature: GYAE6OF02I0Y0D.49.11.A11.1.454.CMB.1.raw
  modified_base (252)..(255): a, c, t, g, unknown or other
  misc_feature (252)..(255): n is a, c, g, or t

SEQ ID NO: 135541 - DNA, 253 bp, Homo sapiens; identical to SEQ ID NO: 134759
  misc_feature: GYAE6OF02FTSCX.49.11.A11.1.454.CMB.1.raw
  modified_base (252)..(253): a, c, t, g, unknown or other
  misc_feature (252)..(253): n is a, c, g, or t

SEQ ID NO: 135542 - DNA, 253 bp, Homo sapiens
  misc_feature: GYAE6OF02GV1OX.49.11.A11.1.454.CMB.1.raw
  modified_base (251)..(253): a, c, t, g, unknown or other
  misc_feature (251)..(253): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccacctcctctctctcgactctgagcgggctggcaaggcgcatagnnn

SEQ ID NO: 135543 - DNA, 269 bp, Homo sapiens
  misc_feature: GYAE6OF02IVJ8Q.49.11.A11.1.454.CMB.1.raw
  modified_base (252)..(269): a, c, t, g, unknown or other
  misc_feature (252)..(269): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccaccctcctctctctcgactctgagcgggctggcaaggcgcatagnnnnnnnnnnnnnnnnnn

SEQ ID NO: 135544 - DNA, 253 bp, Homo sapiens; identical to SEQ ID NO: 134809
  misc_feature: GYAE6OF02GBSHY.49.11.A11.1.454.CMB.1.raw
  modified_base (252)..(253): a, c, t, g, unknown or other
  misc_feature (252)..(253): n is a, c, g, or t

SEQ ID NO: 135545 - DNA, 253 bp, Homo sapiens; identical to SEQ ID NO: 134809
  misc_feature: GYAE6OF02H3E16.49.11.A11.1.454.CMB.1.raw
  modified_base (252)..(253): a, c, t, g, unknown or other
  misc_feature (252)..(253): n is a, c, g, or t

SEQ ID NO: 135546 - DNA, 336 bp, Homo sapiens
  misc_feature: GYAE6OF02HNBQ3.49.11.A11.1.454.CMB.1.raw
  modified_base (262)..(264): a, c, t, g, unknown or other
  misc_feature (262)..(264): n is a, c, g, or t
  modified_base (266)..(268): a, c, t, g, unknown or other
  misc_feature (266)..(268): n is a, c, g, or t
  modified_base (271)..(273): a, c, t, g, unknown or other
  misc_feature (271)..(273): n is a, c, g, or t
  modified_base (275)..(336): a, c, t, g, unknown or other
  misc_feature (275)..(336): n is a, c, g, or t
tcagagtcgagagacacgaccggtgctcgatttagctacgactgcggggaacccggccacccgtgaccaatcagccgggtcgaaggacggggatgaaggccgactattactgtcacggtgtgggatagttggtagtggtgtcgtcttcggagctgggaccagggtcaccggtcctaggtcagcccaaggcccaaccccactgtcactcctgttcccgcctcctctctctcgactctgagcgggctggcaagggcgcatacgnnntnnncannnannnnnnnnnnnnnnnnnnnnnnnnnnnnnnnnnnnnnnnnnnnnnnnnnnnnnnnnnnnnnn

SEQ ID NO: 135547 - DNA, 252 bp, Homo sapiens; identical to SEQ ID NO: 134773
  misc_feature: GYAE6OF02H1HPZ.49.11.A11.1.454.CMB.1.raw
  modified_base (252)..(252): a, c, t, g, unknown or other
  misc_feature (252)..(252): n is a, c, g, or t

SEQ ID NO: 135548 - DNA, 803 bp, Homo sapiens
  misc_feature: GYAE6OF02H7QHK.49.11.A11.1.454.CMB.1.raw
  modified_base (776)..(776): a, c, t, g, unknown or other
  misc_feature (776)..(776): n is a, c, g, or t
tcagagtcgagagacacgaccggtgctcgatttagctacgactgcagggggggcctaaggaagcagcactggtggtgcctcagccatggcctggactgtctcctcgtcgcctcctctctcactgacacagactcgtgtcgtacctctatgtgtctgactcgacgccctaccgtggtcgtcgtaggtccggcccgtaggacgacggaccggaccgaaggtacttaccgtggggtaacggggaaaccacttaggttagggaaaagtaacgtacgtggtcgacctacggttaccggtaaccagacgaaaggaaccgcccggaacggcccgtaacccggtccccgttggtccgtcggttcgggttccgttacgttaggtcgggtagtaggttccgggacccggaccccggtccctacggacgggtacccttcccggaggacgtcgttacttccgtcggtcggtccctaacccgtaacgttccgggtaacccgggggaaccccctccctaacccgtacgaacccgtataccggaccggggtcccggggtaacggaacggggacggggtagtacgggaccggtacccgtaagtttaacgttacggtcggtacggtaggggttgggtagggtaagttgggttagggttaggttgggttcgttccggttcggttacgggacgttcgggtaccgggaccgtacgggtccctaccgttcggtaggaccgaccgacccgaccggaccccaaccgtgtaccgtacaccgttccgtacccgttaccccncccttccttcccgtcttcccgactccg

SEQ ID NO: 135549 - DNA, 255 bp, Homo sapiens; identical to SEQ ID NO: 134817
  misc_feature: GYAE6OF02IWG4T.49.11.A11.1.454.CMB.1.raw
  modified_base (252)..(255): a, c, t, g, unknown or other
  misc_feature (252)..(255): n is a, c, g, or t

SEQ ID NO: 135550 - DNA, 275 bp, Homo sapiens
  misc_feature: GYAE6OF02H7XRZ.49.11.A11.1.454.CMB.1.raw
  modified_base (252)..(275): a, c, t, g, unknown or other
  misc_feature (252)..(275): n is a, c, g, or t
tcagagtcgagagacacgaccggtgctcgatttagctacgactgcagggaacccggccgaccctgaccatcagccgggtcgaagacggggatgaggccgactattactgtcaggtgtgggatagtggtagtggtgtcgtcttcggagctgggaccagggtcaccgtcctaggtcagcccaaggccaacccactgtcactctgttcccaccctctctctctcgactctgagcgggctggcaaggcgcaatagnnnnnnnnnnnnnnnnnnnnnnnn

SEQ ID NO: 135551 - DNA, 161 bp, Homo sapiens; identical to SEQ ID NO: 134859
  misc_feature: GYAE6OF02G3ABZ.49.11.A11.1.454.CMB.1.raw
  modified_base (161)..(161): a, c, t, g, unknown or other
  misc_feature (161)..(161): n is a, c, g, or t

SEQ ID NO: 135552 - DNA, 140 bp, Homo sapiens
  misc_feature: GYAE6OF02H9RFZ.49.11.A11.1.454.CMB.1.raw
  modified_base (140)..(140): a, c, t, g, unknown or other
  misc_feature (140)..(140): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcn

SEQ ID NO: 135553 - DNA, 279 bp, Homo sapiens
  misc_feature: GYAE6OF02G7OHQ.49.11.A11.1.454.CMB.1.raw
  modified_base (252)..(279): a, c, t, g, unknown or other
  misc_feature (252)..(279): n is a, c, g, or t
tcagagtcgagagacacgaccggtgctcgatttagctacgactgcagggaacccgggccaccctgaccatcagccgggtcgaagacggggatgaggccgactattacctgtcaggtgtgggatagtggtagtggtgtcgtcttcggagctgggaccagggtcaccgtcctaggtcagcccaaggccaaccccactgtcactctgttcccacctcctctctctcgactctgagcggctggcaaggcgcatagnnnnnnnnnnnnnnnnnnnnnnnnnnnn

SEQ ID NO: 135554 - DNA, 254 bp, Homo sapiens; identical to SEQ ID NO: 134762
  misc_feature: GYAE6OF02JEFIN.49.11.A11.1.454.CMB.1.raw
  modified_base (252)..(254): a, c, t, g, unknown or other
  misc_feature (252)..(254): n is a, c, g, or t

SEQ ID NO: 135555 - DNA, 254 bp, Homo sapiens; identical to SEQ ID NO: 134762
  misc_feature: GYAE6OF02GHHA9.49.11.A11.1.454.CMB.1.raw
  modified_base (252)..(254): a, c, t, g, unknown or other
  misc_feature (252)..(254): n is a, c, g, or t

SEQ ID NO: 135556 - DNA, 269 bp, Homo sapiens
  misc_feature: GYAE6OF02FYC9S.49.11.A11.1.454.CMB.1.raw
  modified_base (252)..(269): a, c, t, g, unknown or other
  misc_feature (252)..(269): n is a, c, g, or t
tcagagtcgagagacacgaccggtgctcgatttagctacgactgcagggaacccggccgaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccacctcctctctctcgactctgagcgggctggcaaggcgcatagnnnnnnnnnnnnnnnnnn

SEQ ID NO: 135557 - DNA, 526 bp, Homo sapiens
  misc_feature: GYAE6OF02IT71P.49.11.A11.1.454.CMB.1.raw
  modified_base (488)..(488): a, c, t, g, unknown or other
  misc_feature (488)..(488): n is a, c, g, or t
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagccaccctcggtgtcagtggcccctggacagacggccaggattacctgtggggaaacacattggaagtaagactgtgcactggtaccagcagaagccaggccaggcccctgtgctggtcgtctatggtgatggcgaccggccctcgagggactccctgagcgattctctggctccaactctcgggaacccgccaccctgaccatcagccgggtcgaagacggggatggacggccgactatactgtcaggtgtgggataggtggtagtggtgtcgtcttcggagcgtgggaccagggtcaccgtcctaggtcagcccaaggcccaacccncgtcgtcactctcgttcccacctctcctctctcgatcg

SEQ ID NO: 135558 - DNA, 260 bp, Homo sapiens
  misc_feature: GYAE6OF02JIGIX.49.11.A11.1.454.CMB.1.raw
  modified_base (252)..(260): a, c, t, g, unknown or other
  misc_feature (252)..(260): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccaccctcctctctctcgactctgagcgggctggcaaggcgcatagnnnnnnnnn

SEQ ID NO: 135559 - DNA, 253 bp, Homo sapiens; identical to SEQ ID NO: 134759
  misc_feature: GYAE6OF02F4JJ1.49.11.A11.1.454.CMB.1.raw
  modified_base (252)..(253): a, c, t, g, unknown or other
  misc_feature (252)..(253): n is a, c, g, or t

SEQ ID NO: 135560 - DNA, 160 bp, Homo sapiens; identical to SEQ ID NO: 135418
  misc_feature: GYAE6OF02JOMWI.49.11.A11.1.454.CMB.1.raw
  modified_base (160)..(160): a, c, t, g, unknown or other
  misc_feature (160)..(160): n is a, c, g, or t

SEQ ID NO: 135561 - DNA, 254 bp, Homo sapiens
  misc_feature: GYAE6OF02HJG2F.49.11.A11.1.454.CMB.1.raw
  modified_base (250)..(254): a, c, t, g, unknown or other
  misc_feature (250)..(254): n is a, c, g, or t
tcagagtcgagagacacgaccggtgctcgatttagctacgactgcgggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccaccctcctctctctcgactctgagcggctggcaaggcgcatagnnnnn

SEQ ID NO: 135562 - DNA, 255 bp, Homo sapiens; identical to SEQ ID NO: 134799
  misc_feature: GYAE6OF02FHGYV.49.11.A11.1.454.CMB.1.raw
  modified_base (252)..(255): a, c, t, g, unknown or other
  misc_feature (252)..(255): n is a, c, g, or t

SEQ ID NO: 135563 - DNA, 255 bp, Homo sapiens; identical to SEQ ID NO: 134799
  misc_feature: GYAE6OF02HWXZ0.49.11.A11.1.454.CMB.1.raw
  modified_base (252)..(255): a, c, t, g, unknown or other
  misc_feature (252)..(255): n is a, c, g, or t

SEQ ID NO: 135564 - DNA, 255 bp, Homo sapiens; identical to SEQ ID NO: 134799
  misc_feature: GYAE6OF02FRKHU.49.11.A11.1.454.CMB.1.raw
  modified_base (252)..(255): a, c, t, g, unknown or other
  misc_feature (252)..(255): n is a, c, g, or t

SEQ ID NO: 135565 - DNA, 256 bp, Homo sapiens; identical to SEQ ID NO: 135527
  misc_feature: GYAE6OF02I9CFW.49.11.A11.1.454.CMB.1.raw
  modified_base (251)..(256): a, c, t, g, unknown or other
  misc_feature (251)..(256): n is a, c, g, or t

SEQ ID NO: 135566 - DNA, 294 bp, Homo sapiens
  misc_feature: GYAE6OF02I3FU1.49.11.A11.1.454.CMB.1.raw
  modified_base (258)..(294): a, c, t, g, unknown or other
  misc_feature (258)..(294): n is a, c, g, or t
tcagagtcgagagacacgaccggtgctcgatttagctacgactgcagggaacccggccaccctgaccactccagccgggtcgaagacggggatgaggccgactattactgtcaggtgtgggatagtggtagtggtgtcgtcttcggaggctgggaccagggtcaccgtcctaggtcagtcccaaggccaaccccactgtcactctgttcccgccctcctctctcgtcgactctgagcgggcgtggcaaggcgcatagnnnnnnnnnnnnnnnnnnnnnnnnnnnnnnnnnnnnn

SEQ ID NO: 135567 - DNA, 256 bp, Homo sapiens; identical to SEQ ID NO: 134845
  misc_feature: GYAE6OF02G0STR.49.11.A11.1.454.CMB.1.raw
  modified_base (252)..(256): a, c, t, g, unknown or other
  misc_feature (252)..(256): n is a, c, g, or t

SEQ ID NO: 135568 - DNA, 258 bp, Homo sapiens
  misc_feature: GYAE6OF02H439E.49.11.A11.1.454.CMB.1.raw
  modified_base (250)..(258): a, c, t, g, unknown or other
  misc_feature (250)..(258): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaacccactgtcactctgttcccaccctctctctctcgactctgagcgggctggcaaggcgcatagnnnnnnnnn

SEQ ID NO: 135569 - DNA, 548 bp, Homo sapiens
  misc_feature: GYAE6OF02F9XP2.49.11.A11.1.454.CMB.1.raw
  modified_base (506)..(506): a, c, t, g, unknown or other
  misc_feature (506)..(506): n is a, c, g, or t
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagccaccctcggtgtcagtggcccctggacagacggccaggattacctggtgggggaaacgacattggaagtaagactgtgcactggtaccagcagaagccaggccaggcccctgtgctggtcgtctatggtgatggcgaccggccctcgagggatccctgagcgattctctggctccaactcgtgggaacccgccaccctgaccatcacggccgggtacgaaggacggggatggacggccgactatactgtcaggtgtggataggtggtagttggtgtcgtcgttcgggagtcgtggggacctaggggtccaccggttcctaggtccaggcccaaggcccaaccccncgtcgccactcctcgttcccgccctcctcctctctcgactcg

SEQ ID NO: 135570 - DNA, 254 bp, Homo sapiens; identical to SEQ ID NO: 134822
  misc_feature: GYAE6OF02IXZCH.49.11.A11.1.454.CMB.1.raw
  modified_base (251)..(254): a, c, t, g, unknown or other
  misc_feature (251)..(254): n is a, c, g, or t

SEQ ID NO: 135571 - DNA, 255 bp, Homo sapiens; identical to SEQ ID NO: 134817
  misc_feature: GYAE6OF02JE6TL.49.11.A11.1.454.CMB.1.raw
  modified_base (252)..(255): a, c, t, g, unknown or other
  misc_feature (252)..(255): n is a, c, g, or t

SEQ ID NO: 135572 - DNA, 530 bp, Homo sapiens
  misc_feature: GYAE6OF02IYSV8.49.11.A11.1.454.CMB.1.raw
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagccacctcggtgtcagtggcccctggacagacggccaggattacctgtgggggaaacacattggaagtaagactgtgcactggtaccagcagaagccaggccaggcccctgtgctggtcgtctatggtgatggcgaccggccctcgagggatccctgagcgattctctggctccaactctgggaacccgcaccctcgaccatcagccgggtacgaagacggggatcggaggccgactattactgtcagggtcgaagacgccaaacttgtcatattcggcggagggaccaaattgaccgtccgtgggtcagcccaaggcctcgcccctcggtccactcctcgtcccacctcctctctcctcgactctgacgg

SEQ ID NO: 135573 - DNA, 254 bp, Homo sapiens; identical to SEQ ID NO: 134802
  misc_feature: GYAE6OF02I35KO.49.11.A11.1.454.CMB.1.raw
  modified_base (252)..(254): a, c, t, g, unknown or other
  misc_feature (252)..(254): n is a, c, g, or t

SEQ ID NO: 135574 - DNA, 257 bp, Homo sapiens; identical to SEQ ID NO: 134898
  misc_feature: GYAE6OF02GJOBT.49.11.A11.1.454.CMB.1.raw
  modified_base (252)..(257): a, c, t, g, unknown or other
  misc_feature (252)..(257): n is a, c, g, or t

SEQ ID NO: 135575 - DNA, 252 bp, Homo sapiens; identical to SEQ ID NO: 134844
  misc_feature: GYAE6OF02FIM9F.49.11.A11.1.454.CMB.1.raw
  modified_base (252)..(252): a, c, t, g, unknown or other
  misc_feature (252)..(252): n is a, c, g, or t

SEQ ID NO: 135576 - DNA, 253 bp, Homo sapiens; identical to SEQ ID NO: 134759
  misc_feature: GYAE6OF02H76RH.49.11.A11.1.454.CMB.1.raw
  modified_base (252)..(253): a, c, t, g, unknown or other
  misc_feature (252)..(253): n is a, c, g, or t

SEQ ID NO: 135577 - DNA, 251 bp, Homo sapiens
  misc_feature: GYAE6OF02IO39Q.49.11.A11.1.454.CMB.1.raw
  modified_base (251)..(251): a, c, t, g, unknown or other
  misc_feature (251)..(251): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccacctcctctctctcgactctgagcgggctggcaaggcgcatagn

SEQ ID NO: 135578 - DNA, 550 bp, Homo sapiens
  misc_feature: GYAE6OF02JAMPL.49.11.A11.1.454.CMB.1.raw
  modified_base (445)..(445): a, c, t, g, unknown or other
  misc_feature (445)..(445): n is a, c, g, or t
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagccaccctcggtgtcagtggcccctggacagacggccaggattacctggtgggggaaacgacattggaagtaagactgtgcactggtaccagcagaagccaggccaggcccctgtgctggtcgtctatggtgatggcgaccggcctcagggatcccgtgagcgattctctggctccaactcgtacgggaaccccgccaccctgaccatcacgccgggtacgaaggacggggatggacggccgactattacgtgtcagggtgtgggataggtggtagtggtgtcgtnttcggagcgtgggaccagggtcaccgtctaggtcacgcccaaggcccaacccacgtcgtccacgtccgttccccacccttcctcttcctcctcgtacctctacgg

SEQ ID NO: 135579 - DNA, 255 bp, Homo sapiens; identical to SEQ ID NO: 134799
  misc_feature: GYAE6OF02G9BSL.49.11.A11.1.454.CMB.1.raw
  modified_base (252)..(255): a, c, t, g, unknown or other
  misc_feature (252)..(255): n is a, c, g, or t

SEQ ID NO: 135580 - DNA, 317 bp, Homo sapiens
  misc_feature: GYAE6OF02HZ5PX.49.11.A11.1.454.CMB.1.raw
  modified_base (198)..(198): a, c, t, g, unknown or other
  misc_feature (198)..(198): n is a, c, g, or t
  modified_base (258)..(265): a, c, t, g, unknown or other
  misc_feature (258)..(265): n is a, c, g, or t
  modified_base (267)..(267): a, c, t, g, unknown or other
  misc_feature (267)..(267): n is a, c, g, or t
  modified_base (270)..(271): a, c, t, g, unknown or other
  misc_feature (270)..(271): n is a, c, g, or t
  modified_base (273)..(317): a, c, t, g, unknown or other
  misc_feature (273)..(317): n is a, c, g, or t
tcagagtcgagagacacgaccggtgctcgatttagctacgactgcgagggaacccgggccaccctgacccatcaggccgggtcgaagacggggatgaggccgacgtacttactgtcaggtgtggggatagtgggtagtggtgtcgtgttcggagctgggaccagggtcaccgtcctaggtcagcccaaggccaacccntgtcactctgttcccaccctctctcgtctcgactctgagcggctggcaaggcgcatagtnnnnnnnnanagnncnnnnnnnnnnnnnnnnnnnnnnnnnnnnnnnnnnnnnnnnnnnnn

SEQ ID NO: 135581 - DNA, 523 bp, Homo sapiens
  misc_feature: GYAE6OF02F36SA.49.11.A11.1.454.CMB.1.raw
tcagagtcgagagacacgaccggtgctcgatttagctacgactgcaggggggcctaaggaagcagcactggtggtgcctcagccatggcctggaccgttctcctcctcggcctcctctctcactgcacagactctgtgacctcctatgtgctgactcagccaccctcggtgtcagtggcccctggacagacggccaggattacctgtgggggaaacgacattggaagtaagactgtgcactggtaccagcagaagccaggccaggcccctgtgctggtcgtctatggtgatggcgaccggccctcagggatccctgagcgattctctggctccaactctgggaacccggccaccctgaccatcagccgggtcgaagacggggatgaggccgactattactgtcaggtgtgggataggtggtagtggtgtcgtcttcggagctgggaccagggtcaccgtcctaggtcagcccaaggccaaccccgactgtcactctgttcccacctcctcctctctcgactcg

SEQ ID NO: 135582 - DNA, 275 bp, Homo sapiens
  misc_feature: GYAE6OF02HMU3B.49.11.A11.1.454.CMB.1.raw
  modified_base (253)..(275): a, c, t, g, unknown or other
  misc_feature (253)..(275): n is a, c, g, or t
tcagagtcgagagacacgaccggtgctcgatttagctacgactgcagggaacccgggccgaccctgaccatcagccgggtcgaagacgggatgaggccgactattactgtcaggtgtgggatagtggtagtggtgtcgtcttcggagctgggaccagggtcaccgtcctaggtcagcccaaggccaaccccactgtcactctgttcccaccctcctctctctcgactctgagcgggctggcaaggcgcatagnnnnnnnnnnnnnnnnnnnnnnn

SEQ ID NO: 135583 - DNA, 254 bp, Homo sapiens; identical to SEQ ID NO: 134762
  misc_feature: GYAE6OF02H5GX5.49.11.A11.1.454.CMB.1.raw
  modified_base (252)..(254): a, c, t, g, unknown or other
  misc_feature (252)..(254): n is a, c, g, or t

SEQ ID NO: 135584 - DNA, 253 bp, Homo sapiens
  misc_feature: GYAE6OF02FT3B7.49.11.A11.1.454.CMB.1.raw
  modified_base (250)..(253): a, c, t, g, unknown or other
  misc_feature (250)..(253): n is a, c, g, or t
tcagagtcgagagacacgaccggtgctcgatttagctacgactgcagggaacccggccaccctgaccatcagccgggtcgaagacgggatgaggccgactattactgtcaggtgtgggatagtggtagtggtgtcgtcttcggagctgggaccagggtcaccgtcctaggtcagcccaaggccaaccccactgtcactctgttcccgcctcctctctctcgactctgagcgggctggcaaggcgcatagnnnn

SEQ ID NO: 135585 - DNA, 340 bp, Homo sapiens
  misc_feature: GYAE6OF02I94E4.49.11.A11.1.454.CMB.1.raw
  modified_base (111)..(111): a, c, t, g, unknown or other
  misc_feature (111)..(111): n is a, c, g, or t
  modified_base (227)..(227): a, c, t, g, unknown or other
  misc_feature (227)..(227): n is a, c, g, or t
  modified_base (261)..(266): a, c, t, g, unknown or other
  misc_feature (261)..(266): n is a, c, g, or t
  modified_base (271)..(272): a, c, t, g, unknown or other
  misc_feature (271)..(272): n is a, c, g, or t
  modified_base (275)..(340): a, c, t, g, unknown or other
  misc_feature (275)..(340): n is a, c, g, or t
tcagagtcgagagacacgaccggtgctcgatttagctacgactgcaggggaacccggccaccctgaccatcagccgggtcgaagaccggggatgacggccgactaattacngtcaggtgtgggatagtcggttagtggtgtcggtcttcggagctagggacccagggtcaccgttcctaggtcagcccaaggccaaccccatgtcactctgttcccacctcgtctcnctcgactctggagcgggctggcaaggcgcatagnnnnnngaacnncgnnnnnnnnnnnnnnnnnnnnnnnnnnnnnnnnnnnnnnnnnnnnnnnnnnnnnnnnnnnnnnnnnn

SEQ ID NO: 135586 - DNA, 254 bp, Homo sapiens; identical to SEQ ID NO: 134762
  misc_feature: GYAE6OF02IIMFF.49.11.A11.1.454.CMB.1.raw
  modified_base (252)..(254): a, c, t, g, unknown or other
  misc_feature (252)..(254): n is a, c, g, or t

SEQ ID NO: 135587 - DNA, 254 bp, Homo sapiens; identical to SEQ ID NO: 134802
  misc_feature: GYAE6OF02F4OV7.49.11.A11.1.454.CMB.1.raw
  modified_base (252)..(254): a, c, t, g, unknown or other
  misc_feature (252)..(254): n is a, c, g, or t

SEQ ID NO: 135588 - DNA, 261 bp, Homo sapiens
  misc_feature: GYAE6OF02H5GRK.49.11.A11.1.454.CMB.1.raw
  modified_base (252)..(261): a, c, t, g, unknown or other
  misc_feature (252)..(261): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccgccctcctctctctcgactctgagcgggctggcaaggcgcatagnnnnnnnnnn

SEQ ID NO: 135589 - DNA, 256 bp, Homo sapiens; identical to SEQ ID NO: 134784
  misc_feature: GYAE6OF02HZT62.49.11.A11.1.454.CMB.1.raw
  modified_base (252)..(256): a, c, t, g, unknown or other
  misc_feature (252)..(256): n is a, c, g, or t

SEQ ID NO: 135590 - DNA, 255 bp, Homo sapiens; identical to SEQ ID NO: 134799
  misc_feature: GYAE6OF02HWUJ7.49.11.A11.1.454.CMB.1.raw
  modified_base (252)..(255): a, c, t, g, unknown or other
  misc_feature (252)..(255): n is a, c, g, or t

SEQ ID NO: 135591 - DNA, 576 bp, Homo sapiens
  misc_feature: GYAE6OF02GV6A7.49.11.A11.1.454.CMB.1.raw
  modified_base (292)..(292): a, c, t, g, unknown or other
  misc_feature (292)..(292): n is a, c, g, or t
  modified_base (307)..(307): a, c, t, g, unknown or other
  misc_feature (307)..(307): n is a, c, g, or t
tcagagtcgagagacacgaccggtgctcgatttagctacgactgcagggggcctaaggaagcgagcactggtggtgcctcagccatggcctggaccgttctcctcctcggcctcctctctcactgcacagactctgtgacctcctatgtgctgactcagccacctcggtgtcagtggcccctggacagacggccaggattaccgtgtcgggggaaacacattggaagtaagactgtgcacgtggtaccagcagaagccaggccaggcccctgtgctggtcgtctacgtggtnatggcgaccggcctnagggactccctgacgcgattctcgtgcctaccaactcgtgggaacccgcctacccgtgaccgatcacggccgggtacgaacggacgggatcgacggccgaacgttattactgtacaggtcgtaggatagtggtagtggtgttcgtcttcggagcgtgggaccgtagggtctaccgttccgtaggtccaaggtcccgaaggaccctaacccgacgtcgtaccgtaactccttccgtacccacccgtccttactccgtctacccgtatccg

SEQ ID NO: 135592 - DNA, 255 bp, Homo sapiens; identical to SEQ ID NO: 134799
  misc_feature: GYAE6OF02GVPOT.49.11.A11.1.454.CMB.1.raw
  modified_base (252)..(255): a, c, t, g, unknown or other
  misc_feature (252)..(255): n is a, c, g, or t

SEQ ID NO: 135593 - DNA, 253 bp, Homo sapiens
  misc_feature: GYAE6OF02H01S9.49.11.A11.1.454.CMB.1.raw
  modified_base (252)..(253): a, c, t, g, unknown or other
  misc_feature (252)..(253): n is a, c, g, or t
tcagagtcgagagacacgaccggtgctcgatttagctacgactgcagggaacccggccaccctgaccatcagccgggtcgaagacgggtatgaggccgactattactgtcaggtgtgggatagtggtagtggtgtcgtcttcggagctgggaccagggtcaccgtcctaggtcagcccaaggccaaccccactgtcactctgttcccaccctcctctctctcgactctgagcgggctggcaaggcgcatagnn

SEQ ID NO: 135594 - DNA, 257 bp, Homo sapiens
  misc_feature: GYAE6OF02IDKUP.49.11.A11.1.454.CMB.1.raw
  modified_base (245)..(245): a, c, t, g, unknown or other
  misc_feature (245)..(245): n is a, c, g, or t
  modified_base (251)..(257): a, c, t, g, unknown or other
  misc_feature (251)..(257): n is a, c, g, or t
tcagagtcgagagacacgaccggtgctcgatttagctacgactgcaggaaccggccaccctgaccatcagccggtcgaagacgggatgaggccgacgtattactgtcaggtgtgggatagtggtagtggtgtcgtcttcggagctgggaccagggtcaccgtctaggtcagcccaaggccaaccccactgtcacctctcgttcccgccctcctctctcctgactctgagcgggctggacaaggcncatagnnnnnnn

SEQ ID NO: 135595 - DNA, 256 bp, Homo sapiens
  misc_feature: GYAE6OF02HNQ9F.49.11.A11.1.454.CMB.1.raw
  modified_base (250)..(256): a, c, t, g, unknown or other
  misc_feature (250)..(256): n is a, c, g, or t
tcagagtcgagagacacgaccggtgctcgatttagctacgactgcagggaacccggccaccctgaccatcagccgggtcgaagacgggatgaggccgactattactgtcaggtgtgggatagtggtagtggtgtcgtcttcggagctgggaccagggtcaccgtcctaggtcagcccaaggccaaccccactgtcactctgttcccacctcctctctctcgactctgagcgggctggcaaggcgcatagnnnnnnn

SEQ ID NO: 135596 - DNA, 256 bp, Homo sapiens
  misc_feature: GYAE6OF02IC1Q5.49.11.A11.1.454.CMB.1.raw
  modified_base (249)..(256): a, c, t, g, unknown or other
  misc_feature (249)..(256): n is a, c, g, or t
tcagagtcgagagacacgaccggtgctcgatttagctacgactgcagggaaccggccaccctgaccatcagccggtcgaagacgggatgaggccggactattactgtcaggtgtgggatagtggtagtggtgtcgtcttcggagctgggaccagggtcaccgtcctaggtcagcccaaggccaaccccactgtcactctgttcccgcctcctctctctcgactctgagcgggctggcaaggcgcatagnnnnnnnn

SEQ ID NO: 135597 - DNA, 253 bp, Homo sapiens
  misc_feature: GYAE6OF02G1BQT.49.11.A11.1.454.CMB.1.raw
  modified_base (251)..(253): a, c, t, g, unknown or other
  misc_feature (251)..(253): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaacccactgtcactctgttcccgccctcctctctctcgactctgagcgggctggcaaggcgcatagnnn

SEQ ID NO: 135598 - DNA, 254 bp, Homo sapiens; identical to SEQ ID NO: 134762
  misc_feature: GYAE6OF02GTAGR.49.11.A11.1.454.CMB.1.raw
  modified_base (252)..(254): a, c, t, g, unknown or other
  misc_feature (252)..(254): n is a, c, g, or t

SEQ ID NO: 135599 - DNA, 255 bp, Homo sapiens; identical to SEQ ID NO: 134799
  misc_feature: GYAE6OF02F01JC.49.11.A11.1.454.CMB.1.raw
  modified_base (252)..(255): a, c, t, g, unknown or other
  misc_feature (252)..(255): n is a, c, g, or t

SEQ ID NO: 135600 - DNA, 253 bp, Homo sapiens; identical to SEQ ID NO: 134809
  misc_feature: GYAE6OF02FZCFQ.49.11.A11.1.454.CMB.1.raw
  modified_base (252)..(253): a, c, t, g, unknown or other
  misc_feature (252)..(253): n is a, c, g, or t

SEQ ID NO: 135601 - DNA, 285 bp, Homo sapiens
  misc_feature: GYAE6OF02IAEZB.49.11.A11.1.454.CMB.1.raw
  modified_base (252)..(285): a, c, t, g, unknown or other
  misc_feature (252)..(285): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccaccctcctctctctcgactctgagcgggctggcaaggcgcatagnnnnnnnnnnnnnnnnnnnnnnnnnnnnnnnnnn

SEQ ID NO: 135602 - DNA, 255 bp, Homo sapiens; identical to SEQ ID NO: 134817
  misc_feature: GYAE6OF02HA3UD.49.11.A11.1.454.CMB.1.raw
  modified_base (252)..(255): a, c, t, g, unknown or other
  misc_feature (252)..(255): n is a, c, g, or t

SEQ ID NO: 135603 - DNA, 530 bp, Homo sapiens
  misc_feature: GYAE6OF02GLM3C.49.11.A11.1.454.CMB.1.raw
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagccaccctcggtgtcagtggcccctggacagacggccaggattacctgtgggggaaacgacattggaagtaagactgtgcactggtaccagcagaagccaggccaggcccctgtgctggtcgtctatggtgatggcgaccggccctcgagggatcccctgagcgattctctggctccaactctgggaacccggccaccctgaccatcagccgggtcgaagacggggatgaggccgactattactgtcaggtgtgggataggtggtagtggtgtcgtcttcgggagcgtgggaccaggggtcaccgtcctagggtcagcccaaggcccaacccgctgtccactctcgttcccacctcctctctctcgactcg

SEQ ID NO: 135604 - DNA, 531 bp, Homo sapiens
  misc_feature: GYAE6OF02GB039.49.11.A11.1.454.CMB.1.raw
tcagagtcgagagacacgaccggtgctcgatttagctacgactgcaggggggcctaaggaagcagcactggtggtgcctcagccatggcctggaccgttctcctcctcggcctcctctctcactgcacagactctgtgacctcctatgtgctgactcagccaccctcggtgtcagtggcccctggacagacggccaggattacctgtgggggaaacgacattggaagtaagactgtgcactggtaccagcagaagccaggccaggcccctgtgctggtcgtctatggtgatggcgaccggccctcagggatccctgagcgattctctggctccaactctgggaacccgccaccctgaccatcagccgggtcgaagacggggatggaggccgactattactgtcaggtgtgggataggtggtagtggtgtcgtcttcgggagcgtgggaccagggtcaccggttcctagggtcagcccaaggcccaacccgcgtcgtccactctcgttcccgccctcctctctctcgactcg

SEQ ID NO: 135605 - DNA, 256 bp, Homo sapiens; identical to SEQ ID NO: 134845
  misc_feature: GYAE6OF02IYWGQ.49.11.A11.1.454.CMB.1.raw
  modified_base (252)..(256): a, c, t, g, unknown or other
  misc_feature (252)..(256): n is a, c, g, or t

SEQ ID NO: 135606 - DNA, 253 bp, Homo sapiens; identical to SEQ ID NO: 134759
  misc_feature: GYAE6OF02FMXMR.49.11.A11.1.454.CMB.1.raw
  modified_base (252)..(253): a, c, t, g, unknown or other
  misc_feature (252)..(253): n is a, c, g, or t

SEQ ID NO: 135607 - DNA, 254 bp, Homo sapiens; identical to SEQ ID NO: 134762
  misc_feature: GYAE6OF02H6LDF.49.11.A11.1.454.CMB.1.raw
  modified_base (252)..(254): a, c, t, g, unknown or other
  misc_feature (252)..(254): n is a, c, g, or t

SEQ ID NO: 135608 - DNA, 252 bp, Homo sapiens
  misc_feature: GYAE6OF02JBTMB.49.11.A11.1.454.CMB.1.raw
  modified_base (246)..(252): a, c, t, g, unknown or other
  misc_feature (246)..(252): n is a, c, g, or t
tcagagtcgagagacacgaccggtgctcgatttagctacgactgcaggaacccggccaccctgaccatcagccggtcgaagacgggatgaggccgactattactgtcaggtgtgggatagtggtagtggtgtcgtcttcggagctgggaccagggtcaccgtcctaggtcagcccaaggccaacccactgtcactctgttcccgcctcctctctctcgactctgagcggctggcaaggcgcatagnnnnnnn

SEQ ID NO: 135609 - DNA, 254 bp, Homo sapiens; identical to SEQ ID NO: 134762
  misc_feature: GYAE6OF02IXV5P.49.11.A11.1.454.CMB.1.raw
  modified_base (252)..(254): a, c, t, g, unknown or other
  misc_feature (252)..(254): n is a, c, g, or t

SEQ ID NO: 135610 - DNA, 252 bp, Homo sapiens; identical to SEQ ID NO: 134773
  misc_feature: GYAE6OF02FFC8U.49.11.A11.1.454.CMB.1.raw
  modified_base (252)..(252): a, c, t, g, unknown or other
  misc_feature (252)..(252): n is a, c, g, or t

SEQ ID NO: 135611 - DNA, 252 bp, Homo sapiens; identical to SEQ ID NO: 134836
  misc_feature: GYAE6OF02F74VG.49.11.A11.1.454.CMB.1.raw
  modified_base (252)..(252): a, c, t, g, unknown or other
  misc_feature (252)..(252): n is a, c, g, or t

SEQ ID NO: 135612 - DNA, 255 bp, Homo sapiens; identical to SEQ ID NO: 134799
  misc_feature: GYAE6OF02I9WYP.49.11.A11.1.454.CMB.1.raw
  modified_base (252)..(255): a, c, t, g, unknown or other
  misc_feature (252)..(255): n is a, c, g, or t

SEQ ID NO: 135613 - DNA, 258 bp, Homo sapiens; identical to SEQ ID NO: 134826
  misc_feature: GYAE6OF02GW27L.49.11.A11.1.454.CMB.1.raw
  modified_base (252)..(258): a, c, t, g, unknown or other
  misc_feature (252)..(258): n is a, c, g, or t

SEQ ID NO: 135614 - DNA, 259 bp, Homo sapiens
  misc_feature: GYAE6OF02HW2Z4.49.11.A11.1.454.CMB.1.raw
  modified_base (251)..(259): a, c, t, g, unknown or other
  misc_feature (251)..(259): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccaccctctctctctcgactctgagcgggctggcaaggcgcatagnnnnnnnnn

SEQ ID NO: 135615 - DNA, 256 bp, Homo sapiens; identical to SEQ ID NO: 134784
  misc_feature: GYAE6OF02G28K8.49.11.A11.1.454.CMB.1.raw
  modified_base (252)..(256): a, c, t, g, unknown or other
  misc_feature (252)..(256): n is a, c, g, or t

SEQ ID NO: 135616 - DNA, 255 bp, Homo sapiens
  misc_feature: GYAE6OF02F7XCC.49.11.A11.1.454.CMB.1.raw
  modified_base (250)..(255): a, c, t, g, unknown or other
  misc_feature (250)..(255): n is a, c, g, or t
tcagagtcgagagacacgaccggtgctcgatttagctacgactgcagggaacccggccaccctgaccatcagccgggtcgaagacgggatgaggccgactattactgtcaggtgtgggatagtggtagtggtgtcgtcttcggagctgggaccagggtcaccgtcctaggtcagcccaaggccaaccccactgtcactctgttcccaccctcctctctctcgactcgagcgggctggcaaggcgcatagnnnnnn

SEQ ID NO: 135617 - DNA, 281 bp, Homo sapiens
  misc_feature: GYAE6OF02H1SQ0.49.11.A11.1.454.CMB.1.raw
  modified_base (140)..(140): a, c, t, g, unknown or other
  misc_feature (140)..(140): n is a, c, g, or t
  modified_base (253)..(281): a, c, t, g, unknown or other
  misc_feature (253)..(281): n is a, c, g, or t
tcagagtcgagagacacgaccggtgctcgatttagctacgactgcaggggaacccggccaccctgaccatcagccgggtcgaagacggggatgaggccgactattactgtcaggtgtgggatagtggtagtggtgtcgtnttcggagctgggaccagggtcaccgtcctaggtcagcccaaggccaaccccactgtcactctgttcccaccctcctctctctcgactctgacgcggctggcaaggcgcatagnnnnnnnnnnnnnnnnnnnnnnnnnnnnn

SEQ ID NO: 135618 - DNA, 284 bp, Homo sapiens
  misc_feature: GYAE6OF02HYMEA.49.11.A11.1.454.CMB.1.raw
  modified_base (141)..(141): a, c, t, g, unknown or other
  misc_feature (141)..(141): n is a, c, g, or t
  modified_base (257)..(284): a, c, t, g, unknown or other
  misc_feature (257)..(284): n is a, c, g, or t
tcagagtcgagagacacgaccggtgctcgatttagctacgactgcagggtaacccggccaccctgaccatcagccgggtcgaagacggggatgaggccgactattacctgtcaggtgtgggatagtggtagtggtgtcgtnttcggagctgggaccagggtcaccgtcctaggtcagcccaaggcccaaccccactgtcactcctcgttcccgccctcctctctctcgactctgagcgggctggcaaggcgcatagnnnnnnnnnnnnnnnnnnnnnnnnnnnn

SEQ ID NO: 135619 - DNA, 253 bp, Homo sapiens; identical to SEQ ID NO: 134759
  misc_feature: GYAE6OF02GZ8JN.49.11.A11.1.454.CMB.1.raw
  modified_base (252)..(253): a, c, t, g, unknown or other
  misc_feature (252)..(253): n is a, c, g, or t

SEQ ID NO: 135620 - DNA, 272 bp, Homo sapiens
  misc_feature: GYAE6OF02FM459.49.11.A11.1.454.CMB.1.raw
  modified_base (253)..(253): a, c, t, g, unknown or other
  misc_feature (253)..(253): n is a, c, g, or t
  modified_base (255)..(272): a, c, t, g, unknown or other
  misc_feature (255)..(272): n is a, c, g, or t
tcagagtcgagagacacgaccggtgctcgatttagctacgactgcagggaacccggccaccctgaccatcagccgggttcgaagacggggatgaggccgactattactgtcaggtgtgggatagtggtagtggtgtcgtcttcggagctgggaccagggtcaccgtcctaggtcagcccaaggccaaccccactgtcactctgttcccaccctcctctctctcgactctgagcgggctggcaaggcgcatagngnnnnnnnnnnnnnnnnnn

SEQ ID NO: 135621 - DNA, 252 bp, Homo sapiens; identical to SEQ ID NO: 134773
  misc_feature: GYAE6OF02GT5VS.49.11.A11.1.454.CMB.1.raw
  modified_base (252)..(252): a, c, t, g, unknown or other
  misc_feature (252)..(252): n is a, c, g, or t

SEQ ID NO: 135622 - DNA, 800 bp, Homo sapiens
  misc_feature: GYAE6OF02JKX8J.49.11.A11.1.454.CMB.1.raw
  modified_base (205)..(205): a, c, t, g, unknown or other
  misc_feature (205)..(205): n is a, c, g, or t
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagccacctcggtgtcagtggcccctggacagacggccaggattaccnggtagggggaaacacagttggaagtaagactgtgcacgtggtaccagcagaagccaggccaggcccctgtcgcgtggtcgtctagtggtgagtggccgaccggccctcgacgggactcccgtggacgccggtattcgtcgtgggtcctacccgtaaacttcgtacggggaaaccccggccctaacccgttgaacccaattccgaacggtcccggggtacgaaacgggacggggtactgggaaccggtacccgtaacgttaagtttaaccgtggtaccgtaaggggttcgtaggggtaacgttagggttacgggttaacgggttgggtttcggttaccgttacgggtttaccgggggaacggttccggttacgggggaacccgttaacggggggttccccgtaaacccgggtttcccgtaaaggggttacccgaaccgggtaacccccgtaaacggggtaccccctaaaccccccggtaacggttacccggttaaccctaccggtttaccccggttaccggtttacccccccgacccccgttttccccgttcccgtttaacccttccccgggtttacccgtaccccgtttcccggg

SEQ ID NO: 135623 - DNA, 538 bp, Homo sapiens
  misc_feature: GYAE6OF02HVFAJ.49.11.A11.1.454.CMB.1.raw
  modified_base (495)..(495): a, c, t, g, unknown or other
  misc_feature (495)..(495): n is a, c, g, or t
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagccaccctcggtgtcagtggcccctggacagacggccaggattacctgtgggggaaacacattggaagtaagactgtgcactggtaccagcagaagccaggccaggcccctgtgctggtcgtctatggtgatggcgaccggccctcagggatccctgagcgattctctggctccaactctgggaacccgccaccctgaccatcaggccgggtcgaaggacggggatggacggccgaactattactgtaccagggtgtgggtataggtggtagtggtgtcgtcttcggagcgtgggaccagggtccaccgtctaggtcacgcccgaagcccaacccngtcgtccactcctcgttccccgccctcctctcctctcgactcg

SEQ ID NO: 135624 - DNA, 257 bp, Homo sapiens
  misc_feature: GYAE6OF02FKZFT.49.11.A11.1.454.CMB.1.raw
  modified_base (251)..(257): a, c, t, g, unknown or other
  misc_feature (251)..(257): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccaccctcctctctctcactctgagcgggctggcaaggcgcatagnnnnnnn

SEQ ID NO: 135625 - DNA, 590 bp, Homo sapiens
  misc_feature: GYAE6OF02HD9FZ.49.11.A11.1.454.CMB.1.raw
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagccaccctcggtgtcagtggcccctggacagacggccaggattacctgtggggaaacacattggaagtaagactgtgcactggtaccagcagaagccaggccaggcccctgtgctggtcgtctatggtgatggcgaccggccctcgagggactcccgtgagcgattctctggcctaccaactcgtacgggaaccccggccaccctgaccatcgacggccgggtacgaaggacggggatcggacggccgatattactgtcgaggtgtagggataggtggtagtggtgtcgtcgttcggagcgtgggaccgagggtccaccggttccgtagggtccacgacccgaagggacccaaaccccgtacgttcgtacctaccttccttaccgtttaccccaccccttccctccttccttcccgtaccgtaccttccgg

SEQ ID NO: 135626 - DNA, 254 bp, Homo sapiens; identical to SEQ ID NO: 134762
  misc_feature: GYAE6OF02HT929.49.11.A11.1.454.CMB.1.raw
  modified_base (252)..(254): a, c, t, g, unknown or other
  misc_feature (252)..(254): n is a, c, g, or t

SEQ ID NO: 135627 - DNA, 257 bp, Homo sapiens
  misc_feature: GYAE6OF02HRWQ1.49.11.A11.1.454.CMB.1.raw
  modified_base (251)..(257): a, c, t, g, unknown or other
  misc_feature (251)..(257): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccgccctctctctctcgactctgagcgggctggcaaggcgcatagnnnnnnn

SEQ ID NO: 135628 - DNA, 253 bp, Homo sapiens; identical to SEQ ID NO: 134877
  misc_feature: GYAE6OF02GZ9V1.49.11.A11.1.454.CMB.1.raw
  modified_base (252)..(253): a, c, t, g, unknown or other
  misc_feature (252)..(253): n is a, c, g, or t

SEQ ID NO: 135629 - DNA, 258 bp, Homo sapiens
  misc_feature: GYAE6OF02J1GLB.49.11.A11.1.454.CMB.1.raw
  modified_base (251)..(258): a, c, t, g, unknown or other
  misc_feature (251)..(258): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggcccaaccccatgtcactctgttcccgcctcctctctctcgactctgagcgggctggcaaggcgcatagnnnnnnnn

SEQ ID NO: 135630 - DNA, 256 bp, Homo sapiens
  misc_feature: GYAE6OF02FN6ES.49.11.A11.1.454.CMB.1.raw
  modified_base (251)..(256): a, c, t, g, unknown or other
  misc_feature (251)..(256): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccaccctcctctctctcactctgagcgggctggcaaggcgcatagnnnnnn

SEQ ID NO: 135631 - DNA, 257 bp, Homo sapiens
  misc_feature: GYAE6OF02F9Z6X.49.11.A11.1.454.CMB.1.raw
  modified_base (250)..(257): a, c, t, g, unknown or other
  misc_feature (250)..(257): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccacctcctctctctcactctgagcgggctggcaaggcgcatagnnnnnnnn

SEQ ID NO: 135632 - DNA, 258 bp, Homo sapiens; identical to SEQ ID NO: 135370
  misc_feature: GYAE6OF02GMUFE.49.11.A11.1.454.CMB.1.raw
  modified_base (252)..(258): a, c, t, g, unknown or other
  misc_feature (252)..(258): n is a, c, g, or t

SEQ ID NO: 135633 - DNA, 254 bp, Homo sapiens; identical to SEQ ID NO: 134802
  misc_feature: GYAE6OF02GDVMC.49.11.A11.1.454.CMB.1.raw
  modified_base (252)..(254): a, c, t, g, unknown or other
  misc_feature (252)..(254): n is a, c, g, or t

SEQ ID NO: 135634 - DNA, 253 bp, Homo sapiens; identical to SEQ ID NO: 134759
  misc_feature: GYAE6OF02HJD5N.49.11.A11.1.454.CMB.1.raw
  modified_base (252)..(253): a, c, t, g, unknown or other
  misc_feature (252)..(253): n is a, c, g, or t

SEQ ID NO: 135635 - DNA, 597 bp, Homo sapiens
  misc_feature: GYAE6OF02H7JVA.49.11.A11.1.454.CMB.1.raw
  modified_base (219)..(219): a, c, t, g, unknown or other
  misc_feature (219)..(219): n is a, c, g, or t
  modified_base (378)..(378): a, c, t, g, unknown or other
  misc_feature (378)..(378): n is a, c, g, or t
  modified_base (555)..(555): a, c, t, g, unknown or other
  misc_feature (555)..(555): n is a, c, g, or t
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagccaccctcggtgtcagtcggcccctggacagacggccaggattacctgtgggggaaacncattggaagtaagactgtgcactggtaccagcagaacgccaggccaggcccctgtgctggtcgtctatggtgatggcgaccggccctcgagggactccctgagcgtattctcgtggtcctaccaaccttcgtcgggaaccccggcccacccgtgaaccntcacggcccggggtcgaagggaccggggatacggacgggacccgaacgttagttacgtggtacgagggttggtgggtattaggttggtaggttgggtgttcgtcgttcggagtcgtggggacctagggtccaccgttccgtaggtcaacgcccaaggcccaacccgacgtcgtaccnctccgttacgtccccacccttcctcttccctctccgactccg

SEQ ID NO: 135636 - DNA, 252 bp, Homo sapiens
  misc_feature: GYAE6OF02IYV9P.49.11.A11.1.454.CMB.1.raw
  modified_base (249)..(252): a, c, t, g, unknown or other
  misc_feature (249)..(252): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaacccactgtcactctgttccgcctcctctctctcgactctgagcgggctggcaaggcgcatagnnnn

SEQ ID NO: 135637 - DNA, 532 bp, Homo sapiens
  misc_feature: GYAE6OF02FYVS5.49.11.A11.1.454.CMB.1.raw
  modified_base (443)..(443): a, c, t, g, unknown or other
  misc_feature (443)..(443): n is a, c, g, or t
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagccaccctcggtgtcagtggcccctggacagacggccaggattacctggtgggggaaacgacattggaagtaagactgtgcactggtaccagcagaagccaggccaggcccctgtgctggtcgtctatggtgatggcgaccggccctcagggatccctgagcgattctctggctccaactctgggaacccggccaccctgaccatcagccgggtcgaaggacggggatgaggccgactattactgtcaggtgtgggataggtggtagtggtgtcgtcttcgggngcgtgggaccagggtcaccgtcctaggtcagcccaaggcccaacccacgtcgtcactctcgttcccgccctcctcctctcctcgactcg

SEQ ID NO: 135638 - DNA, 269 bp, Homo sapiens
  misc_feature: GYAE6OF02JDUAT.49.11.A11.1.454.CMB.1.raw
  modified_base (251)..(253): a, c, t, g, unknown or other
  misc_feature (251)..(253): n is a, c, g, or t
  modified_base (255)..(269): a, c, t, g, unknown or other
  misc_feature (255)..(269): n is a, c, g, or t
tcagagtcgagagacacgaccggtgctcgatttagctacgactgcgggaacccggccgaccctcgaccgatcagccggtcgaagacgggatgaggccgactattactgtcaggtgtgggatagtggtagtggtgtcgtcttcggagctgggaccagggtcaccgtcctaggtcagcccaaggccaaccccactgtcactctgttcccaccctcctctctctcgactctgagcggctggcaaggcgcatagnnntnnnnnnnnnnnnnnn

SEQ ID NO: 135639 - DNA, 596 bp, Homo sapiens
  misc_feature: GYAE6OF02GSJ4V.49.11.A11.1.454.CMB.1.raw
  modified_base (546)..(546): a, c, t, g, unknown or other
  misc_feature (546)..(546): n is a, c, g, or t
tcagagtcgagagacacgaccggtgctcgatttagctacgactgcagggggggggcctaaggaagcagcactggtggtgcctcagccatggcctggaccgttctcctcctcggcctcctctctcactgcacagactctgtgacctcctatgtgctgactcagccaccctcggtgtcagtggcccctggacagacggccaggattacctggtgggggaaacgacattggaagtaagactgtgcactggtaccagcagaagccaggccaggcccctgtgctggtcgtctatggtgatgggcgacccggccctcgagggactcccctggagcgattcctctgggctccaactcgtcgggaaccccggcccaccccgtgaccatcacggcccggggtacgaaggacgggggatggaacgggccgaatacgttacgtgtcgagggtgtgggataggttggtaggtggtgtcggtcgttcgggagcgtggggaccgtaggggtccaaccggttccgtagggtccacggaccccaacgggcccaacccccgtntcggtccaccgttcctcgttccccacccttcctcctcctctccgactccg

SEQ ID NO: 135640 - DNA, 288 bp, Homo sapiens
  misc_feature: GYAE6OF02HSZHQ.49.11.A11.1.454.CMB.1.raw
  modified_base (256)..(288): a, c, t, g, unknown or other
  misc_feature (256)..(288): n is a, c, g, or t
tcagagtcgagagacacgaccggtgctcgatttagctacgactgcagggaacccggccaccctgaccattcagccgggtcgaagacgggggagtggaggccgactattactgtcaggtgtgggatagtggtagtggtgtcgtcttcggagctgggacccagggtcaccgtcctaggtcagcccaaggccaaccccactgtcactctgttcccgccctctctctctcgactctgagcgggctggcaaggcgcatagnnnnnnnnnnnnnnnnnnnnnnnnnnnnnnnnn

SEQ ID NO: 135641 - DNA, 254 bp, Homo sapiens; identical to SEQ ID NO: 134762
  misc_feature: GYAE6OF02G4EDL.49.11.A11.1.454.CMB.1.raw
  modified_base (252)..(254): a, c, t, g, unknown or other
  misc_feature (252)..(254): n is a, c, g, or t

SEQ ID NO: 135642 - DNA, 530 bp, Homo sapiens
  misc_feature: GYAE6OF02HHVR1.49.11.A11.1.454.CMB.1.raw
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagccaccctcggtgtcagtggcccctggacagacggcaggattacctgtgggggaaacacattggaagtaagactgtgcactggtaccagcagaagccaggccaggcccctgtgctggtcgtctatggtgatggcgaccggccctcaggggatcccgtgagcgattctctggctccaactctgggaacccggccaccctcgaccatcagcccgggtcgaaggacggggatggaggccgactagttactgtcaggtgtgggatagtggtagtggtgtcgtcttcggagcgtgggaccagggtcaccgtctaggtcagcccaaggcccaacccgctcgtcactctcgtcccaccctcctcctcctctcgactcg

SEQ ID NO: 135643 - DNA, 253 bp, Homo sapiens; identical to SEQ ID NO: 134759
  misc_feature: GYAE6OF02F2UQ5.49.11.A11.1.454.CMB.1.raw
  modified_base (252)..(253): a, c, t, g, unknown or other
  misc_feature (252)..(253): n is a, c, g, or t

SEQ ID NO: 135644 - DNA, 254 bp, Homo sapiens; identical to SEQ ID NO: 134762
  misc_feature: GYAE6OF02G1B8I.49.11.A11.1.454.CMB.1.raw
  modified_base (252)..(254): a, c, t, g, unknown or other
  misc_feature (252)..(254): n is a, c, g, or t

SEQ ID NO: 135645 - DNA, 255 bp, Homo sapiens; identical to SEQ ID NO: 134799
  misc_feature: GYAE6OF02IBRVJ.49.11.A11.1.454.CMB.1.raw
  modified_base (252)..(255): a, c, t, g, unknown or other
  misc_feature (252)..(255): n is a, c, g, or t

SEQ ID NO: 135646 - DNA, 575 bp, Homo sapiens
  misc_feature: GYAE6OF02GL8EA.49.11.A11.1.454.CMB.1.raw
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagccaccctcggtgtcagtggcccctggacagacggccaggattacctggtgggggaaacgacagttggaagtaagactgtgcactggtaccagcagaagccaggccaggcccctgtgctggtcgtctatggtgatgggcgaccggccctcgagggactccccgtgagcgattctcgtggctccaactcgtacgggaaccccgccaccctgaccatcgacgccgggtacgaacggacggggatggacggccgaacgtagttacgtgtcgagggtgtagggataggttggtagtggtgtcgtcgttcgggagtcgtgggtaccgagggtcaccggttccgtaggtcacgcccgaaggccccaacccgcgtcgtaccacctcgttccgttccccgcccttcctcctcctctccgctccg

SEQ ID NO: 135647 - DNA, 565 bp, Homo sapiens
  misc_feature: GYAE6OF02GWCMY.49.11.A11.1.454.CMB.1.raw
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagccaccctcggtgtcagtggcccctggacagacggccaggattacctgtgggggaaacgacattggaagtaagactgtgcactggtaccagcagaagccaggccaggcccctgtgctggtcgtctatggtgatggcgaccggccctcgagggactcccgtgagcgattctctggctccaactcgtcgggacccgccaccctgaccatcacgccgggtacgaaggacgggatggaggccgactattactgtcaggtgtgggataggtggtagtggtgtcgtcgttcgggagtcgtggggaccgaggggtccacccggttccgtagggtcacgccccgaagggcccaaccccgtacgtcgtccacgttccgtaccgttccccgcccttcctcctcctctccgactccg

SEQ ID NO: 135648 - DNA, 270 bp, Homo sapiens
  misc_feature: GYAE6OF02FE0Q3.49.11.A11.1.454.CMB.1.raw
  modified_base (190)..(190): a, c, t, g, unknown or other
  misc_feature (190)..(190): n is a, c, g, or t
  modified_base (244)..(244): a, c, t, g, unknown or other
  misc_feature (244)..(244): n is a, c, g, or t
  modified_base (250)..(270): a, c, t, g, unknown or other
  misc_feature (250)..(270): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtctaggtcagcccaaggccaaccccntgtcactctgttccccaccctctctctctcgactctgagcgggctggcaaggcncatagnnnnnnnnnnnnnnnnnnnnn

SEQ ID NO: 135649 - DNA, 280 bp, Homo sapiens
  misc_feature: GYAE6OF02GSJMS.49.11.A11.1.454.CMB.1.raw
  modified_base (238)..(238): a, c, t, g, unknown or other
  misc_feature (238)..(238): n is a, c, g, or t
  modified_base (253)..(280): a, c, t, g, unknown or other
  misc_feature (253)..(280): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtctttcggagctgggaccgtagggtcaccgtcctaggttcagcccaaggccaacccactgtcactctgttcccgccctcctcgtctcgactctgagcgggntggcaaggcgcatgnnnnnnnnnnnnnnnnnnnnnnnnnnnn

SEQ ID NO: 135650 - DNA, 521 bp, Homo sapiens
  misc_feature: GYAE6OF02F2XSI.49.11.A11.1.454.CMB.1.raw
  modified_base (484)..(484): a, c, t, g, unknown or other
  misc_feature (484)..(484): n is a, c, g, or t
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagccaccctcggtgtcagtggcccctggacagacggccaggattacctgtgggggaaacgacattggaagtaagactgtgcactggtaccagcagaagccaggccaggcccctgtgctggtcgtctatggtgatggcgaccggccctcagggatccctgagcgattctctggctccaactctgggaacccgccaccctgaccatcagccgggtcgaagacggggatgaggccgactattactgtcaggtgtgggataggtggtagtggtgtcgtcttcggagtctgggaccagggtcaccgtctaggtcagcccaaggccaacccntcgtcactctcgttcccacctcctctctctcgactcg

SEQ ID NO: 135651 - DNA, 256 bp, Homo sapiens; identical to SEQ ID NO: 135002
  misc_feature: GYAE6OF02IY66A.49.11.A11.1.454.CMB.1.raw
  modified_base (252)..(256): a, c, t, g, unknown or other
  misc_feature (252)..(256): n is a, c, g, or t

SEQ ID NO: 135652 - DNA, 270 bp, Homo sapiens
  misc_feature: GYAE6OF02ITS30.49.11.A11.1.454.CMB.1.raw
  modified_base (254)..(270): a, c, t, g, unknown or other
  misc_feature (254)..(270): n is a, c, g, or t
tcagagtcgagagacacgaccggtgctcgatttagctacgactgcggggtaacccgggccaccctgaccaatcagccgggtcgaagacggggatgaggccgactattactgtcaggtgtgggatagtggtagtggtgtcgtcttcggagctgggaccagggtcaccgtcctaggtcagcccaaggccaaccccatgtcactctgttcccgccctcctctctctcgactctgagcgggctggcaaggcgcatagnnnnnnnnnnnnnnnnn

SEQ ID NO: 135653 - DNA, 255 bp, Homo sapiens; identical to SEQ ID NO: 134799
  misc_feature: GYAE6OF02IC8U6.49.11.A11.1.454.CMB.1.raw
  modified_base (252)..(255): a, c, t, g, unknown or other
  misc_feature (252)..(255): n is a, c, g, or t

SEQ ID NO: 135654 - DNA, 257 bp, Homo sapiens; identical to SEQ ID NO: 134898
  misc_feature: GYAE6OF02HZK44.49.11.A11.1.454.CMB.1.raw
  modified_base (252)..(257): a, c, t, g, unknown or other
  misc_feature (252)..(257): n is a, c, g, or t

SEQ ID NO: 135655 - DNA, 524 bp, Homo sapiens
  misc_feature: GYAE6OF02G39S9.49.11.A11.1.454.CMB.1.raw
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagccaccctcggtgtcagtggcccctggacagacggccaggattacctgtgggggaaacacattggaagtaagactgtgcactggtaccagcagaagccaggccaggcccctgtgctggtcgtctatggtgatggcgaccggccctcagggatccctgagcgattctctggctccaactctgggacccgccaccctgaccatcagccgggtcgaagacggggatggaggccgactatactgtcaggtgtgggatagtggtagtggtgtcgtcgttcggagtcgtggggaccaggggtccaccgtccgtaggtcagcccaggcccaacccgctgtcactctcgtcccgcctcctcctctctcgctcg

SEQ ID NO: 135656 - DNA, 259 bp, Homo sapiens
  misc_feature: GYAE6OF02GVBX9.49.11.A11.1.454.CMB.1.raw
  modified_base (251)..(259): a, c, t, g, unknown or other
  misc_feature (251)..(259): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccacctcctctctctcgactctgagcgggctggcaaggcgcatagnnnnnnnnn

SEQ ID NO: 135657 - DNA, 601 bp, Homo sapiens
  misc_feature: GYAE6OF02G9T9V.49.11.A11.1.454.CMB.1.raw
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcatatgtgctgactcagccaccctcggtgtcagtggcccctggacagacggccaggattacctgtgggggaaacacattggaagtaagactgtgcactggtaccagcagaagccaggccaggcccctgtgctggtcgtctatggtgatggccgaccggccctcgagggactcccgtgacgcgtattctcgtggctccaactcgtacgggaacccgccaccctgacctagtcgacggccgggtacgaaggacggggatcggacggccgaacgttagttacgtggtacgagggtggtagggattaggtgggttagtgggttcgtcggttcgttggagtcggtcggggaccgtagggtcctaccgtccgtacggtccacggacccgacggcccaaccccgtagtccgtccaaccttccgtccgttccccgccccgttcccttccgtccttcgtccgtaccg

SEQ ID NO: 135658 - DNA, 609 bp, Homo sapiens
  misc_feature: GYAE6OF02H0LIQ.49.11.A11.1.454.CMB.1.raw
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagccaccctcggtgtcagtcggcccctggacagacggccaggacttacctggtgggggaaaacgacagttggaaagtaagactgtgcacgtggtaccagcagaagccaggccaggcccctggtgctggtcgtctatggtgatggccgaccggccctgagggactccctgacgcgtattctcgtggctccaactcgtacgggaacccgccacccgtcgaccatcgacggcccgggtacgaacgggacggggataggacggccgaacttattaccgtgtcgtagggtggtgggtagtaggttggtagtggtgtcgtcgttcgggagtcgtagggaccgtgggtccaccggtctacgggtcacgcccgaacggcccaaccccgtcgtcggtacctaccgtccgttcccggttcccccgcccttcccgtaccttccctcgtcccgtacttcccgg

SEQ ID NO: 135659 - DNA, 556 bp, Homo sapiens
  misc_feature: GYAE6OF02HK0NY.49.11.A11.1.454.CMB.1.raw
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagccaccctcggtgtcagtggcccctggacagacggccaggattacctggtgggggaaacgacattggaagtaagactgtgcactggtaccagcagaagccaggccaggcccctgtgctggtcgtctatggtgatggcgaccggccctcgagggactccccgtgacgcgattctctggctccaactcgtcgggaaccccgccaccctgaccatccagccgggtacgaaggacggggatggaggccgactatactgtcagggtgtgggataggtggtagtggtgtcgtgtcggagcgtgggaccagggtccaccggttcctagggtaccacgacccgaaggcccaaaccccgcgtcgtccaccttctcgttccccgccctcctccttcctctcgactcg

SEQ ID NO: 135660 - DNA, 264 bp, Homo sapiens
  misc_feature: GYAE6OF02IEU3F.49.11.A11.1.454.CMB.1.raw
  modified_base (247)..(264): a, c, t, g, unknown or other
  misc_feature (247)..(264): n is a, c, g, or t
tcagagtcgagagacacgaccggtgctcgatttagctacgactgcagggaacccggccaccctgaccatcagccgggtcgaagacgggatgaggccgactattactgtcaggtgtgggatagtggtagtggtgtcgtcttcggagctgggaccagggtcaccgtcctaggtcagcccaaggccaaccccatgtcactctgttcccacctctctctctcgactctgagcgggctggcaggcgcatagnnnnnnnnnnnnnnnnnn

SEQ ID NO: 135661 - DNA, 254 bp, Homo sapiens; identical to SEQ ID NO: 134793
  misc_feature: GYAE6OF02HP4WZ.49.11.A11.1.454.CMB.1.raw
  modified_base (251)..(254): a, c, t, g, unknown or other
  misc_feature (251)..(254): n is a, c, g, or t

SEQ ID NO: 135662 - DNA, 255 bp, Homo sapiens
  misc_feature: GYAE6OF02HBWJK.49.11.A11.1.454.CMB.1.raw
  modified_base (251)..(255): a, c, t, g, unknown or other
  misc_feature (251)..(255): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccacctcctctctctcgactctgagcgggctggcaaggcgcatagnnnnn

SEQ ID NO: 135663 - DNA, 254 bp, Homo sapiens
  misc_feature: GYAE6OF02FG4YA.49.11.A11.1.454.CMB.1.raw
  modified_base (249)..(254): a, c, t, g, unknown or other
  misc_feature (249)..(254): n is a, c, g, or t
tcagagtcgagagacacgaccggtgctcgatttagctacgactgcagggaacccggccaccctgaccatcagccgggtcgaagacgggatgaggccgactattactgtcaggtgtgggatagtggtagtggtgtcgtcttcggagctgggaccagggtcaccgtcctaggtcagcccaaggccaaccccactgtcactctgttcccgcctctctctctcgactctgagcgggctggcaaggcgcatagnnnnnn

SEQ ID NO: 135664 - DNA, 260 bp, Homo sapiens
  misc_feature: GYAE6OF02J0XN9.49.11.A11.1.454.CMB.1.raw
  modified_base (245)..(245): a, c, t, g, unknown or other
  misc_feature (245)..(245): n is a, c, g, or t
  modified_base (251)..(260): a, c, t, g, unknown or other
  misc_feature (251)..(260): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaacccactgtcactctgttcccaccctcctctctctcgactctgagcgggctggcaaggcncatagnnnnnnnnnn

SEQ ID NO: 135665 - DNA, 262 bp, Homo sapiens
  misc_feature: GYAE6OF02FLAY2.49.11.A11.1.454.CMB.1.raw
  modified_base (250)..(262): a, c, t, g, unknown or other
  misc_feature (250)..(262): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccatgtcactctgttcccacctcctctctctcgactctgagcgggctggcaaggcgcatagnnnnnnnnnnnnn

SEQ ID NO: 135666 - DNA, 902 bp, Homo sapiens
  misc_feature: GYAE6OF02IF6SZ.49.11.A11.1.454.CMB.1.raw
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagccaccctcggtgtcagtggcccctggacagacggccaggattacctgtgggggaaacacattggaagtaagactgtgcactggtaccagcagaagccaggccaggcccctgtgctggtcgtctatggtgatggcgaccggccctcgagggactcccgtgacgcgtaacttcgtcgttggcctcccgaaacctccgttacgggggaaacccccggtccccgaacccccgttacggaacccctaacgttcccgaaacggggtccccgggggtacccggtaaaacggggaccgggggggtaacttcgggaacggggtaccccggaaaccgtttaaacgttttaaaccggttcggttacccgtaagggggtttacgggtttacggggggtaaagtttaggggtttaggggtttaaaggggtttagggggtttcgggtttcccgggtttaccggttttaccgggggtaacggtcccgggtttacggggggtaaaccccggtaaccgggggggtttccccgtaaaccccggggttttcccggtttaaaaccgggggttcccgtaaaccggggtaccccccggtaaaaccggggccccccgtaaaaaccccccccgtacggtttaacccgggttacccccgtaacccgtttcccgtttacccggttttacccccccccaaccccccggttttcccctttacccgtttacccccgtttcccgtttaccccccggtaaccctttccccggg

SEQ ID NO: 135667 - DNA, 300 bp, Homo sapiens
  misc_feature: GYAE6OF02JFDP2.49.11.A11.1.454.CMB.1.raw
  modified_base (266)..(300): a, c, t, g, unknown or other
  misc_feature (266)..(300): n is a, c, g, or t
tcagagtcgagagacacgaccggtgctcgatttagctacgactgcaggggaacccggccgaccctgaccatcagccgggtcgaagacgggggatgaggccgactattacgtgtcaggtgtgggatagtggtacgtggtgtcgtcttcggagctgggaccagggtcacccgtcctaggtcagcccaaggccaaccccactgtcactctgttccccaccctcctctcctctcgactctgagcggggctggctaaggccgacaattagnnnnnnnnnnnnnnnnnnnnnnnnnnnnnnnnnnn

SEQ ID NO: 135668 - DNA, 255 bp, Homo sapiens; identical to SEQ ID NO: 134817
  misc_feature: GYAE6OF02F9KGB.49.11.A11.1.454.CMB.1.raw
  modified_base (252)..(255): a, c, t, g, unknown or other
  misc_feature (252)..(255): n is a, c, g, or t

SEQ ID NO: 135669 - DNA, 254 bp, Homo sapiens; identical to SEQ ID NO: 134802
  misc_feature: GYAE6OF02FTNFG.49.11.A11.1.454.CMB.1.raw
  modified_base (252)..(254): a, c, t, g, unknown or other
  misc_feature (252)..(254): n is a, c, g, or t

SEQ ID NO: 135670 - DNA, 252 bp, Homo sapiens; identical to SEQ ID NO: 135076
  misc_feature: GYAE6OF02GMR1A.49.11.A11.1.454.CMB.1.raw
  modified_base (251)..(252): a, c, t, g, unknown or other
  misc_feature (251)..(252): n is a, c, g, or t

SEQ ID NO: 135671 - DNA, 160 bp, Homo sapiens
  misc_feature: GYAE6OF02ICJ3J.49.11.A11.1.454.CMB.1.raw
tcagagtcgagagacacgaccggtgctcgatttagctacgactgcagggagcttactgactaggccggccttaattaaggtcagcctaaggctgcccccagcgtcactctgttcccaccctcctctctctcgactctgagcgggctggcaaggcgcatag

SEQ ID NO: 135672 - DNA, 284 bp, Homo sapiens
  misc_feature: GYAE6OF02FS7LL.49.11.A11.1.454.CMB.1.raw
  modified_base (254)..(284): a, c, t, g, unknown or other
  misc_feature (254)..(284): n is a, c, g, or t
tcagagtcgagagacacgaccggtgctcgatttagctacgactgccgggaacccgggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccaccctcctctctctcgactctgagcgggctgggcaaggcgcatagnnnnnnnnnnnnnnnnnnnnnnnnnnnnnnn

SEQ ID NO: 135673 - DNA, 254 bp, Homo sapiens; identical to SEQ ID NO: 134762
  misc_feature: GYAE6OF02F9A8X.49.11.A11.1.454.CMB.1.raw
  modified_base (252)..(254): a, c, t, g, unknown or other
  misc_feature (252)..(254): n is a, c, g, or t

SEQ ID NO: 135674 - DNA, 537 bp, Homo sapiens
  misc_feature: GYAE6OF02I7H24.49.11.A11.1.454.CMB.1.raw
  modified_base (486)..(486): a, c, t, g, unknown or other
  misc_feature (486)..(486): n is a, c, g, or t
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagccaccctcggtgtcagtggcccctggacagacggccaggattacctgtgggggaaacgacattggaagtaagactgtgcactggtaccagcagaagccaggccaggcccctgtgctggtcgtctatggtgatggcgaccggccctcgaggggactccctgagcgattctctggctccaactctgggacccgcaccctgaccatcagccgggtcgaagacgggatgaggccgatattactgtcaggtgtgggataggtggtagtggtgtcgtctcgggagtctgggaccagggtcaccgtcctaggtcacgcccaaggcccaacccncgttgtccacgtcctcgttccccgacccttcctccttctcttccgactccg

SEQ ID NO: 135675 - DNA, 691 bp, Homo sapiens
  misc_feature: GYAE6OF02IUHR0.49.11.A11.1.454.CMB.1.raw
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctctatgtgctgactcagccacctcggtgtcagtggcccctggacagacggccaggattacctgtggggaaacacattggaataagactgtgcactggtaccagcagaagccaggccaggcccctgtgctggtctctatcggtgatggcgaccggccctcgagggactccctgacgcgattcgtctggctccaactcgtacgggaccccgcacccgtgaccagtccacggtccgggtacgaacgggtacggggatcggacgggtctacggaacttagtttaccgtggttacgagggttcggtaggggtaatttagggttgggttacggttggggttacgttcggttcgtttaccgggaggttccggtcgggggtaaacccgtagggggttacccaacccgggtttccggtaacggggttaccccaacgggtaccccgaacgggtaccccgaaacccccgtagttaccggttaccctaaccgttccgttttccgggttaacccccctacccttccccgtccctttacccgttcccgtaccggttaaccccg

SEQ ID NO: 135676 - DNA, 251 bp, Homo sapiens
  misc_feature: GYAE6OF02I1N89.49.11.A11.1.454.CMB.1.raw
  modified_base (246)..(251): a, c, t, g, unknown or other
  misc_feature (246)..(251): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccaccctcctctactctgagcgggctggcaaggcgcatagnnnnnn

SEQ ID NO: 135677 - DNA, 253 bp, Homo sapiens; identical to SEQ ID NO: 135542
  misc_feature: GYAE6OF02G9FND.49.11.A11.1.454.CMB.1.raw
  modified_base (251)..(253): a, c, t, g, unknown or other
  misc_feature (251)..(253): n is a, c, g, or t

SEQ ID NO: 135678 - DNA, 258 bp, Homo sapiens; identical to SEQ ID NO: 134826
  misc_feature: GYAE6OF02GG591.49.11.A11.1.454.CMB.1.raw
  modified_base (252)..(258): a, c, t, g, unknown or other
  misc_feature (252)..(258): n is a, c, g, or t

SEQ ID NO: 135679 - DNA, 270 bp, Homo sapiens
  misc_feature: GYAE6OF02F4L53.49.11.A11.1.454.CMB.1.raw
  modified_base (253)..(270): a, c, t, g, unknown or other
  misc_feature (253)..(270): n is a, c, g, or t
tcagagtcgagagacacgaccggtgctcgatttagctacgactgcagggaacccggccgaccctgaccatcagccgggtcgaagacggggatgaggccgactattactgtcaggtgtgggatagtggtagtggtgtcgtcttcggagctgggaccagggtcaccgtcctaggtcagcccaaggccaaccccatgtcactctgttcccgccctcctcgtctctcgactctgagcgggctggcaaggcgcatagnnnnnnnnnnnnnnnnnn

SEQ ID NO: 135680 - DNA, 259 bp, Homo sapiens
  misc_feature: GYAE6OF02G77A1.49.11.A11.1.454.CMB.1.raw
  modified_base (253)..(259): a, c, t, g, unknown or other
  misc_feature (253)..(259): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggcccaaccccactgtcactctcgttcccaccctcctctctctcgactctgagcggctggcaaggcgcatagnnnnnnn

SEQ ID NO: 135681 - DNA, 504 bp, Homo sapiens
  misc_feature: GYAE6OF02FLVRE.49.11.A11.1.454.CMB.1.raw
  modified_base (411)..(411): a, c, t, g, unknown or other
  misc_feature (411)..(411): n is a, c, g, or t
  modified_base (426)..(426): a, c, t, g, unknown or other
  misc_feature (426)..(426): n is a, c, g, or t
  modified_base (477)..(477): a, c, t, g, unknown or other
  misc_feature (477)..(477): n is a, c, g, or t
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagccaccctcggtgtcagtggcccctggacagacggccaggattacctgtgggggaaacacattggaagtaagactgtgcactggtaccagcagaagccgggccaggcccctgtgttggtgatgtataaagacactgagaggccctcagggatccctgagcgattctctggctccaggtcaggggacaacggtcacattggccatcagtggagtccaggcagaggacgaggctgactattatgtcaatcaacngacacattggacttngtcttcgaatgacaccaaggtcaccgtctggcagcccaaggcccaaccccntcgtcactctcgtccccgccctcctcc

SEQ ID NO: 135682 - DNA, 255 bp, Homo sapiens; identical to SEQ ID NO: 134817
  misc_feature: GYAE6OF02F8TND.49.11.A11.1.454.CMB.1.raw
  modified_base (252)..(255): a, c, t, g, unknown or other
  misc_feature (252)..(255): n is a, c, g, or t

SEQ ID NO: 135683 - DNA, 255 bp, Homo sapiens; identical to SEQ ID NO: 135662
  misc_feature: GYAE6OF02G15KU.49.11.A11.1.454.CMB.1.raw
  modified_base (251)..(255): a, c, t, g, unknown or other
  misc_feature (251)..(255): n is a, c, g, or t

SEQ ID NO: 135684 - DNA, 525 bp, Homo sapiens
  misc_feature: GYAE6OF02F41HQ.49.11.A11.1.454.CMB.1.raw
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagccaccctcggtgtcagtggcccctggacagacggccaggattacctgtgggggaaacgacattggaagtaagactgtgcactggtaccagcagaagccaggccaggcccctgtgctggtcgtctatggtgatggcgaccggccctcagggatccctgagcgattctctggctccaactctgggaacccgccaccctgaccatcagccgggtcgaagacggggatgaggccgactattactgtcaggtgtgggataggtgtagtggtgtcgtcttcgggagctgggaccaggggtcaccggtctaggtcagcccaaggccaacccacgtgccactcctcgttcccgccttcctctctctcgactcg

SEQ ID NO: 135685 - DNA, 256 bp, Homo sapiens
  misc_feature: GYAE6OF02H9M3X.49.11.A11.1.454.CMB.1.raw
  modified_base (251)..(256): a, c, t, g, unknown or other
  misc_feature (251)..(256): n is a, c, g, or t
tcagagtcgagagacacgaccggtgctcgatttagctacgactgcagggaacccggccaccctgaccatcagccgggtcgaagacggggatgaggccgactattactgtcaggtgtggatagtggtagtggtgtcgtcttcggagctgggaccagggtcaccgtcctaggtcagcccaaggccaaccccactgtcactctgttcccaccctctctctctcgactctgacgcgggctggcaaggcgcatagnnnnnn

SEQ ID NO: 135686 - DNA, 253 bp, Homo sapiens; identical to SEQ ID NO: 134809
  misc_feature: GYAE6OF02FFQ0K.49.11.A11.1.454.CMB.1.raw
  modified_base (252)..(253): a, c, t, g, unknown or other
  misc_feature (252)..(253): n is a, c, g, or t

SEQ ID NO: 135687 - DNA, 583 bp, Homo sapiens
  misc_feature: GYAE6OF02GUH6L.49.11.A11.1.454.CMB.1.raw
  modified_base (414)..(414): a, c, t, g, unknown or other
  misc_feature (414)..(414): n is a, c, g, or t
  modified_base (424)..(424): a, c, t, g, unknown or other
  misc_feature (424)..(424): n is a, c, g, or t
tcagagtcgagagacacgaccggtgctcgatttagctacgactgcaggggggcctaaggaagcagcactggtggtgcctcagccatggcctggaccgttctcctcctcggcctcctctctcactgcacagactctgtgacctcctatgtgctgactcagccaccctcggtgtcagtggcccctggacagacggccaggattacctggtagggggaaacacattggaagtaagactgtgcactggtaccagcagaagccaggccaggcccctgtgctggtcgtctaatcggtgatggccgaccggccctcgaggggtactccccgtgagcgattctctggcctccaactctcgggaacccgccaccctgaccatcgagccgggtacgaacgacgggatggacggccgactatacngtcaggttgngggataggtggtagtggtgtcgtcttcggagcgtgggaccagggtccaccggtctagggtcacgtcccgaaggtcccaacccgtacgtcggtaccaccgttccgtaccgtttcccccgaaccccttcccttaccgttccctccttcccggtacttccgg

SEQ ID NO: 135688 - DNA, 581 bp, Homo sapiens
  misc_feature: GYAE6OF02IJXN3.49.11.A11.1.454.CMB.1.raw
  modified_base (460)..(460): a, c, t, g, unknown or other
  misc_feature (460)..(460): n is a, c, g, or t
tcagagtcgagagacacgaccggtgctcgatttagctacgactgcaggggggggcctaaggaagcagcactggtggtgcctcagccatggcctggaccgttctcctcctcggcctcctctctcactgcacagactctgtgacctcctatgtgctgactcagccaccctcggtgtcagtggcccctggacagacggccaggattacctggtgggggaaacacagttgggaagtaagactgtgcactggtaccagcagaagccaggccaggccccctgtgctggtcgtctatggtgatggcgaccggccctcgagggctccctgagcgattctctggctccaactcgtcgggaaccccgccaccctcgaccatcacggccgggtacgaagggacggggatcggaggcccgacttatactgtcgagggtgtgggataggtggttagtggttgtcgtcgtcggngtcgtgggaccgaggggtccaccgttccgtacgggtcaccggacccgaacggccccaaacccgcgtcgtacccaccttccttccgtacccctacccttccctccttcctcctccgtactcg

SEQ ID NO: 135689 - DNA, 547 bp, Homo sapiens
  misc_feature: GYAE6OF02FLAZG.49.11.A11.1.454.CMB.1.raw
  modified_base (502)..(502): a, c, t, g, unknown or other
  misc_feature (502)..(502): n is a, c, g, or t
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagccaccctcggtgtcagtggcccctggacagacggccaggattacctgtgggggaaacgacattggaagtaagactgtgcactggtaccaacagaagccaggccaggcccctgtgctggtcgtctatggtgatggcgaccggccctcgagggactccctgagcgattctctggctccaactctcggggaacccggccaccctgaccatcacgccgggtcgaaggacggggatggacggccgactatactgtcgaggtggtggatagtggtagtggtgtcgtcgttcggagtcgtgggaccgtagggtccaccgtccgtaggtcacgacccaaggcccaacccnctcggtcactcgtcgttcccgcccttctctctctcgactcgtcgg

SEQ ID NO: 135690 - DNA, 257 bp, Homo sapiens; identical to SEQ ID NO: 134882
  misc_feature: GYAE6OF02GSY31.49.11.A11.1.454.CMB.1.raw
  modified_base (252)..(257): a, c, t, g, unknown or other
  misc_feature (252)..(257): n is a, c, g, or t

SEQ ID NO: 135691 - DNA, 255 bp, Homo sapiens; identical to SEQ ID NO: 134799
  misc_feature: GYAE6OF02GXL7A.49.11.A11.1.454.CMB.1.raw
  modified_base (252)..(255): a, c, t, g, unknown or other
  misc_feature (252)..(255): n is a, c, g, or t

SEQ ID NO: 135692 - DNA, 261 bp, Homo sapiens
  misc_feature: GYAE6OF02JYWT8.49.11.A11.1.454.CMB.1.raw
  modified_base (250)..(261): a, c, t, g, unknown or other
  misc_feature (250)..(261): n is a, c, g, or t
tcagagtcgagagacacgaccggtgctcgatttagctacgactgcagggaacccggccaccctgaccatcagccgggtcgaagacgggatgaggccgactattactgtcaggtgtgggatagtggtagtggtgtcgtcttcggagctgggaccagggtcaccgtcctaggtcagcccaaggccaaccccactgtcactctgttcccaccctcctctctctcactctgagcgggctggcaaggcgcatagnnnnnnnnnnnn

SEQ ID NO: 135693 - DNA, 575 bp, Homo sapiens
  misc_feature: GYAE6OF02GZSAE.49.11.A11.1.454.CMB.1.raw
  modified_base (327)..(327): a, c, t, g, unknown or other
  misc_feature (327)..(327): n is a, c, g, or t
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagccaccctcggtgtcagtggcccctggacagacggccaggattacctgtgggggaaacgacattggaagtaagactgtgcactggtaccagcagaagccaggccaggcccctgtgctggtcgtctatggtgatggcgaccggccctcgagggatccctgagcgattcnctggctccaactcgtcgggaacccgccacccgtgaccatcacggccgggtcgaacggacggggatcggaacggccgaactattacgtgtcgaggtggtagggataggtggtagtggtgtcgtcttcgggagcgtgggaccgagggtccaccggttccgtaggtccagaccccgaaggcccaaccccgcgttcgtaccacctccgttccgttccccgcccttccctccttccgtcctccgaccttccgg

SEQ ID NO: 135694 - DNA, 256 bp, Homo sapiens; identical to SEQ ID NO: 135002
  misc_feature: GYAE6OF02FQOJN.49.11.A11.1.454.CMB.1.raw
  modified_base (252)..(256): a, c, t, g, unknown or other
  misc_feature (252)..(256): n is a, c, g, or t

SEQ ID NO: 135695 - DNA, 602 bp, Homo sapiens
  misc_feature: GYAE6OF02JIVYD.49.11.A11.1.454.CMB.1.raw
  modified_base (427)..(427): a, c, t, g, unknown or other
  misc_feature (427)..(427): n is a, c, g, or t
tcagagtcgagagacacgaccggtgctcgatttagctacgactgcagggggggcctaaggaagcagcactggtggtgcctcagccatggcctgaaccgttctcctcctcggcctcctctctcactgcacagactctgtgacctcctatgtgctgactcagccaccctcggtgtcagtggcccctggacagacggccaggattacctggtgggggaaacacattggaagtaagactgtgcactggtaccagcagaagccaggccaggcccctgtgctggtcgtctatggtgatggcgaccggccctcgagggactccctgacgcgattctcgtggcctccaactcgtcgggaaccccgccaccctgaccatccgacggcccgggtcgaacggacggggatggacggccgatacttactgtcgaggtgngggataggtggtagtggtgtcgtcgttcggagtcgtagggacctaggggtccaccggttccgtacggtccgacgcccgaacgggccccaacccgcgttcggtcctaaccgttccgttaccggtttccccccgaccccttcccgttccttacccgtccgtacccgtaccgttccgg

SEQ ID NO: 135696 - DNA, 255 bp, Homo sapiens; identical to SEQ ID NO: 134799
  misc_feature: GYAE6OF02IN9NQ.49.11.A11.1.454.CMB.1.raw
  modified_base (252)..(255): a, c, t, g, unknown or other
  misc_feature (252)..(255): n is a, c, g, or t

SEQ ID NO: 135697 - DNA, 574 bp, Homo sapiens
  misc_feature: GYAE6OF02GBPTX.49.11.A11.1.454.CMB.1.raw
  modified_base (458)..(458): a, c, t, g, unknown or other
  misc_feature (458)..(458): n is a, c, g, or t
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagccaccctcggtgtcagtggcccctggacagacggccaggattacctggtgggggaaacacattggaagtaagactgtgcactggtaccagcagaagccaggccaggcccctgtgctggtcgtctatggtgatggcgaccggccctcgagggactccccgtgacgcgtattctcgtggcctccaactcgtcgggaaccccgccacccctgaccatcacggccgggtacgaaggacggggatggacggccgactattactgtcgaggtgtagggatagtggtagtggtgtcgtcgtcggngtcgtgggacctagggtcctaccgttcgtaggtcacgcccgaaggccccaaccccgtacgtcgtaccaccgttccgttccgttcccctacccttccttcctcctcctccgacttcg

SEQ ID NO: 135698 - DNA, 676 bp, Homo sapiens
  misc_feature: GYAE6OF02I9Y2B.49.11.A11.1.454.CMB.1.raw
  modified_base (266)..(266): a, c, t, g, unknown or other
  misc_feature (266)..(266): n is a, c, g, or t
  modified_base (631)..(631): a, c, t, g, unknown or other
  misc_feature (631)..(631): n is a, c, g, or t
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagccaccctcggtgtcagtggcccctggacagacggccaggattaccgtggtagggggaaacaacgtagtaggtaagtaagtacgtagtagacgacgtacggtaccgnaacggacgaccgaaggacccgaacggacccgtcgagggccccttaggttacggtaccttagggttcggttacgtagtgggtacggacggtccggtccggaccgggaccctaccgtacgggacgtacccgtagtacgtcgtacgttcctacctacgtccgtaccgaaccgtaccgtaccggtacccggacccacccgtacgaccgacgtacgaacggaccgggtacgaacggacgggacgtacgtacgtacgtacgtacgtacgtaggtacgaggtaggtaggtagtaggtaggtagtggtgtgtcgtacggacgtacgtacgacgtacgtacgaccgtacgacgtacgacgaccgacgccacctnacctacgtcgtaccgtacccgtaccgttcccgtccctccgtcctc

SEQ ID NO: 135699 - DNA, 619 bp, Homo sapiens
  misc_feature: GYAE6OF02HFDE1.49.11.A11.1.454.CMB.1.raw
  modified_base (483)..(483): a, c, t, g, unknown or other
  misc_feature (483)..(483): n is a, c, g, or t
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagccaccctggtgtcagtggcccctggacagacggccaggattacctggtagggggaaacacattggaaagtaagactgtgcatggtaccagcagaagccaggccaggcccctgtcgctggtcgtctagtggtgagtcggcgaccggccctcgagggactcccgtgacgcgtacttctcgtggcctccaactcgtacgggaaccccgcctacccgtgacccagtccgacggtcccgggtacgaacggacggggatcgggacggccgaactacgttacgtgtcgaggtggtagggataggtggtagttgggtgtcgttcgttcggngcggtcgggaccgtaggggtcctaccggtccgtaggtccaacgacccgaacggccctaaccccgtacgtcgttaccgacttaccgttccgttacccccgtacccttcccgttcctcccgttcttaccgacttccgg

SEQ ID NO: 135700 - DNA, 282 bp, Homo sapiens
  misc_feature: GYAE6OF02HPZR3.49.11.A11.1.454.CMB.1.raw
  modified_base (191)..(191): a, c, t, g, unknown or other
  misc_feature (191)..(191): n is a, c, g, or t
  modified_base (261)..(282): a, c, t, g, unknown or other
  misc_feature (261)..(282): n is a, c, g, or t
tcagagtcgagagacacgaccggtgctcgatttagctacgactgcagggaacccgccaccctgaccatcagccgggtcgaagacggggatgaggccgactattactgtcaggtgtgggatagtggtagtggtgtcgtcttcggagcgtgggaccagggtccaccgtctaggtcagcccaaggcccaacccntgtcactctcgttcccacccttctctctctcgactcgtggacggcgggtctggaccaagggcacagtagnnnnnnnnnnnnnnnnnnnnnn

SEQ ID NO: 135701 - DNA, 162 bp, Homo sapiens; identical to SEQ ID NO: 135489
  misc_feature: GYAE6OF02HOIYB.49.11.A11.1.454.CMB.1.raw
  modified_base (161)..(162): a, c, t, g, unknown or other
  misc_feature (161)..(162): n is a, c, g, or t

SEQ ID NO: 135702 - DNA, 264 bp, Homo sapiens
  misc_feature: GYAE6OF02GL88G.49.11.A11.1.454.CMB.1.raw
  modified_base (253)..(264): a, c, t, g, unknown or other
  misc_feature (253)..(264): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggttcaccgtcctaggtcagcccaaggccaaccccactgtcactctgttcccaccctcctctctctcgactctgagcgggctggcaaggcgcatagnnnnnnnnnnnn

SEQ ID NO: 135703 - DNA, 616 bp, Homo sapiens
  misc_feature: GYAE6OF02JGEWB.49.11.A11.1.454.CMB.1.raw
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagccaccctcggtgtcagtggcccctggacagacggccaggattacctggtgggggaaacgacattggaagtaagactgtgcactggtaccagcagaagccaggccaggcccctggtgctggtcgtctatggtgatggcgaccggccctcgagggactccctgacgcgattctcgtggcctccaactcgtcgggaacccggccaccctcgacactcgagccgggtacgaaggacggggatcggacggcccgacttacgttaccgtgtcgagggtggtaggggattagggtgggttaggtgggttcggtacgttcgttcgggagcggtacggggaccgtaggggtccaacccggttccgttaagggtccaacggccccgtaacggaccccaacccgtcgtgtaccgtacctcccgttccgttaccccgacccttcctcctcgtcctaccgtacctccgg

SEQ ID NO: 135704 - DNA, 272 bp, Homo sapiens
  misc_feature: GYAE6OF02JRJI6.49.11.A11.1.454.CMB.1.raw
  modified_base (247)..(247): a, c, t, g, unknown or other
  misc_feature (247)..(247): n is a, c, g, or t
  modified_base (253)..(272): a, c, t, g, unknown or other
  misc_feature (253)..(272): n is a, c, g, or t
tcagagtcgagagacacgaccggtgctcgatttagctacgactgcagggaacccggaccaccctcgaccatcagccgggtcgaagacggggatgaggccgactattactgtcaggtgtgggatagtggtagttggtgtcgtcttcggagctgggaccagggtcaccgtcctaggtcagcccaaggccaaccccactgtcactctgttcccaccctcctctctctcgactctgagcggctggcaggcncatagnnnnnnnnnnnnnnnnnnnn

SEQ ID NO: 135705 - DNA, 712 bp, Homo sapiens
  misc_feature: GYAE6OF02GBWMZ.49.11.A11.1.454.CMB.1.raw
  modified_base (447)..(447): a, c, t, g, unknown or other
  misc_feature (447)..(447): n is a, c, g, or t
tcagagtcgagagacacgaccggtgctcgatttagctacgactgcaggggggcctaaggggaagcagcactggtggtgcctcgagccatggcctggaccgttcgtcctcctcggcctcctctctcactgcacagactctgtgacctcctagtgtgctgactcagccacctcggtgtcagtggcccctgggacagacggccaggattacctggtagggggaaacgacagttggaagtaaggactgtgcactggtaccagtcagaacgccaggccaggcccctgtcgctggtcgtcctaatggtgatggcgaccgggccctacgaggggactccccgtgaggtcgtattctctggctaccaactcgtgggaacccgccaaccgtgaccatcacggtccgggtacgaacggtacggggatcgggaacggcccgtaacgttaagttaccgnggttacgagggttaggtagggaacttagggttacgggtagttcgggtacgttaccggttcgtttacggggagtccgttagggggtaacccgtagggggtttaccgaaccccggtttaccgtaacggggttccggaacgggttaccccgaaacgggtcccccaaaccccggtacgttccggttacccgtaaccgtttacccgttacgtttacccccgaccccttcccgttaccgttccgttacccttacccgggtacccttcccgg

SEQ ID NO: 135706 - DNA, 259 bp, Homo sapiens
  misc_feature: GYAE6OF02I2DY4.49.11.A11.1.454.CMB.1.raw
  modified_base (251)..(259): a, c, t, g, unknown or other
  misc_feature (251)..(259): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccgcctcctctctctcgactctgagcgggctggcaaggcgcatagnnnnnnnnn

SEQ ID NO: 135707 - DNA, 261 bp, Homo sapiens
  misc_feature: GYAE6OF02JG595.49.11.A11.1.454.CMB.1.raw
  modified_base (251)..(261): a, c, t, g, unknown or other
  misc_feature (251)..(261): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccacctcctctctctcgactctgagcgggctggcaaggcgcatagnnnnnnnnnnn

SEQ ID NO: 135708 - DNA, 256 bp, Homo sapiens; identical to SEQ ID NO: 134784
  misc_feature: GYAE6OF02F6ZPH.49.11.A11.1.454.CMB.1.raw
  modified_base (252)..(256): a, c, t, g, unknown or other
  misc_feature (252)..(256): n is a, c, g, or t

SEQ ID NO: 135709 - DNA, 544 bp, Homo sapiens
  misc_feature: GYAE6OF02FL2YO.49.11.A11.1.454.CMB.1.raw
  modified_base (474)..(474): a, c, t, g, unknown or other
  misc_feature (474)..(474): n is a, c, g, or t
  modified_base (480)..(480): a, c, t, g, unknown or other
  misc_feature (480)..(480): n is a, c, g, or t
  modified_base (506)..(506): a, c, t, g, unknown or other
  misc_feature (506)..(506): n is a, c, g, or t
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagccaccctcggtgtcagtggcccctggacagacggccaggattacctggtgggggaaacgacattggaagtaagactgtgcactggtaccagcagaagccaggccaggcccctgtgctggtcgtctatggtgatggcgaccggccctcgagggactcccgtgagcgattctctggctccaactcgtcgggaacccggccaccctgaccactcgacggccgggtacgaacgggacgggggatggaggccgactaattactgtacgagggtgtgggataggtggtagtggtgtcgttcttcgggagcgtgggaccgngggtcnccgtctaggtcagccagcccaacccnctgtccactctcgttcccgccctcctctctctcgctcg

SEQ ID NO: 135710 - DNA, 652 bp, Homo sapiens
  misc_feature: GYAE6OF02I1YVM.49.11.A11.1.454.CMB.1.raw
  modified_base (464)..(464): a, c, t, g, unknown or other
  misc_feature (464)..(464): n is a, c, g, or t
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagccaccctcggtgtcagtggcccctggacagacgccaggattacctgtgggggaaacacattggaagtaagactgtgcatggtaccagcagaagccaggccaggcccctgtgctggtcgtctatggtgagtggcgacccggccctcgaggggactccctgacgcgtattcctctggcctaccgaactcgtcgggaaccccggccacccgtgaccatcacggccgggtacgaacgggacgggatggacggtccgaacgtattactcggtgtacgggtgtagggattaggttgggttacgtgggttnttcggttccgtttcgggagtccgtacggggtacccgaggggttcccaaccgggttccgttaagggtccaaccggtaccccgaaacgggtcccccaaaccccgtcgtacggttacctaaccgttcccttccggtttacccccacccgtttccccttacccgtccctttacccgttccgaacccttccgg

SEQ ID NO: 135711 - DNA, 296 bp, Homo sapiens
  misc_feature: GYAE6OF02H0XAR.49.11.A11.1.454.CMB.1.raw
  modified_base (142)..(142): a, c, t, g, unknown or other
  misc_feature (142)..(142): n is a, c, g, or t
  modified_base (256)..(256): a, c, t, g, unknown or other
  misc_feature (256)..(256): n is a, c, g, or t
  modified_base (258)..(296): a, c, t, g, unknown or other
  misc_feature (258)..(296): n is a, c, g, or t
tcagagtcgagagacacgaccggtgctcgatttagctacgactgcaggggaacccggccacccgtgaccatcagccgggtcgaagacggggatgaggccgactattactgtcaggtgtgggatagtcggtagtggtgtcgtnttcggagctgggaccagggtcaccgtcctaggtcagcccaaggccaaccccactgtcactctgttcccgccctcctctctctcgactctgacgcgggctggcaaggcgcatagnannnnnnnnnnnnnnnnnnnnnnnnnnnnnnnnnnnnnnn

SEQ ID NO: 135712 - DNA, 606 bp, Homo sapiens
  misc_feature: GYAE6OF02IU4KW.49.11.A11.1.454.CMB.1.raw
  modified_base (409)..(409): a, c, t, g, unknown or other
  misc_feature (409)..(409): n is a, c, g, or t
tcagagtcgagagacacgaccggtgctcgatttagctacgactgcaggggggggcctaaggaagcagcactggtggtgcctcagccatggcctggaccgttctcctcctcggcctcctctctcactgcacagactctgtgacctcctatgtgctgactcagccaccctcggtgtcagtggcccctggacagacggccaggattacctggtagggggaaacacattgggaaagtaagactgtgcactggtaccagcagaagccaggccaggccccctgtcgctggtcgtctatggtgagtcgggcgaccggccctcgagggactccctgacgcgtattctctggcctccaactcgtacgggaccccggccaccctcgaccatcgacggcccgggtacgaaggaacggggngtagacggccgactacgttactggtcagggtgtagggatagggttcggtagtgggttgtcgttcgttcgggacgtcgtacgggaccgtaggggtcgtacccgtcgtacggtcgaacgaccgaacggcccaacccgacgtcgtacctactctccgttaccctaccccgtccttaccttcctcgttaccgacgttccgg

SEQ ID NO: 135713 - DNA, 727 bp, Homo sapiens
  misc_feature: GYAE6OF02HE24O.49.11.A11.1.454.CMB.1.raw
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagccaccctcggtgtcagtcggcccctggacagacggccaggacttaccgtggtagggggaaacacagttgggaaagtaagacttgtgcacgtggtaccagcagaagccaggccacggcccctgtcgcgtggtcgtctagtggtgagtcggaccgaccggccctcgaagggctcccgtgacgcgtacttcgtcgtcggctacccaacgttccggacggggaacccccggtccctaaccccgtacgaacccgtactacgaaccggcccggggtacgaaacgggacgggggaactcgggacggtacccgaacgtttaacgttaccgtggtaccgaggggttcggtaggggtattagggttgggttaggttcggtaggttccggttcgttacggggagtccgggtacgggacccgtaggggtccctaacccggttccgtagggtccgaaccggtaccccgaaacgggaccccctaaaccccgtcgttaccggtaccctacccgttaccgttacccgtttaccccccacccgtttccccgtacttccccgttcgtacccggtaccttcccggg

SEQ ID NO: 135714 - DNA, 542 bp, Homo sapiens
  misc_feature: GYAE6OF02FFPVE.49.11.A11.1.454.CMB.1.raw
  modified_base (450)..(450): a, c, t, g, unknown or other
  misc_feature (450)..(450): n is a, c, g, or t
  modified_base (452)..(452): a, c, t, g, unknown or other
  misc_feature (452)..(452): n is a, c, g, or t
  modified_base (497)..(497): a, c, t, g, unknown or other
  misc_feature (497)..(497): n is a, c, g, or t
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagccaccctcggtgtcagtggcccctggacagacggccaggattacctgtgggggaaacgacattggaagtaagactgtgcactggtaccagcagaagccaggccaggcccctgtgctggtcgtctatggtgatggcgaccggccctcgagggatcccgtgagcgattctctggctccaactcgtcgggaaccccggccaccctgaccatcaggccgggtacgaagacggggatggacggccgactattactgtcaggtgtgggataggtggtagttggtgtcgtcttgggngngtgggaccagggtccaccgtccaggtcagcccaaggcccaacccncgtcgtcacctctcgttccccacccttcctcctctcctcgactcg

SEQ ID NO: 135715 - DNA, 254 bp, Homo sapiens
  misc_feature: GYAE6OF02HYCHF.49.11.A11.1.454.CMB.1.raw
  modified_base (250)..(254): a, c, t, g, unknown or other
  misc_feature (250)..(254): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaacccactgtcactctgttcccaccctcctctctctcgactctgagcgggctggcaggcgcatagnnnnn

SEQ ID NO: 135716 - DNA, 775 bp, Homo sapiens
  misc_feature: GYAE6OF02HCPWE.49.11.A11.1.454.CMB.1.raw
  modified_base (177)..(177): a, c, t, g, unknown or other
  misc_feature (177)..(177): n is a, c, g, or t
tcagagtcgagagacacgaccggtgctcgatttagctacgactgcagggggggcctaaggaagccagcactggtggtgcctcgagccatgggccctggaccgttctcctcctcggccgtcctctctcactgcacgagactctgtgacctctatgtgctgactcagccaccctcggtntccagtcggcccctggacagacgccaggattaccgtggtaggggaaacacagttcggaaagtaacgacttggtcggctaacgtgggtaaccagctaagaaacgtccaaggccaagggcccccttggtcgcttgggtccgtaccgtaagtcgggtacgacgttcgggccgacccggccccttcgaacggggcttcccgtgacgtaccgtaatttccgtacgttcgggcctaccctaaacgttcgtacggggaaccccgccgaacccgttcggaccctagtccgaacggcccgggttaacgtaacgggaccggggattacgggacgggacccgaacgttaacttaccgtcgtccgaggggttcggtagggagttaggttagggtaggttaggttcgttacggttcgtacggtacggtcgtacgggtaccgtaggggttcctaaccggttccgttaacgggtcctaaccgggtcccgtaaaccggggcccctaaaaccccggtcccgttacgggttaaccgaccgtttaccggttacccggtttaccccgcccccgtttaccgtccgtttacccggtccttacccggtaaccctttcccgg

SEQ ID NO: 135717 - DNA, 253 bp, Homo sapiens; identical to SEQ ID NO: 134809
  misc_feature: GYAE6OF02FZ397.49.11.A11.1.454.CMB.1.raw
  modified_base (252)..(253): a, c, t, g, unknown or other
  misc_feature (252)..(253): n is a, c, g, or t

SEQ ID NO: 135718 - DNA, 647 bp, Homo sapiens
  misc_feature: GYAE6OF02IU5QR.49.11.A11.1.454.CMB.1.raw
  modified_base (171)..(171): a, c, t, g, unknown or other
  misc_feature (171)..(171): n is a, c, g, or t
  modified_base (218)..(218): a, c, t, g, unknown or other
  misc_feature (218)..(218): n is a, c, g, or t
tcagagtcgagagacacgaccggtgctcgatttagctacgactgcaggggggcctaaggaagcagcactggtggtgcctcagccatggcctggaccgttctcctcctcggcctcctctctcactgcacagactctgtgacctcctatgtgctgactcagccaccctcggtntcagtggcccctggacagacggccaggattacctggtgggggaaacncgattggaagtaagactgtgcactggtaccagcaggaagccaggccaggcccctgtgctggtcgtctagtggtagactggcgacccggcctgagggctcccgtgacgcgattctcgtggtcctaccgaacgtcgtacgggaaccccggccacccgttgacccagtccaggtccgggtacgaaaggcgggactggacgcttgaacttattacgtgtacgaggtggtagggagttagtcgggttagtggttagtcgtacgttcgggagtcgttacgggacccgacgggttaccgtacccgttccggtacggtaccgaaccgtacccgaacgggaccccctaaaccccggtacgttcggttaccccacgtttccgttaccggtttaccccccacccttaccgtcccgtttccgttacccgttccgtacccgg

SEQ ID NO: 135719 - DNA, 912 bp, Homo sapiens
  misc_feature: GYAE6OF02IS7PA.49.11.A11.1.454.CMB.1.raw
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagccaccctcggtgtcagtcggcccctggacagacggccaggattaccgtggtgggggaaacacattgggaaagtaagactgtgcactggtaccagcagacgaccaggccacggcccctgtgcgtggtcgtctagtggtgagtggcgaccggccctcgaacgggtctcccgtggacgtcgtacttcgtcgtacggtctacccgaacttccggtaccggggaacccccggtccaaccccgttgaacccacgtccgaccggtacccggggtaccggaaagggtaccggggggaacgtacgggaaccggggtacccggtaaccgtttaaacgtttacccgttacggtaccggtaaagggggtttcggtaacgggggttagtttaacggggttacgggggttttaacggggttcggggttcgggtttaccgggttccggttttaccggggggtaacgggtccgggttttaaccggggggaaccccggttaaacgggggggttccccggttaaaccccgggtttaccgggttaaacccggggttcggtaaacccggggttaaccccccgggtaaaccgggaccccccccggtaaaaccccccggttaaccgggtttaaccccggtacccggtttaaaccccccgggtttacccgttttacccccggggttttaccccccccggtccccccgttttacccccggttccccttttaaccccggtttcccccggtttaacccggtaccccgttttccccggg

SEQ ID NO: 135720 - DNA, 268 bp, Homo sapiens
  misc_feature: GYAE6OF02GV12G.49.11.A11.1.454.CMB.1.raw
  modified_base (250)..(268): a, c, t, g, unknown or other
  misc_feature (250)..(268): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtctaccgtcctaggtcagtcccaaggccaacccactgtcactctgttcccacctcctctctctcgactctgagcggctggcgaggcgcatgnnnnnnnnnnnnnnnnnnn

SEQ ID NO: 135721 - DNA, 252 bp, Homo sapiens
  misc_feature: GYAE6OF02GQVMF.49.11.A11.1.454.CMB.1.raw
  modified_base (250)..(252): a, c, t, g, unknown or other
  misc_feature (250)..(252): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccgccctcctctctctcgactgagcgggctggcaaggcgcatagnnn

SEQ ID NO: 135722 - DNA, 256 bp, Homo sapiens
  misc_feature: GYAE6OF02G0UNB.49.11.A11.1.454.CMB.1.raw
  modified_base (251)..(256): a, c, t, g, unknown or other
  misc_feature (251)..(256): n is a, c, g, or t
tcagagtcgagagacacgaccggtgctcgatttagctacgactgcagggaacccggccaccctgaccatcagccgggtcgaagacgggatgaggccgactattactgtcaggtgtgggatagtggtagtggtgtcgtcttcggagctgggaccagggtcaccgtcctaggtcagcccaaggccaaccccactgtcactctgttcccgccctcctctctctcgactctgagcgggctggcaaggcgcatagnnnnnn

SEQ ID NO: 135723 - DNA, 577 bp, Homo sapiens
  misc_feature: GYAE6OF02JBYOW.49.11.A11.1.454.CMB.1.raw
  modified_base (547)..(547): a, c, t, g, unknown or other
  misc_feature (547)..(547): n is a, c, g, or t
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagccaccctcggtgtcagtggcccctggacagacggccaggattacctggtgggggaaacacagttggaagtaagactgtgcactggtaccagcagaagccaggccaggcccctgtgctggtcgtctatggtgagtggcgaccgggccctcgagggactcccgtgagcgattctctggctccaactcgtcgggacccgccaccctcgaccactcgacggccgggtacggaaggacggggatggacggccgaactagttacgtgtcagggtgtgggattaggtggtagtggtgtcgttcgttcgggagtcgtgggaccgagggtccgaccgtccgtaggcgacgcccgaacggcccaacccacgtcgtccacttcccgttcgttcccccncccttccgttccctctccctcgccttacgg

SEQ ID NO: 135724 - DNA, 671 bp, Homo sapiens
  misc_feature: GYAE6OF02GT0S5.49.11.A11.1.454.CMB.1.raw
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagccaccctcggtgtcagtggcccctggacagacggccaggattacctggtagggggaaacacagttggaagtaagactgtgcactggtaccagcagaagccaggccaggcccctgtgctggtcgtctagtggtgagtggccgacccggccctcgagggactcccgtgacgcgtattctctggcctccaactcgtacgggaaccccgccacccgtgacccatccgacggcccggggtacggaaacgggacgggggatcgggacggcccgtaacgttacgttaccgtggtaccgaggggttcggtaggggtattaggtagggttaggtgtccgttccgggtttccggggggttgttccggggcgggtacggggtaccgtaaggttcggaccggtttcggttcgggtaccgaacggcccgaaggtcccgtccggtacccccgtcggtccctaccgttccgttcccgttaccccgtaccccttcccgtccgttcccttccgttccgtaccttccgg

SEQ ID NO: 135725 - DNA, 622 bp, Homo sapiens
  misc_feature: GYAE6OF02GQZBE.49.11.A11.1.454.CMB.1.raw
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagccaccctcggtgtcagtggcccctggacagacggccaggattacctgtgggggaaacgacattggaagtaagactgtgcactggtaccagcagaagccaggccaggcccctgtgctggtcgtctatggtgatggccgaccggccctcgaggggactccccgtgacgcgtattcctctggcctacccgaactcgtacgggaaccccggccacccctgacccactcgacggccgggtacggaacggaccggggatggacgggccgaacttacgtttacgtgtcgagggtggtgggataggttggtagtgggtgtcgttcgttcgggagtcgtcggggaccgtaggggtcctacccgttccgtacggtccacggtaccccgaacggaccccaaccccgtacgtccgtacctaccgttccttccgttccccaccccgttccttccttccttccttccgacttccgg

SEQ ID NO: 135726 - DNA, 259 bp, Homo sapiens
  misc_feature: GYAE6OF02FL8G8.49.11.A11.1.454.CMB.1.raw
  modified_base (254)..(259): a, c, t, g, unknown or other
  misc_feature (254)..(259): n is a, c, g, or t
tcagagtcgagagacacgaccggtgctcgatttagctacgactgcggggaacccggccaccctgaccatcagccgggtcgaagacggggatgaggccgactattactgtcaggtgtgggatagtggtagtggtgtcgtcttcggagctgggaccagggtcaccgtcctaggtcagcccaaggcccaacccccactgtcactctgttcccaccctcctctctctcgactctgagcgggctggcaaggcgcatagnnnnnn

SEQ ID NO: 135727 - DNA, 257 bp, Homo sapiens
  misc_feature: GYAE6OF02GQ8GQ.49.11.A11.1.454.CMB.1.raw
  modified_base (246)..(246): a, c, t, g, unknown or other
  misc_feature (246)..(246): n is a, c, g, or t
  modified_base (252)..(257): a, c, t, g, unknown or other
  misc_feature (252)..(257): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccaccctcctctctctcgactctgagcgggctggcaaggcncatagnnnnnn

SEQ ID NO: 135728 - DNA, 255 bp, Homo sapiens; identical to SEQ ID NO: 134799
  misc_feature: GYAE6OF02GJYON.49.11.A11.1.454.CMB.1.raw
  modified_base (252)..(255): a, c, t, g, unknown or other
  misc_feature (252)..(255): n is a, c, g, or t

SEQ ID NO: 135729 - DNA, 251 bp, Homo sapiens
  misc_feature: GYAE6OF02JCP08.49.11.A11.1.454.CMB.1.raw
  modified_base (242)..(242): a, c, t, g, unknown or other
  misc_feature (242)..(242): n is a, c, g, or t
  modified_base (247)..(251): a, c, t, g, unknown or other
  misc_feature (247)..(251): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccgcccttctctctcgactctgagcggctggcaggcncatgnnnnn

SEQ ID NO: 135730 - DNA, 615 bp, Homo sapiens
  misc_feature: GYAE6OF02FTKAO.49.11.A11.1.454.CMB.1.raw
tcagagtcgagagacacgaccggtgctcgatttagctacgactgcagggggggccgtaaggaagcagcactggtgggtgcctcagccagtggcctgggaccggttcctcctcctcggcctcctcgtctcactgcacagactctgtgacctctatgtgctgactcagccaccctggtgtcagtcgcccctggacagacgcaggattacctggtaggggaaacacattcggaataagactgtgcacgtggtaccagcaagaagcctaaggtccaaggccccctggtcgacgtaggtcggtacctaactgggtgacttggaccgtaaccggtcccttcgaggggtactcccgtgacgtcgtattacgtcgtcggctaccgaacgtcgtacgggaaccccggccacccgtggaaccagtccgaacggccgggtacgaacggacggggatacggacggccgtactagttacgtgtcgaggtcgtggataggttggtagtggttgtcgtcgttcggagtcgtagggaccagggtccaccggttcgtagtcgtacggacccgaacggcccaacccgcgtcggacacgtactacgtcccacctcctcctcctctacctactcg

SEQ ID NO: 135731 - DNA, 707 bp, Homo sapiens
  misc_feature: GYAE6OF02J1EBJ.49.11.A11.1.454.CMB.1.raw
tcagagtcgagagacacgaccggtgctcgatttagctacgactgcaggggggccgtaaggaagcagcactggtggtgcctcagccatggcctggaccgttctcctcctcggcctcctctctcactgcacagactctgtgacctcctatgtgctgactcagccaccctcggtgtcagtcggcccctggacacgacggccagggatttacccgtggtagggggaaaacacagttgggaaagtaagactggtgaccactgggtaccagcgagaagccaggccaggcccctggcgctggtcgtctatggtgagtggcaccggcctctaggggactcccgtgacggcgtacttcgtccgttgggcctacctaacgttccgttacggggaaccccggaccctaccccgtacggaaccctagtccaacgggtcccggggtaccggaaaacgggtaccgggggagtaccgggacggaccgtacgttacgttacgtcggtacgtacgggttggtagggtaacgttaggtacgggttaggttaggttcgggtcgttcgtttccgggaggtccgtaggggaccgtacggggtacgaccggttccgttaggtccacgggtacccgacggtacccgacccgtacgtcggtcctacccgtcgttacccttaccccggtaccccttcccgttcgttacccgtccgtttaccgccgttcccgg

SEQ ID NO: 135732 - DNA, 563 bp, Homo sapiens
  misc_feature: GYAE6OF02HZG6N.49.11.A11.1.454.CMB.1.raw
tcagagtcgagagacacgaccggtgctcgatttagctacgactgcaggggggggcctaaggaagcagcactggtggtgcctcagccatggcctggaccgttctcctcctcggcctcctctctcactgcacagactctgtgacctcctatgtgctgactcagccaccctcggtgtcagtggcccctggacagacggccaggattacctggtggggaaacacattggaagtaagactgtgcactggtaccagcagaagccaggccacggcccctgtgctggtcgtctatggtgatgggcgaccggccctcgagggactccccgtgacgcgtattctctggctaccaactcgtcgggaacccgccaccctgaccatcacgccgggtacgaaggacggggatggacggccgaacgttattacgtgtcagggtgtgggatagtggtagtggtgtacgtcgtcgggagtcgtggggacctaggggtccaccggttctacggtcacgcccgaaggcccaacccgcgtcgtacactcttccgtaccccaccttcctctcctctccgactcg

SEQ ID NO: 135733 - DNA, 269 bp, Homo sapiens
  misc_feature: GYAE6OF02HU6Q1.49.11.A11.1.454.CMB.1.raw
  modified_base (250)..(269): a, c, t, g, unknown or other
  misc_feature (250)..(269): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggcccaaccccactgtcactctgttcccacctcctctctctcactctgagcggctggcaaggcgcatagnnnnnnnnnnnnnnnnnnnn

SEQ ID NO: 135734 - DNA, 862 bp, Homo sapiens
  misc_feature: GYAE6OF02G1AP9.49.11.A11.1.454.CMB.1.raw
  modified_base (288)..(288): a, c, t, g, unknown or other
  misc_feature (288)..(288): n is a, c, g, or t
tcagagtcgagagacacgaccggtgctcgatttagctacgactgcaggggggccgtaaggaagcagcactggtggtgcctcagccatggcctggaccgttctcctcctcggcctcctctctcactgcacagactctgtgacctcctatgtgctagactcagcccaccctcggtgtcagtcggcccctggaccaggacggccaggacttaccgtggtagggggaaaacacgtagttaggaaagtaagacgtgtgcacgtggtaccagcagagccgagccacggccctgngcgtggtcgtctagtggtgagtcggccgacccggccctagacgggactcccgtaggacgtcgtactttccgtcgtcgggcccttaccgtaaccgtccggtaccgggggaacccccgtacccgaaccccgtacggaaccccgtacgttacccggaccggggttacccgggggtacccgaaaacgggggaaccgggggtaacgttacggggaaccggggtaccccgtaaacggtttaaccgtttaaccggtaggttaccgtaaggggggttacgggtacggggtaagttacggggttagggttaacggggtttcgggttcggtttaccggggtttccgtttacgggggaaccggttcggtaccggggggttaacccgggtaacggggtttacccgtaacccccggggtttacgtttaaccgggggaccctaaccgggaaccccgtaaaccggggaccccctaaaccccggtacccggtttcggtacccgttacccgttacccgtttaccggtttacccccccgtaccccgtttcccttaccgttccccgtttaaccgttcccggtactttcccggg

SEQ ID NO: 135735 - DNA, 258 bp, Homo sapiens
  misc_feature: GYAE6OF02IH1R2.49.11.A11.1.454.CMB.1.raw
  modified_base (215)..(215): a, c, t, g, unknown or other
  misc_feature (215)..(215): n is a, c, g, or t
  modified_base (251)..(258): a, c, t, g, unknown or other
  misc_feature (251)..(258): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccatgtcactctgttcccaccctcctntctctcgactctgagcgggctggcaaggcgcatagnnnnnnnn

SEQ ID NO: 135736 - DNA, 255 bp, Homo sapiens; identical to SEQ ID NO: 135253
  misc_feature: GYAE6OF02G73ED.49.11.A11.1.454.CMB.1.raw
  modified_base (251)..(255): a, c, t, g, unknown or other
  misc_feature (251)..(255): n is a, c, g, or t

SEQ ID NO: 135737 - DNA, 253 bp, Homo sapiens; identical to SEQ ID NO: 134759
  misc_feature: GYAE6OF02F3CWT.49.11.A11.1.454.CMB.1.raw
  modified_base (252)..(253): a, c, t, g, unknown or other
  misc_feature (252)..(253): n is a, c, g, or t

SEQ ID NO: 135738 - DNA, 299 bp, Homo sapiens
  misc_feature: GYAE6OF02JTW7U.49.11.A11.1.454.CMB.1.raw
  modified_base (203)..(203): a, c, t, g, unknown or other
  misc_feature (203)..(203): n is a, c, g, or t
  modified_base (236)..(236): a, c, t, g, unknown or other
  misc_feature (236)..(236): n is a, c, g, or t
  modified_base (252)..(253): a, c, t, g, unknown or other
  misc_feature (252)..(253): n is a, c, g, or t
  modified_base (255)..(255): a, c, t, g, unknown or other
  misc_feature (255)..(255): n is a, c, g, or t
  modified_base (257)..(257): a, c, t, g, unknown or other
  misc_feature (257)..(257): n is a, c, g, or t
  modified_base (262)..(262): a, c, t, g, unknown or other
  misc_feature (262)..(262): n is a, c, g, or t
  modified_base (264)..(265): a, c, t, g, unknown or other
  misc_feature (264)..(265): n is a, c, g, or t
  modified_base (267)..(299): a, c, t, g, unknown or other
  misc_feature (267)..(299): n is a, c, g, or t
tcagagtcgagagacacgaccggtgctcgatttagctacgactgcagggaacccggccaccctgacccatcagccgggtcgaagacggggatgaggccgacgtattactgtcaggtgtcgggataggtggtagtggtgtcgtcttggagcttgggaccagggtcaccgtcctaggtcagcccaaggccaacccatgtcactcngttcccacctctctctctcgactctgacgcggntggctaggcgcatagnncnanctagncnntnnnnnnnnnnnnnnnnnnnnnnnnnnnnnnnnn

SEQ ID NO: 135739 - DNA, 258 bp, Homo sapiens
  misc_feature: GYAE6OF02IAHQE.49.11.A11.1.454.CMB.1.raw
  modified_base (251)..(258): a, c, t, g, unknown or other
  misc_feature (251)..(258): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccatgtcactctgttcccaccctcctctctctcgactctgagcgggctggcaaggcgcatagnnnnnnnn

SEQ ID NO: 135740 - DNA, 309 bp, Homo sapiens
  misc_feature: GYAE6OF02HEKP1.49.11.A11.1.454.CMB.1.raw
  modified_base (289)..(289): a, c, t, g, unknown or other
  misc_feature (289)..(289): n is a, c, g, or t
  modified_base (295)..(295): a, c, t, g, unknown or other
  misc_feature (295)..(295): n is a, c, g, or t
  modified_base (300)..(309): a, c, t, g, unknown or other
  misc_feature (300)..(309): n is a, c, g, or t
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagccaccctcggtgtcagtggcccctggacagacggccaggattacctgtgggggaaacacattggaaagtaagactgtgcacgtggtaccagcagaagccaggccaggccctgtgctggtctctatggtnacgtgncggcnnnnnnnnnn

SEQ ID NO: 135741 - DNA, 254 bp, Homo sapiens; identical to SEQ ID NO: 134822
  misc_feature: GYAE6OF02GCE02.49.11.A11.1.454.CMB.1.raw
  modified_base (251)..(254): a, c, t, g, unknown or other
  misc_feature (251)..(254): n is a, c, g, or t

SEQ ID NO: 135742 - DNA, 679 bp, Homo sapiens
  misc_feature: GYAE6OF02JV9YU.49.11.A11.1.454.CMB.1.raw
  modified_base (216)..(216): a, c, t, g, unknown or other
  misc_feature (216)..(216): n is a, c, g, or t
  modified_base (282)..(282): a, c, t, g, unknown or other
  misc_feature (282)..(282): n is a, c, g, or t
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagcccaccctcggtgtcagtcggccctggacagacggccaggattacctgctctgganatgctattcgaccaaaccgtatatgcttattggtaccagcaagaacgccggcacgccctgtgtggngatagtaataagacactggagacggcctcgaagggactcccgtggacgcgtacttctacgtggcctccgacggttacgaacgggtacaaacgggtacaacgtagttcggacctaagtaccgagggtagggtacgtaccgaggaccgaaggtacgggaacggaggtctacgtaattagtttaagttcgtaactaacgtacaaacgacgaactaaccgtaagtttacggtttaaactttacgttacggtttacccgtttaacggaaacccgttgaaccgtaacccgtaaggttacccgtaaccccgggttcggtaacgggttaaccgaaccccggacccgtaaaccgggacccccttaaaccccgacgttaccggtaccctacccgttccttaccccgg

SEQ ID NO: 135743 - DNA, 255 bp, Homo sapiens; identical to SEQ ID NO: 134799
  misc_feature: GYAE6OF02FXOS3.49.11.A11.1.454.CMB.1.raw
  modified_base (252)..(255): a, c, t, g, unknown or other
  misc_feature (252)..(255): n is a, c, g, or t

SEQ ID NO: 135744 - DNA, 256 bp, Homo sapiens; identical to SEQ ID NO: 135092
  misc_feature: GYAE6OF02GAATP.49.11.A11.1.454.CMB.1.raw
  modified_base (251)..(256): a, c, t, g, unknown or other
  misc_feature (251)..(256): n is a, c, g, or t

SEQ ID NO: 135745 - DNA, 252 bp, Homo sapiens; identical to SEQ ID NO: 134773
  misc_feature: GYAE6OF02GXN6G.49.11.A11.1.454.CMB.1.raw
  modified_base (252)..(252): a, c, t, g, unknown or other
  misc_feature (252)..(252): n is a, c, g, or t

SEQ ID NO: 135746 - DNA, 254 bp, Homo sapiens; identical to SEQ ID NO: 134802
  misc_feature: GYAE6OF02FKIPT.49.11.A11.1.454.CMB.1.raw
  modified_base (252)..(254): a, c, t, g, unknown or other
  misc_feature (252)..(254): n is a, c, g, or t

SEQ ID NO: 135747 - DNA, 272 bp, Homo sapiens
  misc_feature: GYAE6OF02GYRG5.49.11.A11.1.454.CMB.1.raw
  modified_base (251)..(272): a, c, t, g, unknown or other
  misc_feature (251)..(272): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccacctcctctctctcgactctgagcgggctggcaaggcgcatagnnnnnnnnnnnnnnnnnnnnnn

SEQ ID NO: 135748 - DNA, 599 bp, Homo sapiens
  misc_feature: GYAE6OF02IVOW4.49.11.A11.1.454.CMB.1.raw
  modified_base (221)..(221): a, c, t, g, unknown or other
  misc_feature (221)..(221): n is a, c, g, or t
tcagagtcgagagacacgaccggtgctcgatttagctacgactgcaggggggggcctaaggaagcagcactggtggtgcctcagccatggcctggaccgttctcctcctcggcctcctctctcactgcacagactctgtgacctcctatgtgctgactcagccaccctcggtgtcagtggcccctggacagacggccaggattacctggtgggggaaaacncattggaagtaagactgtgcactggtaccagcagaagccaggccaggcccctgtgctggtcgtctagtggtgagtggccgaccggccctcgacgggactcccgtggacgcgtattctcgtcggctaccaactcgtacggggaaccccgccacccttgacctatcgacggccgggtacgaacgggcggggatggacggccgaacttagttacgtgtacgagggtggtagggattaggtggttaggtggtcgtcgttcgttcggagtcgtaggggaccgtaggggtccaccggttcgtacggtcaacgcccgaaggacccaacccgtcgtcgtccactccgttccgttccccgcccttcctcctcctccgtacgtcctcg

SEQ ID NO: 135749 - DNA, 293 bp, Homo sapiens
  misc_feature: GYAE6OF02HDCZE.49.11.A11.1.454.CMB.1.raw
  modified_base (258)..(268): a, c, t, g, unknown or other
  misc_feature (258)..(268): n is a, c, g, or t
  modified_base (270)..(293): a, c, t, g, unknown or other
  misc_feature (270)..(293): n is a, c, g, or t
tcagagtcgagagacacgaccggtgctcgatttagctacgactgcagggaacccggccaccctgggaccatcagccgggtcgaagacggggatgaggccgactattactgtcagggtgtggggatagtggtagtggtgtcgtcttccggagctgggaccagggtcaccgtccgtaggtcagcccaaggccaaccccactgtcactctgttcccgccctcctctctctcgactctgagcgggctggcaaggcgcatagnnnnnnnnnnntnnnnnnnnnnnnnnnnnnnnnnnn

SEQ ID NO: 135750 - DNA, 712 bp, Homo sapiens
  misc_feature: GYAE6OF02GVST1.49.11.A11.1.454.CMB.1.raw
  modified_base (212)..(212): a, c, t, g, unknown or other
  misc_feature (212)..(212): n is a, c, g, or t
  modified_base (225)..(225): a, c, t, g, unknown or other
  misc_feature (225)..(225): n is a, c, g, or t
tcagagtcgagagacacgaccggtgctcgatttagctacgactgcgagggggggcctaaggaagcagcactggtggtgcctcagccatggcctggaccgttctccctcctcggcctcctctctcactgctacagactctgtcgacctcctatgtgctgactcagccacccgtcggtgtcagtcggcccctggacagacggcaggattaccgnggtgggggaaacncgagttgggaagtaagactgtgcgacgtggtaccagcagaacgccaggccacggcccctgtacgctggtcgtctagtggtcgacgtcggccgaccggccctacgacgggtactcccgtgacgcgactttccgcgtggcctccaacgtcgtacgggaaccccgtcctaacccgtgaaccatccgaacggtcccggggtacgaaacggtacgggggatacgggacggtacccgtaagttaaacgtttaccgtggttaccgaaggggttggttagggggaatttaggggttgggttaaggttcgggttaggttccgttcggttacgggagtccgttagggggaccctaagggggtccaacccggtttccgtaagggtccaacgcccccgaaagggtcccccaaaccccgtacgttcggtacccaaccgttccgttacccgttacccccgacccctttaccgtcccttaccgttcctacccgtacttccgg

SEQ ID NO: 135751 - DNA, 255 bp, Homo sapiens
  misc_feature: GYAE6OF02IXLQ2.49.11.A11.1.454.CMB.1.raw
  modified_base (247)..(255): a, c, t, g, unknown or other
  misc_feature (247)..(255): n is a, c, g, or t
tcagagtcgagagacacgaccggtgctcgatttagctacgactgcagggaacccggccaccctgaccatcagccgggtcgaagacgggatgaggccgactattactgtcaggtgtgggatagtggtagtggtgtcgtcttcggagctgggaccagggtcaccgtcctaggtcagcccaaggccaacccactgtcactctcgttcccgcctcctctctctcgactctgagcggctggcaagcgcatgnnnnnnnnn

SEQ ID NO: 135752 - DNA, 270 bp, Homo sapiens
  misc_feature: GYAE6OF02J0DAP.49.11.A11.1.454.CMB.1.raw
  modified_base (249)..(249): a, c, t, g, unknown or other
  misc_feature (249)..(249): n is a, c, g, or t
  modified_base (255)..(270): a, c, t, g, unknown or other
  misc_feature (255)..(270): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccgcccttctcctctctcgactctgacgcgggctggacagggcncatagnnnnnnnnnnnnnnnn

SEQ ID NO: 135753 - DNA, 258 bp, Homo sapiens; identical to SEQ ID NO: 135502
  misc_feature: GYAE6OF02IUBZN.49.11.A11.1.454.CMB.1.raw
  modified_base (251)..(258): a, c, t, g, unknown or other
  misc_feature (251)..(258): n is a, c, g, or t

SEQ ID NO: 135754 - DNA, 636 bp, Homo sapiens
  misc_feature: GYAE6OF02FYFKC.49.11.A11.1.454.CMB.1.raw
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagccaccctcggtgtcagtcggcccctggacagaccggccaggattacctggtagggggaaacacattggaagtaagactgtgcactggtaccagcagaagccaggccaggcccctgtcgctggtcgtctagtggtgagtggcgacccggccctcgacggggactccccgtgacgcgattctctggcctcaactcgtacgggaacccggccaccctgaccatccacggcccgggtagaacggacggggatggacggccgacttagttacgtgtcgtagggtgtagggattaggtgggtagtggttggtcgttcgttcgggagtcggtaggggaccgtaggggtccaccgggttccgtagggtccgacggccccaacgggccccaaccccgtacgtccggtaccctaacccgttcccgtaccggtttacccccctaccccgttcccttaccgtccctttccctaccggtacccttccgg

SEQ ID NO: 135755 - DNA, 655 bp, Homo sapiens
  misc_feature: GYAE6OF02HXAAK.49.11.A11.1.454.CMB.1.raw
  modified_base (416)..(416): a, c, t, g, unknown or other
  misc_feature (416)..(416): n is a, c, g, or t
tcagagtcgagagacacgaccggtgctcgatttagctacgactgcaggggggggcctaaggaagcagcactggtggtgcctcagccatggcctggaccgttctcctcctcggcctcctctctcactgcacagactctgtgacctcctatgtgctgactcacgccaccctcggtgtcagtggcccctggacagacggccaggattaccgtggtagggggaaacactagttagggaagtaagacttgtgctacgtggtaccagcagaacgccgaggccgacggccccctggtcggcgtgggttccgtcttagtcggtgtagtcgggccggacccggccctcggacgggactcccgtgacgcgtacttctcgtcggcctacctaacgtcgtacgggaaccccgccaacccgtcgaaccnctcgaacggtccgggtacgaacgggacggggagtacgggacgggaccctagtaacgtttacgtgtacggaggggttgtagggattagggtgggtagtgggttcgttcgtcgtcggcgtcggtacgggaccgagggtccgaccgttcgtacggtcgacgacccgaacggcccaacccgtcgtcgtcctaccgttccgttcccgtcccctcccgttccttaccctcctccgtccgctccgg

SEQ ID NO: 135756 - DNA, 590 bp, Homo sapiens
  misc_feature: GYAE6OF02I963P.49.11.A11.1.454.CMB.1.raw
  modified_base (275)..(275): a, c, t, g, unknown or other
  misc_feature (275)..(275): n is a, c, g, or t
  modified_base (466)..(466): a, c, t, g, unknown or other
  misc_feature (466)..(466): n is a, c, g, or t
tcagagtcgagagacacgaccggtgctcgatttagctacgactgcagggggggccgtaaggaagcagcactggtggtgcctcagccatggcctggaccgttctcctcctcggcctcctctctcactgcacagactctgtgacctcctatgtgctgactcagccaccctcggtgtcagtcggcccctggacagacggccaggattaccgtgtgggggaaacacattggaaagtaagactgtgcactggtaccagcagagccaggccaggcccctgngctggtcgtctatggtgagtggcgaccggcctcgaggctccctgacgcgtattctcgtggctaccaactcgtacgggacccgccaccctcgaccagtcgaggtcccggtacgaacggacgggagtggacggtctgaacgttattactgtacgaggtcgtaggtattaggtgtagtggtgtcgtcgttacgngtcgtcgggacctgggtcctaccgtcgtacggtacacgacccgacggacccaaccccgtacgttacgtccgtaccgttccgttccgttaccccacccttccttcctccttaccgtccgtacccg

SEQ ID NO: 135757 - DNA, 676 bp, Homo sapiens
  misc_feature: GYAE6OF02GKH9Z.49.11.A11.1.454.CMB.1.raw
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagccaccctcggtgtcagtcggcccctggacagacggccaggattacctggtgggggaaacacattggaagtaagactgtgcactggtaccagcagaagccacggccacggcccctgtgctggtcgtctagtggtgagtggccgaccggccctacgagggactcccgtgacgcgtattccgtcgtggcctacccaacttccgtacggggaaccccgccctaaccccgtcgaaccctagtaccgacggtcccggggtacggaaagggaccgggggtatcggacgggcccgtaacgtagtttaccgtggtacgagggtggtagggattagggttggtaggtggttcgtcggtcgtttcgggagtcggtacggggaccgaggggttccaccggttaccgtaggtcccgaacggacccccgtaacggaccccaaaccccgtacgtcggtaccctaacccgttcttacccggttaccccctaccccgttccttaccccttctaccgttcccggtacttcccgg

SEQ ID NO: 135758 - DNA, 256 bp, Homo sapiens
  misc_feature: GYAE6OF02IHBJX.49.11.A11.1.454.CMB.1.raw
  modified_base (248)..(256): a, c, t, g, unknown or other
  misc_feature (248)..(256): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtctaggtcagcccaaggccaaccccactgtcactctgttcccacctcctctctctcgactctgagcggctggcaggcgcatagnnnnnnnnn

SEQ ID NO: 135759 - DNA, 888 bp, Homo sapiens
  misc_feature: GYAE6OF02IAYAB.49.11.A11.1.454.CMB.1.raw
  modified_base (212)..(212): a, c, t, g, unknown or other
  misc_feature (212)..(212): n is a, c, g, or t
  modified_base (227)..(227): a, c, t, g, unknown or other
  misc_feature (227)..(227): n is a, c, g, or t
tcagagtcgagagacacgaccggtgctcgatttagctacgactgcagggggccgtaaggaagcagcactggtggtgcctcagccatggcctggaccgttctcctcctcggcctcctctctcactgcacagactctgtgacctcctatgtgctagactcacgccacccgtggtgtcagtcggcccctggacacgaccggccaggtattaccgnggtacggggaaaacncagttggaaagtaagactgtagccacgtaggtaccaagcagaacgccgacggcgaggcccctgcgacgtggtcgtactagtcggtagacgtggaccgtaccggcccttacgacgggtactccccgtagacggacgtacgttccgtcgtcggtcctaccgtaacgtcgtaccgggaacccgtccgacccgtcgaaccgtacctacgaccgggtcccgggacgaaacgggacgggtacgtacgggtaacggtccgttacgggtaaaccttaacggtttacgttacgggtacccgttaaacggggttgggttaccggggtaaagtttacggggtttacggggttaaacggtttacggggtttaccgggttcgggtttaccgggttttacgggaaccgggtttacggttaacccggggggtaaaccccggttaaccggggttaccccggttaacccgggtttaccccgggtttacgggttaacccgggtaacccgggtaaccccggttaaacccgggaacccccggtaaaccccccgttaaccggttaacccggttacccgttaacccggtttacccgtttacccccgggtttaccccccgttaaccccgtttcccccggtttaacccctttccccgttacccggtttaaccccggttaccccgg

SEQ ID NO: 135760 - DNA, 830 bp, Homo sapiens
  misc_feature: GYAE6OF02IH8M8.49.11.A11.1.454.CMB.1.raw
  modified_base (305)..(305): a, c, t, g, unknown or other
  misc_feature (305)..(305): n is a, c, g, or t
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagcccaccctcggtgtcagtcggcccctgggacagaccggccaggacttaccgtggtaggggggaaaacactagttgggaaagttaagactgtgcactggtaccagcagaagccaggcaggcccctgtgcgtggtcgtctagtgggngtagtgggccggaacccggccctcgacggggactcccgtggacgcggtacttctcgtcggtctacccgaacttccggtaccggggaaccccggccctaacccgtacggaaccctacgtccgaaccgggtcccggggtaccggaaacgggacgggggtacgtacgggacgggtacccggtaacgttaactttacggtgtacggtacggggttagggtacggggtaagtacggttaggtaacgtaaccgggtaccgttaagggtttcggggtaccgggtttcgggggaaccgggtaacgggggtaaccggtaaacgggggttaccgggtacccgggtttaccgggtaacgggtaccggtaacccgggacccggtaaacgggtcccgttaccccgggttacccccccggttaccgggttaaccccgttacccggtttcccgttaccccggttttccccccgaacccccgtttccccgtttccccggtttacccgtttccccgtttaccccggtaacccgtttcccggg

SEQ ID NO: 135761 - DNA, 259 bp, Homo sapiens; identical to SEQ ID NO: 134954
  misc_feature: GYAE6OF02IEUNI.49.11.A11.1.454.CMB.1.raw
  modified_base (252)..(259): a, c, t, g, unknown or other
  misc_feature (252)..(259): n is a, c, g, or t

SEQ ID NO: 135762 - DNA, 580 bp, Homo sapiens
  misc_feature: GYAE6OF02HVV8O.49.11.A11.1.454.CMB.1.raw
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagccaccctcggtgtcagtggcccctggacagacggccaggattaccgtgtgggggaaacacattggaaagtaagactgtgcactggtaccagcagaagccaggccaggcccctgtgctggtcgtctatggtgatgggccgaccggccctcgagggctcccgtgacgcgtattctcgtggcctaccaacgtcgtacgggaaccccgccacccgtgaccatcgacggccgggtacgaaggacggggatcggacggccgaactattactgtcgaggtgtgggataggtggtagtggtgtcgtcgtcggagtcgtgggaccgtagggtccaccgtcgtaggtcacgacccgaagccccaacccgtacgtcgtaccaccttccgtccgttaccccacccttccgttcctcctcctccgacttccgg

SEQ ID NO: 135763 - DNA, 599 bp, Homo sapiens
  misc_feature: GYAE6OF02HVD8R.49.11.A11.1.454.CMB.1.raw
  modified_base (221)..(221): a, c, t, g, unknown or other
  misc_feature (221)..(221): n is a, c, g, or t
  modified_base (239)..(239): a, c, t, g, unknown or other
  misc_feature (239)..(239): n is a, c, g, or t
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagccaccctcggtgtcagtggcccctggacagacggccaggattaccgtggtagggggaaacncattggaagtaagactgngcacgtggtaccagcagaacgccaggccaggcccctgtgcgtggtcgtctatggtgagtcggccgaccggccctcgagggactcccgtgacgcgtattctcgtcggcctaccaacgttcgtacgggaaccccgccaccctcgaccactcgacggccgggtacgaagggacggggatggacggccgtaacgttattacgtgtcgagggttggtgggtataggttggttaggtggtacgttcgttcgtcgggagtcggtcgggaccgtagggtccaccggttcgtaggtcacgacccgaacgcccaacccgtgtcgtacctccgtcgttccgttccccgtcctcctcctcctcgtcgactcg

SEQ ID NO: 135764 - DNA, 597 bp, Homo sapiens
  misc_feature: GYAE6OF02IVR2I.49.11.A11.1.454.CMB.1.raw
  modified_base (482)..(482): a, c, t, g, unknown or other
  misc_feature (482)..(482): n is a, c, g, or t
  modified_base (539)..(539): a, c, t, g, unknown or other
  misc_feature (539)..(539): n is a, c, g, or t
tcagagtcgagagacacgaccggtgctcgatttagctacgactgcaggggggggcctaaggaagcagcactggtggtgcctcagccatggcctggaccgttctcctcctcggcctcctctctcactgcacagactctgtgacctcctatgtgctgactcagccaccctcggtgtcagtcggcccctggacagaccggccaggattaccgtggtagggggaaaacacagttgggaaagtaagactgtgcactggtaccagcagaagccaggccaggcccctgtgctggtcgtctagtggtgatggcgaccggccctcgagggactcccgtgagcgtattctctggctccaactcgtccgggacccgccaccctcgaccactcgacggccgggtacggaacgggacggggatggacggaccgtacttacgttacgtgtacgagggttggtagggtataggtggtagttggtgtcgttcgttggngtcggtgggacgtgggtccaccggtccgtaggtcacgcccgaacggccccaacccgngtcgtacctactccgttcccgtacccctaccctcctccgttcctccgttccgtctccg

SEQ ID NO: 135765 - DNA, 263 bp, Homo sapiens
  misc_feature: GYAE6OF02FHCHA.49.11.A11.1.454.CMB.1.raw
  modified_base (230)..(230): a, c, t, g, unknown or other
  misc_feature (230)..(230): n is a, c, g, or t
  modified_base (252)..(263): a, c, t, g, unknown or other
  misc_feature (252)..(263): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttccccacctcctctctctcgactctgngcgggctggcaaggcgcatagnnnnnnnnnnnn

SEQ ID NO: 135766 - DNA, 259 bp, Homo sapiens; identical to SEQ ID NO: 134954
  misc_feature: GYAE6OF02GCWH7.49.11.A11.1.454.CMB.1.raw
  modified_base (252)..(259): a, c, t, g, unknown or other
  misc_feature (252)..(259): n is a, c, g, or t

SEQ ID NO: 135767 - DNA, 581 bp, Homo sapiens
  misc_feature: GYAE6OF02HX96Y.49.11.A11.1.454.CMB.1.raw
  modified_base (221)..(221): a, c, t, g, unknown or other
  misc_feature (221)..(221): n is a, c, g, or t
  modified_base (325)..(325): a, c, t, g, unknown or other
  misc_feature (325)..(325): n is a, c, g, or t
  modified_base (368)..(368): a, c, t, g, unknown or other
  misc_feature (368)..(368): n is a, c, g, or t
tcagagtcgagagacacgaccggtgctcgatttagctacgactgcaggggggcctaaggaagcagcactgtggtgcctcagccatggcctggaccgttctcctcctcggcctcctctctcactgcacagactctgtgacctcctatgtgctgactcagccaccctcggtgtcagtcggcccctggacagacggccaggattaccgtggtagggggaaacanagttggaagtaagactgtcgacactggtaccagcagaagccaggccacggcccctgtcgctggtcgtctagtggtgagtggcgaccggcctcgagggctcccgngagcgattctgcggcctacacgtcgtccgggaacccgccaccngaccatccgacgccgggtacgaacggcggggactggacggccgtaacgtacttacgtgtcgaggtggtggagttaggtggtagtggttcgtcgttcgttggacgtcgtcgggaccgacgggtccaccggtctaggtcacgaccgaacgccaacccctagtcgtcctaacgtcttaccgttccccgtaccttccctctccttcgtcctacgtcg

SEQ ID NO: 135768 - DNA, 260 bp, Homo sapiens
  misc_feature: GYAE6OF02JWZET.49.11.A11.1.454.CMB.1.raw
  modified_base (251)..(260): a, c, t, g, unknown or other
  misc_feature (251)..(260): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccaccctcctctctctcgactctgagcggctggcaaggcgcatagnnnnnnnnnn

SEQ ID NO: 135769 - DNA, 260 bp, Homo sapiens
  misc_feature: GYAE6OF02JOMW0.49.11.A11.1.454.CMB.1.raw
  modified_base (140)..(140): a, c, t, g, unknown or other
  misc_feature (140)..(140): n is a, c, g, or t
  modified_base (190)..(190): a, c, t, g, unknown or other
  misc_feature (190)..(190): n is a, c, g, or t
  modified_base (224)..(224): a, c, t, g, unknown or other
  misc_feature (224)..(224): n is a, c, g, or t
  modified_base (240)..(240): a, c, t, g, unknown or other
  misc_feature (240)..(240): n is a, c, g, or t
  modified_base (246)..(260): a, c, t, g, unknown or other
  misc_feature (246)..(260): n is a, c, g, or t
tcagagtcgagagacacgaccggtgctcgatttagctacgactgcaggggaacccggccaccctgaccatcagccgggtcgaagacggggatgaggccgactattactgtcaggtgtgggatagtggtagtggtgtcgtnttcggagctgggaccagggtcaccgtctaggtcagcccaaggccaacccntgtcactctgttcccacctcctctctctcactcngagcggctggcagccntatagnnnnnnnnnnnnnnn

SEQ ID NO: 135770 - DNA, 259 bp, Homo sapiens; identical to SEQ ID NO: 135163
  misc_feature: GYAE6OF02HT3P8.49.11.A11.1.454.CMB.1.raw
  modified_base (252)..(259): a, c, t, g, unknown or other
  misc_feature (252)..(259): n is a, c, g, or t

SEQ ID NO: 135771 - DNA, 259 bp, Homo sapiens; identical to SEQ ID NO: 135656
  misc_feature: GYAE6OF02GBB9H.49.11.A11.1.454.CMB.1.raw
  modified_base (251)..(259): a, c, t, g, unknown or other
  misc_feature (251)..(259): n is a, c, g, or t

SEQ ID NO: 135772 - DNA, 255 bp, Homo sapiens
  misc_feature: GYAE6OF02HWZDX.49.11.A11.1.454.CMB.1.raw
  modified_base (244)..(244): a, c, t, g, unknown or other
  misc_feature (244)..(244): n is a, c, g, or t
  modified_base (250)..(255): a, c, t, g, unknown or other
  misc_feature (250)..(255): n is a, c, g, or t
tcagagtcgagagacacgaccggtgctcgatttagctacgactgcagggaacccggccaccctgaccatcagccgggtcgaagacgggatgaggccgactattactgtcaggtgtgggatagtggtagtggtgtcgtcttcggagctgggaccagggtcaccgtcctaggtcagcccaaggccaaccccactgtcactctgttcccaccctcctctctctcgactctgacgcggctggcaggcncatagnnnnnn

SEQ ID NO: 135773 - DNA, 622 bp, Homo sapiens
  misc_feature: GYAE6OF02GPM68.49.11.A11.1.454.CMB.1.raw
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagccaccctcggtgtcagtggcccctggacagacggccaggattacctgtgggggaaacacagttggaagtaagactgtgcacgtggtaccagcaagaagccaggccaaggcccctgtgctggtcgtctagtggtgatggcgaccggccgtcagggactcccgtgacgcgtatctctaggctaccgaactcgtcgggaacccggccaccgtcgaccatcgacggccggtacgaaggacgggatcgtacggcccaattacgtaacgtgtcgtagggtggtagggattaaggttggtaggtggttcggtcggttacgttcgggacgtcggtacggggaccgtacggggtcctaccgggttccttagggtacacgccccgaagggccccaacccgtacgtcgtaccacgttcccgtacgtttccccacccgttcccttccgttaccttccggtaccgtacctcccgg

SEQ ID NO: 135774 - DNA, 269 bp, Homo sapiens
  misc_feature: GYAE6OF02GNHLX.49.11.A11.1.454.CMB.1.raw
  modified_base (149)..(149): a, c, t, g, unknown or other
  misc_feature (149)..(149): n is a, c, g, or t
  modified_base (261)..(269): a, c, t, g, unknown or other
  misc_feature (261)..(269): n is a, c, g, or t
tcagagtcgagagacacgaccggtgctcgatttagctacgactgcaggggaacccggccaccctgacccatcagccgggtcgaagacgggggatgaggccgactatatctgtcaggtgtgggatagtagtagtgctcttccggggggtnttcggcggagggaccaagttgaccgtcgttggtcagcccaaggctgccccctggtcactctgttcccgccctcctctctctcgactctgagcgggctggcaaggcgcatagnnnnnnnnn

SEQ ID NO: 135775 - DNA, 256 bp, Homo sapiens
  misc_feature: GYAE6OF02F97YQ.49.11.A11.1.454.CMB.1.raw
  modified_base (252)..(256): a, c, t, g, unknown or other
  misc_feature (252)..(256): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtaactctgttcccaccctcctctctctcgactctgagcgggctggcaaggcgcatagnnnnn

SEQ ID NO: 135776 - DNA, 511 bp, Homo sapiens
  misc_feature: GYAE6OF02I6UYX.49.11.A11.1.454.CMB.1.raw
  modified_base (244)..(244): a, c, t, g, unknown or other
  misc_feature (244)..(244): n is a, c, g, or t
  modified_base (250)..(255): a, c, t, g, unknown or other
  misc_feature (250)..(255): n is a, c, g, or t
  modified_base (257)..(258): a, c, t, g, unknown or other
  misc_feature (257)..(258): n is a, c, g, or t
  modified_base (261)..(261): a, c, t, g, unknown or other
  misc_feature (261)..(261): n is a, c, g, or t
  modified_base (266)..(266): a, c, t, g, unknown or other
  misc_feature (266)..(266): n is a, c, g, or t
  modified_base (270)..(270): a, c, t, g, unknown or other
  misc_feature (270)..(270): n is a, c, g, or t
  modified_base (272)..(272): a, c, t, g, unknown or other
  misc_feature (272)..(272): n is a, c, g, or t
  modified_base (274)..(274): a, c, t, g, unknown or other
  misc_feature (274)..(274): n is a, c, g, or t
  modified_base (277)..(279): a, c, t, g, unknown or other
  misc_feature (277)..(279): n is a, c, g, or t
  modified_base (281)..(281): a, c, t, g, unknown or other
  misc_feature (281)..(281): n is a, c, g, or t
  modified_base (285)..(286): a, c, t, g, unknown or other
  misc_feature (285)..(286): n is a, c, g, or t
  modified_base (288)..(288): a, c, t, g, unknown or other
  misc_feature (288)..(288): n is a, c, g, or t
  modified_base (290)..(291): a, c, t, g, unknown or other
  misc_feature (290)..(291): n is a, c, g, or t
  modified_base (297)..(297): a, c, t, g, unknown or other
  misc_feature (297)..(297): n is a, c, g, or t
  modified_base (299)..(299): a, c, t, g, unknown or other
  misc_feature (299)..(299): n is a, c, g, or t
  modified_base (301)..(301): a, c, t, g, unknown or other
  misc_feature (301)..(301): n is a, c, g, or t
  modified_base (307)..(307): a, c, t, g, unknown or other
  misc_feature (307)..(307): n is a, c, g, or t
  modified_base (310)..(310): a, c, t, g, unknown or other
  misc_feature (310)..(310): n is a, c, g, or t
  modified_base (316)..(316): a, c, t, g, unknown or other
  misc_feature (316)..(316): n is a, c, g, or t
  modified_base (319)..(319): a, c, t, g, unknown or other
  misc_feature (319)..(319): n is a, c, g, or t
  modified_base (326)..(327): a, c, t, g, unknown or other
  misc_feature (326)..(327): n is a, c, g, or t
  modified_base (329)..(329): a, c, t, g, unknown or other
  misc_feature (329)..(329): n is a, c, g, or t
  modified_base (336)..(336): a, c, t, g, unknown or other
  misc_feature (336)..(336): n is a, c, g, or t
  modified_base (352)..(352): a, c, t, g, unknown or other
  misc_feature (352)..(352): n is a, c, g, or t
  modified_base (355)..(355): a, c, t, g, unknown or other
  misc_feature (355)..(355): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccatgtcactctgttcccacctctctctctcgactctgacgcgggctggcaaggcncatagnnnnnnannacngactngacntngntcnnntnctgnngntnncgatcngntnagtcancgnagctgnacngcatgtnntnatcgacngtactgcgactgtacncgngtcgtctcgcgtacgtacgtacgtacgtacgtacgtacgtacgacgtacgtacgtcgtacgtacgtacgtacgtacgtacgttacgtacgtacgtacgtacgtacgtacgtacgtacgtacgtagtacgtcgtacgtacgtacgtacgtacgtacg

SEQ ID NO: 135777 - DNA, 806 bp, Homo sapiens
  misc_feature: GYAE6OF02JVYYW.49.11.A11.1.454.CMB.1.raw
  modified_base (292)..(292): a, c, t, g, unknown or other
  misc_feature (292)..(292): n is a, c, g, or t
tcagagtcgagagacacgaccggtgctcgatttagctacgactgcaggggggccgtaaggaagcagcactggtggtgcctcagccatggcctggaccgttctcctcctcggcctcctctctcactgcacagactctgtgacctcctatgtgctgactcagccacctcggtgtcaggtcgcccctggacagaccggccagggacttaccgtgggtacgggggaaaacacgagttgggaaagtaaggactgtgacacgtggtaccaggcagaacgcgaggccacggcccctagngcgtggtctactgtcggtgacgtggccgaccggcctcgaagggtcctccgtggacgcgactttcgtacgtcggtcctaccgtaaccgttccggtacggggaaccccgtccccgtaacccgtacggtaaccccgtacgtaccggtaacccggggtacccggggttaacggaaaacggggaccggggggtacgtacggggtaaccgggtaccccggtaaacgttaacgtttaccggttacgggtaccggttaacgggggttacggggtacggggttaacggttacggggttagggttacgggttcggggttacggtttccggggttacggttccggggtaagggttccggtaccgggggacccggttaacggggtacccgtacccgggttacgtacgggttccgaaccggtacccgtaaccggcccctaacccgtaccggtacggtaccttaaccggtccgtacccgttccccgtaccccttccgttcccttcccgtaccttaccgtaccttccgg

SEQ ID NO: 135778 - DNA, 643 bp, Homo sapiens
  misc_feature: GYAE6OF02FHU7Z.49.11.A11.1.454.CMB.1.raw
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagccaccctcggtgtcagtggcccctggacagacggccaggattacctgtgggggaaaccacattggaagtaagactgtgcactggtaccagcagaagccaggccaggcccctgtcgctggtcgtctatggtgatggcgaccggccctcgagggactcccgtgagcgacttctctggctccaactcgacgggaccccgccacccgtgaccactcgacggccgggtacgaacggacggggtatacggacggcccgtaactaactttacgtcggtacgtaggggttcggtacggggaattacgggttggttaggttgggtcgttcgttcgtttcgggagtcgtggggacccaggggttccaaccggttccgtaggtaccacggtaccccgaaacgggccccaaaccccgcgttcggtaccacccgttccgttaccgttcccccgtaaccccttcccgttcccgttcctccgttccggtaccttccgg

SEQ ID NO: 135779 - DNA, 257 bp, Homo sapiens
  misc_feature: GYAE6OF02IXL69.49.11.A11.1.454.CMB.1.raw
  modified_base (251)..(257): a, c, t, g, unknown or other
  misc_feature (251)..(257): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccaccctccttctctcgactctgagcgggctggcaaggcgcatagnnnnnnn

SEQ ID NO: 135780 - DNA, 260 bp, Homo sapiens; identical to SEQ ID NO: 135056
  misc_feature: GYAE6OF02GDD7U.49.11.A11.1.454.CMB.1.raw
  modified_base (252)..(260): a, c, t, g, unknown or other
  misc_feature (252)..(260): n is a, c, g, or t

SEQ ID NO: 135781 - DNA, 295 bp, Homo sapiens
  misc_feature: GYAE6OF02JCQ7H.49.11.A11.1.454.CMB.1.raw
  modified_base (257)..(295): a, c, t, g, unknown or other
  misc_feature (257)..(295): n is a, c, g, or t
tcagagtcgagagacacgaccggtgctcgatttagctacgactgcaggggaacccggccaccctgaccatacagccgggtcgaagacggggatgaggccgactattactgtcagggtgtgggatagtggtagtggtgtcgtcttcggagctgggaccagggtcaccgtcctaggtcagcccaaggccaaccccactgtcacgtctgttcccacctcctctctcgtcgactctgagcgggctggcaaggcgcatagcnnnnnnnnnnnnnnnnnnnnnnnnnnnnnnnnnnnnnnn

SEQ ID NO: 135782 - DNA, 302 bp, Homo sapiens
  misc_feature: GYAE6OF02HELFJ.49.11.A11.1.454.CMB.1.raw
  modified_base (261)..(302): a, c, t, g, unknown or other
  misc_feature (261)..(302): n is a, c, g, or t
tcagagtcgagagacacgaccggtgctcgatttagctacgactgctaggggtaacccgggccaccctgacccatcagccggtcgaagacgggatgaggccgactagttacctgtcaggtgtcgggagtagtcggtagtggtgtcgtcttcggagcctgggaccagggtcaccgtcctaaggtcacgcccaaggcccaaccccactgtcactcctgttcccacctcctctctctcgactctgagcggctgcaagcgcatagnnnnnnnnnnnnnnnnnnnnnnnnnnnnnnnnnnnnnnnnnn

SEQ ID NO: 135783 - DNA, 679 bp, Homo sapiens
  misc_feature: GYAE6OF02G1F0P.49.11.A11.1.454.CMB.1.raw
  modified_base (194)..(194): a, c, t, g, unknown or other
  misc_feature (194)..(194): n is a, c, g, or t
  modified_base (222)..(222): a, c, t, g, unknown or other
  misc_feature (222)..(222): n is a, c, g, or t
  modified_base (273)..(273): a, c, t, g, unknown or other
  misc_feature (273)..(273): n is a, c, g, or t
  modified_base (321)..(321): a, c, t, g, unknown or other
  misc_feature (321)..(321): n is a, c, g, or t
  modified_base (523)..(523): a, c, t, g, unknown or other
  misc_feature (523)..(523): n is a, c, g, or t
tcagagtcgagagacacgaccggtgctcgatttagctacgactgcgtagggggggcctaaggaagcagtcactggtggtgcctcagccatggcctggaccgttctcctcctcggcctcctctcgtcactgcacagactctgtgacctcctatcgtgctgactcagccaccctcggtgtcagtggcccctggacngacggccaggattacctgtggggaaacncattggaatagactgtgcactggtaccagcagagccaggccaggcccctgngctggtcgtctactggtcagtggcgaccggcctcgacgggactcccgngacgtcgtacttctcgtggcctccgaactccgtacggggaaccccggcctacccgtcgaccctactccgacggtacccggggtacgaaacgggtaccgggggtatcgggaacggtcccggtaacttagttaccgtgtaccgtaagggttggtacgggtattagggttcgggtaggttcgggttcgttacgtcgtttacgggngtaccggttacggggacccgtagggtccgtaccggtacgttaacgggtccaacggacccgaagggaccccaaccccgtacgttcggtaccctaccgttccgttaccggttcccccgaccctttacccgtccttacccgtcctacccggtactccgg

SEQ ID NO: 135784 - DNA, 255 bp, Homo sapiens; identical to SEQ ID NO: 134799
  misc_feature: GYAE6OF02FMA7J.49.11.A11.1.454.CMB.1.raw
  modified_base (252)..(255): a, c, t, g, unknown or other
  misc_feature (252)..(255): n is a, c, g, or t

SEQ ID NO: 135785 - DNA, 253 bp, Homo sapiens
  misc_feature: GYAE6OF02HUQAP.49.11.A11.1.454.CMB.1.raw
  modified_base (250)..(253): a, c, t, g, unknown or other
  misc_feature (250)..(253): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccacctcctctctctcgactctgagcgggctggcaggcgcatagnnnn

SEQ ID NO: 135786 - DNA, 700 bp, Homo sapiens
  misc_feature: GYAE6OF02HNS0J.49.11.A11.1.454.CMB.1.raw
tcagagtcgagagacacgaccggtgctcgatttagctacgactgcaggggggggcctaaggaagcagcactggtggtgcctcagccatggcctggaccgttctcctcctcggcctcctctctcactgcacagactctgtgacctcctatgtgctgactcagccaccctcggtgtcagtcggccctggacagaccggccaggacttaccgtggtagggggaaaacacagttaggaagtaagactgtgctactggtaccagcagaacgccaggccaggcccctgtcgcgtggtcgtctagtggtgagtggacgaccggccctcgagggactcccgtgagcgtattctcgtggcctaccaacgtcgtacggggaacccgacctaacccgcgaacccagtacacggccgggtacggaaagggacgggagtggacggccgtaaccttagttaacgttcggtacgagggttcggtaggggtattacgggttaggtttaggtaggggtttcgtacggttccggtttcggggaacgtcgggttccgggtaaccggtacggggttaccgaccgggtttacctacggggtaccaacgggtaccccgaacgggtaccccaacccgtacttcggtacctaaccggttccgttcccgtttcccccgtaccccgttcccgttaccttcccgtaccgttcccgttaccgtaccgg

SEQ ID NO: 135787 - DNA, 743 bp, Homo sapiens
  misc_feature: GYAE6OF02H5G4J.49.11.A11.1.454.CMB.1.raw
  modified_base (227)..(227): a, c, t, g, unknown or other
  misc_feature (227)..(227): n is a, c, g, or t
tcagagtcgagagacacgaccggtgctcgatttagctacgactgcaggggggggcctaaggaagcagcactggtggtgcctcagccatggcctggaccgttctcctcctcggcctcctcctctcactgcacagactctgtgaccttcctatgtgctgactcacgccaccctggtgtcagtcggccctggacagaccggccaggacttaccgtgggtagggggaaacncagtttggaattaacgacttgcgcacgttggaccagcagaacgccaggccacggtcccctggtacgtcgtaggtcgttactagttggtacgtatcgggacggacccgtcccgtcgacggtaccttcccgtagtacggcgtacttccgtcgtcggtcctaccgtaaaccgttcggtaccggggtaaccccggctaaccccgttaggaacccagtttaccgacgggtcccggggttaacgaacggggtacggggtacgtacggacgggtacgtacgtacgttaacgttacgtcggtacgtagggttacggtagggtacgttaagggttacggtagttcgggttcgttacggtcgttacgggacggtcggtacgggacccgtagggtacccgtacgtaccggtacggttaccgacggtaccccgaacgggtaccctaacccggtacgtaccgtaccgtaaccgttccgttcccgttacccctacccgttccgttacccttccgttccgtaccgttaccg

SEQ ID NO: 135788 - DNA, 292 bp, Homo sapiens
  misc_feature: GYAE6OF02G91D7.49.11.A11.1.454.CMB.1.raw
  modified_base (218)..(218): a, c, t, g, unknown or other
  misc_feature (218)..(218): n is a, c, g, or t
  modified_base (250)..(250): a, c, t, g, unknown or other
  misc_feature (250)..(250): n is a, c, g, or t
  modified_base (256)..(256): a, c, t, g, unknown or other
  misc_feature (256)..(256): n is a, c, g, or t
  modified_base (258)..(263): a, c, t, g, unknown or other
  misc_feature (258)..(263): n is a, c, g, or t
  modified_base (267)..(292): a, c, t, g, unknown or other
  misc_feature (267)..(292): n is a, c, g, or t
tcagagtcgagagacacgaccggtgctcgatttagctacgactgcagggaacccggccgaccctgaccatcagccgggtcgaagacggggatgaggcccgactattactgtcaggtgtgggatagtggtagtggtgtcgtcttcggagctgggaccagggtcaccgtcctaggtcagcccaaggccaaccccactgtcactctgttcccaccctcctntctctcgactctgagcgggctgggcaaggtcncatagnannnnnncttnnnnnnnnnnnnnnnnnnnnnnnnnn

SEQ ID NO: 135789 - DNA, 694 bp, Homo sapiens
  misc_feature: GYAE6OF02IWMSM.49.11.A11.1.454.CMB.1.raw
  modified_base (172)..(172): a, c, t, g, unknown or other
  misc_feature (172)..(172): n is a, c, g, or t
  modified_base (224)..(224): a, c, t, g, unknown or other
  misc_feature (224)..(224): n is a, c, g, or t
  modified_base (351)..(351): a, c, t, g, unknown or other
  misc_feature (351)..(351): n is a, c, g, or t
tcagagtcgagagacacgaccggtgctcgatttagctacgactgcagggggggcctaaggaagcagcactggtggtgcctcagccatggcctggaccgttctcctcctcggcctcctctctcactgcacagactctgtcgacctcctatgtgctgactcagccacctcggtntcagtcggcccctggacagacggccaggacttaccgtggtagggggaaaacncagttggaaagtaagactggtgcacgtggtaccagcagaagccaggtcacggcccctgtcgcgtggtcgtctagtggtagacgtggccgacccggtcctacgagggtctcccgtgacgtcgacttcncgtcggcctaccaacgtcgtacgggaacccgccctacccgtacgacctacgtcgaccgggtccgggtacgaaacgggtacggggtactacgggaccgggtaccgtaacgttacgtaacgttcggtacgtaacgggttggtacgggtattaggtgggttacgtggttcgtcgttcgtacgggtacgtcggtacgggacctaggggtccgtacccggttcgtacgggtccaaccggtacccgaacggaccctaaaccccgtcgttacgaccccgttaacgtcccgttacccggttccccgtccccttaccgttccgttaaccggttccctaccggtaccttccgg

SEQ ID NO: 135790 - DNA, 759 bp, Homo sapiens
  misc_feature: GYAE6OF02I4EH9.49.11.A11.1.454.CMB.1.raw
tcagagtcgagagacacgaccggtgctcgatttagctacgactgcaggggggggcctaaggaagcagcactggtggtgcctcagccatggcctggaccgttctcctcctcggcctcctctctcactgcacagactctgtgacctcctatgtgctgactcagccaccctcggtgtcagtcggcccctggacagacggccaggacttaccgtggtagggggaaacacagttagggaagtaagactggtgactacgtcggtaccagcaagaacgccgaaggccacggcccctgtcgcgtggtcgtctagtggtagagtcggccggtacccggccctcgacgggtacctcccgtagacgtccgtattcgtacgtcggacctacccgtaaacgtccggtacggggaacccccgtccgaacccgtacgaaccctacgtccgaacgggtcccggggtaacggaaacggggaccggggtagtacgggaacggtacccgtaagttaacgttacggtggttaccgtagggttcgggtaggggtagttaggggttaggtagggttcgggttacgttccggttcggttacgggacggtccggtacggggaaccggtacgggggttacctacccgggttaccggttacgggaccgtaaccgacccgaaaccggacccctaaaccccgtacgttcggtaaccctaccgttccgttaccccgttacccctaccccttcccgttaccgttcccgtacccggtaccttcggtacgg

SEQ ID NO: 135791 - DNA, 719 bp, Homo sapiens
  misc_feature: GYAE6OF02H0T2Z.49.11.A11.1.454.CMB.1.raw
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagcccaccctcggtgtcagtggcccctggacagacggccagggattaccgtggtagggggaaacgactagttgggaagtaagactggtcgcacgtggtaccagcaagaacgccaggccaggcccctggtgcgtggtcgtctagtggtgagtggcgacccggccctcgagggactcccgtgagcgattctctggctcccaactcgtacgggaaccccgccacccgtgaacccatacgacggtcccggggtacgaaacggggaccgggggtatacgggaacgggtcccgtaacgttactttacgttcggtacgtaggggtggttggggtaattagggttggggttaggttgggtcgttcggttaccgtttcgggacggtccggttacgggggacccgtacggggtacccgtacccgggttaccgttaacgggtccgaaccggtccccgaaacggggtaccccccaaaccccgtacgtacggtaccctaaccgttcccgttacccgttaccccctacccccgttccctttcccgtacccgtttcgtcccggttaccttacccgg

SEQ ID NO: 135792 - DNA, 791 bp, Homo sapiens
  misc_feature: GYAE6OF02J0CN1.49.11.A11.1.454.CMB.1.raw
tcagagtcgagagacacgaccggtgctcgatttagctacgactgcaggggggccgtaaggaagcagcactggtggtgcctcagccatggcctggaccgttctcctcctcggcctcctctctcactgcacagactctgtgacctcctatgtgctgactcagccacctcggtgtcagtcggcccctggacagacggccaggatttaccgtggtagggggaaaccacgatttagggaagtaaagactggtgcacgtggtaccagcagaagccaggccaggcccctgtgctggtctcgtagtcggtgagtcggccgaccggccctgacgggtactcccgtgacgtcgtattctcgtcggtcctaccctaacgtccgtacggggaaccccgacctacccgtcgacctacgccgtacgggcccggggtacggaacgggacggggtacgtacgggacgggtaccgtaacgttaacgttacgttcgggtacgtaaggggttcgggttacggggtaagttacggggttagggtttacggggttacgggttacgggttccgggtttacggtttaccggggtacggttccgggttaccgggggacccggttaacgggggttaccccggtacccggtttacccggtaagggttcccgaaccgggtaccccggaaaccggtacccccgaaacccgttaccggtcggttaacccgttaccgttacccgtttcccggtttaccccccggtccccttttacccgtcccgtttcccgttacccgttacccggttacccgttacccggg

SEQ ID NO: 135793 - DNA, 669 bp, Homo sapiens
  misc_feature: GYAE6OF02GWQTY.49.11.A11.1.454.CMB.1.raw
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagccaccctcggtgtcagtggcccctggacagacggccaggattacctgtggggaaacgacattggaagtaagactgtgcactggtaccagcagaagccaggccaggcccctgtgctggtcgtctatggtgatggcgaccggccctgagggcctccgagacgagtactcgtcgtgcctacctactcggtaaccgggaccccgacctacccgtacgaacctacgtaccgaccgggtccgggtaacggaaacggggaacgggtacgtaggaccggaaccgtaacgttaacttacgttcggtagtaggggttcgggtagggtaagtagggttaggtagggttcggttacggttcgttcggtcgggacgtcgggtaccggaccggtacggtccgtacccggttgtacggtcaaccggaaccgaaccgaccccaacccgtacgtcgtaacctacgttccgttacccggttccccgtccccttaccttcccttaccgttccgtaccgtccgttacgg

SEQ ID NO: 135794 - DNA, 261 bp, Homo sapiens
  misc_feature: GYAE6OF02II1WB.49.11.A11.1.454.CMB.1.raw
  modified_base (242)..(242): a, c, t, g, unknown or other
  misc_feature (242)..(242): n is a, c, g, or t
  modified_base (248)..(261): a, c, t, g, unknown or other
  misc_feature (248)..(261): n is a, c, g, or t
tcagagtcgagagacacgaccggtgctcgatttagctacgactgcagggaacccggccaccctgaccatcagccgggtcgaagcggggatgaggccgactattactgtcaggtgtgggatagtggtagtggtgtcgtcttcggagctgggaccagggtcaccgtctaggtcagcccaaggccaaccccactgtcactctgttcccaccctctctctctcgactctgagcggctggcaaggcncatagnnnnnnnnnnnnnn

SEQ ID NO: 135795 - DNA, 729 bp, Homo sapiens
  misc_feature: GYAE6OF02FN9ZU.49.11.A11.1.454.CMB.1.raw
  modified_base (319)..(319): a, c, t, g, unknown or other
  misc_feature (319)..(319): n is a, c, g, or t
tcagagtcgagagacacgaccggtgctcgatttagctacgactgcagggggggcccaaggaagcagcactggtggtgcctcagccatggcctggaccgttctcctcctcggcctcctctctcactgcacagactctgtgacctcctatgtgctgtactcagccaccctcggtgtcagtcggccccgtcggacgacgacgggaccaggtacgttaccgtggtacgggggaaacgaactagttaggtaaagtaagactgtgcacgtcggtacacgcgagaaagccgacggccacggcccctgtcggctggtcgtctatggngagtcggcgaccggccctgagggactcccgtgaggccgtattccgtcgtcggcctacccaactccgtacggggaccccgcccgacccctacggaccatccgacgggtcccggggtaacggaaagggacgggggagtacgggacgggtacccgtaacttacgttacgttcgtacggtacgggtgggtacgggtagttagggttagggttagggttgggtacggttccgttcggtttaccgggagggtccggtacgggggtaccgtacggggtactacccggttaccgtacggtaccgaacgtacccgaaccgggaccccaaaccccgtacggtccgtacccaccggttcccgttaccgttcccccgtccccttaccccgttccgttcccttccgttacccgtaccttccgg

SEQ ID NO: 135796 - DNA, 263 bp, Homo sapiens
  misc_feature: GYAE6OF02JFMWG.49.11.A11.1.454.CMB.1.raw
  modified_base (251)..(263): a, c, t, g, unknown or other
  misc_feature (251)..(263): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccatgtcactctgttcccgccctcctctctctcgactctgagcgggctggcaaggcgcatagnnnnnnnnnnnnn

SEQ ID NO: 135797 - DNA, 164 bp, Homo sapiens; identical to SEQ ID NO: 135429
  misc_feature: GYAE6OF02GKUS9.49.11.A11.1.454.CMB.1.raw
  modified_base (161)..(164): a, c, t, g, unknown or other
  misc_feature (161)..(164): n is a, c, g, or t

SEQ ID NO: 135798 - DNA, 666 bp, Homo sapiens
  misc_feature: GYAE6OF02H2XJ3.49.11.A11.1.454.CMB.1.raw
  modified_base (174)..(174): a, c, t, g, unknown or other
  misc_feature (174)..(174): n is a, c, g, or t
  modified_base (209)..(209): a, c, t, g, unknown or other
  misc_feature (209)..(209): n is a, c, g, or t
  modified_base (254)..(254): a, c, t, g, unknown or other
  misc_feature (254)..(254): n is a, c, g, or t
  modified_base (531)..(531): a, c, t, g, unknown or other
  misc_feature (531)..(531): n is a, c, g, or t
tcagagtcgagagacacgaccggtgctcgatttagctacgactgcaggggggggcctaaggaagcagcactggtggtgcctcagccatggcctggaccgttctcctccgtcggcctcctctctcactgcacagactctgtgacctcatatgtgctgactcagccacccgtggtntcagtcggccctggacagacggcaggtattaccgnggtaggggaacacagttaggaagtaagactgtgctactggtaccngcgagagccacggccacggcccctgtcgcgtggtcgtctagtggtgagtcgggccggaccggcccgtacgagggtactcccgtagacgcattctcgtcgtcctcctaacgttccggtacggggaacccgcccctacccgtacgaacctacgtacggaccggtaccggggacgaacggggacgggtgtaacgggtaccggaccgggtaactaagtttacgtgtacgaggttggggtaggtaggttaggtgggttaggtggttcgtcgtcggttacggnggtacggtcgggaaccgtcgggtaccgccgttacgacggtccaccgaccgaaccgacccctaaccgcgttaccgacctccgttacccgttcccggttccccgtcccttcccttccgtcccgttcgtaccccgtcg

SEQ ID NO: 135799 - DNA, 613 bp, Homo sapiens
  misc_feature: GYAE6OF02HNS0Y.49.11.A11.1.454.CMB.1.raw
  modified_base (415)..(415): a, c, t, g, unknown or other
  misc_feature (415)..(415): n is a, c, g, or t
  modified_base (502)..(502): a, c, t, g, unknown or other
  misc_feature (502)..(502): n is a, c, g, or t
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagccaccctcggtgtcagtggcccctggacagacggccaggacttacctggtagggggaaacacattaggaagtaagactgtgcactggtaccagcagaagcaggccaggcccctgtgctggtcgtctagtggtgagtggccgacccggccctcgagggactcccgtagagcgtattctcgtggcctccaactcgtacgggaaccccggccacccgtcgaccactccgacggcccgggtacggaacgggacgggganaggacggaccgtacttaacttacgtggtacgtagggttcggtgggtagttagggttgggtaggttgggttcgtcgttcgttccgggngtccgtgggaccgtagggtccaccggttcgtacggtcgacgcccgacggcccaacccgtacgtcgtaccactccgttccgtccccgcccttcctccttcgtctcctactcg

SEQ ID NO: 135800 - DNA, 275 bp, Homo sapiens
  misc_feature: GYAE6OF02GMP8W.49.11.A11.1.454.CMB.1.raw
  modified_base (244)..(244): a, c, t, g, unknown or other
  misc_feature (244)..(244): n is a, c, g, or t
  modified_base (250)..(275): a, c, t, g, unknown or other
  misc_feature (250)..(275): n is a, c, g, or t
tcagagtcgagagacacgaccggtgctcgatttagctacgactgcaggggaacccgggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccatgtcactctgttcccacctcctctctctcactctgagcggctggcaaggcncatagnnnnnnnnnnnnnnnnnnnnnnnnnn

SEQ ID NO: 135801 - DNA, 719 bp, Homo sapiens
  misc_feature: GYAE6OF02I9V4W.49.11.A11.1.454.CMB.1.raw
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcacgccaccctcggtgtccaggtcggcccctggacacggacggccaggtacttaccgtggtagggggaaacactagttagggaaagtaagactggtgcacgtacggtaccagacaaggaacgccgaggccgacggcccctggtcgccgtggtcgtctagtggtgagtcggaccggaccggccctacgacgggtacctcccgtaggacgtcgtacttccgtcgtcggtacctaccaacgttccggtaccgggaaccccgtccctacccgtcgaccgtacgtccgacgggtcccgggacggtaacgggacggggtactacgggaccggtaccgtacgttaacgttaacgtcggtaacggacggttcgggttaggtaacgttagggttacgggttaggttcgggttcgttaccggttcggttaccgggagtaccgggttaccgggaccggtacgggttccgtaaccggttcgtaacggtctaaccgccgtaacggtcccaacccgtgtccctacgtaccttcccgtccgtccccgtcccgtcctcgtcctccgtcgtaccgtcgg

SEQ ID NO: 135802 - DNA, 273 bp, Homo sapiens
  misc_feature: GYAE6OF02IVKWC.49.11.A11.1.454.CMB.1.raw
  modified_base (140)..(140): a, c, t, g, unknown or other
  misc_feature (140)..(140): n is a, c, g, or t
  modified_base (254)..(254): a, c, t, g, unknown or other
  misc_feature (254)..(254): n is a, c, g, or t
  modified_base (257)..(273): a, c, t, g, unknown or other
  misc_feature (257)..(273): n is a, c, g, or t
tcagagtcgagagacacgaccggtgctcgatttagctacgactgcagggaacccggccaccctgaccatcacgccgggtcgaagacggggatgaggccgactattactgtcaggtgtgggatagtggtagtggtgtcgtnttcggagctgggaccagggtcaccgtctaggtcagcccaaggccaacccattgcactctgttcccacctcctctctctcaactcgtgaagcgggctggacaaggcgcaattagnacnnnnnnnnnnnnnnnnn

SEQ ID NO: 135803 - DNA, 807 bp, Homo sapiens
  misc_feature: GYAE6OF02I8622.49.11.A11.1.454.CMB.1.raw
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagccacctcggtgtcagtcggcccctggacagacggccaaggacttaccgtggtacgggggaaacacagtttcggaaagtaaggactgtggccacgtggtaaccagccaagaacgccgaggccacggccccgtagttcggcgtggttccgtcttagtggttggaagtcggggccgaccccggtcctcggaacggggactccccgtaggacgtcggtacttcgtccgtgggccttaccgaaaccgttcggtaccgggggaaccccgtcccgaacccgttcgaaaccgtactacgaccggacccgggggtacggaaaacgggacgggggtacgtagggaaccgggcccgtaacttacgttaacgtggtaccgtaaggggttcggtacggggtattagggttacgggttacggttgggttcggttacggttcggttacggggacgtccggttacgggggaacccggtacggggtaccgtaacccggttccgtaagggttacccgaacggttaccccggaaacggggacccccctaaacccggttaccggtccggttaaccgtacccggtttccgttacccgggtttcccccctaaccccggtttccccgttttcccgtaccccgttacgttacccccgaaccgtttcccggg

SEQ ID NO: 135804 - DNA, 257 bp, Homo sapiens
  misc_feature: GYAE6OF02FO8LA.49.11.A11.1.454.CMB.1.raw
  modified_base (252)..(257): a, c, t, g, unknown or other
  misc_feature (252)..(257): n is a, c, g, or t
tcagagtcgagagacacgaccggtgctcgatttagctacgactgcagggaacccggccaccctgaccatcagccgggtcgaagacggggatgaggtcgactattactgtcaggtgtgggatagtggtagtggtgtcgtcttcggagctgggaccagggtcaccgtcctaggtcagcccaaggccaaccccactgtcactctgttcccaccctcctctctctcgactctgagcgggctggcaaggcgcatagnnnnnn

SEQ ID NO: 135805 - DNA, 256 bp, Homo sapiens
  misc_feature: GYAE6OF02IJT7G.49.11.A11.1.454.CMB.1.raw
  modified_base (251)..(256): a, c, t, g, unknown or other
  misc_feature (251)..(256): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaaggccaaccccactgtcactctgttcccgccctctctctctcgactctgagcggctggcaaggcgcatagnnnnnn

SEQ ID NO: 135806 - DNA, 254 bp, Homo sapiens; identical to SEQ ID NO: 134762
  misc_feature: GYAE6OF02FWMPO.49.11.A11.1.454.CMB.1.raw
  modified_base (252)..(254): a, c, t, g, unknown or other
  misc_feature (252)..(254): n is a, c, g, or t

SEQ ID NO: 135807 - DNA, 262 bp, Homo sapiens
  misc_feature: GYAE6OF02H5MJX.49.11.A11.1.454.CMB.1.raw
  modified_base (251)..(262): a, c, t, g, unknown or other
  misc_feature (251)..(262): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccgccctcctctctctcgactctgagcgggctggcaggcgcatagnnnnnnnnnnnn

SEQ ID NO: 135808 - DNA, 256 bp, Homo sapiens
  misc_feature: GYAE6OF02HXQGV.49.11.A11.1.454.CMB.1.raw
  modified_base (250)..(256): a, c, t, g, unknown or other
  misc_feature (250)..(256): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccgccctcctctctctcgactctgagcggctggcaggcgcatagnnnnnnn

SEQ ID NO: 135809 - DNA, 255 bp, Homo sapiens
  misc_feature: GYAE6OF02HRRN1.49.11.A11.1.454.CMB.1.raw
  modified_base (248)..(255): a, c, t, g, unknown or other
  misc_feature (248)..(255): n is a, c, g, or t
tcagagtcgagagacacgaccggtgctcgatttagctacgactgcagggaacccggccaccctgaccatcagccgggtcgaaagacggggatgaggccgactattactgtcaggtgtgggatagtggtagtggtgtcgtcttcggagctgggaccagggtcaccgtcctaggtcagcccaaggccaacccactgtcactctgttcccacctcctctctctcgactctgagcggctggcaggcgcatgnnnnnnnn

SEQ ID NO: 135810 - DNA, 917 bp, Homo sapiens
  misc_feature: GYAE6OF02G8EQB.49.11.A11.1.454.CMB.1.raw
  modified_base (450)..(450): a, c, t, g, unknown or other
  misc_feature (450)..(450): n is a, c, g, or t
tcagagtcgagagacacgaccggtgctcgatttagctacgactgcaggggggccgtaaggaagacagcactggtggtgccgtcagccatggcctggaccgttctcctcctcggcctcctctctcactgcacagactctgtcgacctcctatgtcgctgactcagcccacctcggtcgtcaggtcggccccgtggaccacggaccggccgaaggactttacctgggtacgggggaaaacgtacaagtttagggaaagtaaggaacttggtacgccgaaacttcgggtaaccaaggtaccgaaggaaacggacccgaagggacccgacgggtaccccccgtcggttggcgttcgggttccggttccgttaaggttggtacggtaagttcggggacccggtaaccgggcccccttcgaacggggtactccccgtaggacggcgtacttttccncggtcgggtccctaccgaacgttacccggtacggggaaacccccggtccctaccccgtaggaacccctacggtcgaccggggtacccggggtacggaaacgggaccgggggtacgtacgggtaaccgggaccggtaacgttaaccgtttaacggttccggttacggtaacggggtttacgggtagggggttaacgtttaaggggttacggggtttaacgggtttggggttacgggtttaccggggtttccgtttaccgggggttaacgggttcggttaccgggggtaacccgtacgggggtttcccgtaaccccgggtttccgggttaacgggtccgttaacgggaacccccgtaacggaccccggtaaccccctacggtaccggtacctcccgttacgttccccggtttaccccgccccgtttacccgttcccgttacccgttccgttcccgtaccgtttacccgg

SEQ ID NO: 135811 - DNA, 579 bp, Homo sapiens
  misc_feature: GYAE6OF02FXBWH.49.11.A11.1.454.CMB.1.raw
tcagagtcgagagacacgaccggtgctcgatttagctacgactgcaggggggggcctaaggaagcagcactggtggtgcctcagccatggcctggaccgttctcctcctcggcctcctctctcactgcacagactctgtgacctcctatgtgctgactcagccacctcggtgtcagtggcccctggacagacggcaggattacctgctctggagatgcattgaccaaagcaatatgcttactggtaccagcagaacgccaggccaggccctgtctgatctatttataaagtactttgaggagggcctacgacggacccctgacgcgtacttctctggcctcagtctcagcgacaacacgttacacgttcgaacctatcgaggtggacggttccggggactaggacggacggaggcgtagaacttatacgtgtctagtcatcgacgacgagtagtcggacttaccgttctacggttcgttacgttccgggacgggaacgggtaccgaacgtaccgtaccggtaccgttacccgtaaggtaccaccggtacccgacggaccctccggacccccttaccggg

SEQ ID NO: 135812 - DNA, 1014 bp, Homo sapiens
  misc_feature: GYAE6OF02JKP20.49.11.A11.1.454.CMB.1.raw
tcagagtcgagagacacgaccggtgctcgatttagctacgactgcaggggggccgtaaggaagcagcactggtggtgcctcagccatggcctggaccgttctcctcctcggcctcctctctcactgcacagactctgtgacctcctatgtgctgactcagcccacctcggtgtcagtggcccctggacagacggccagggtattaccgtggtacgggggaaacacgtagtttcgggaaagttaaggaccttggtacgcctaacttgggtaaccaggaccaggaaacgcccgagggcccaacgggtccccctaggtcggtccgtagggggttccgtaccgttaagttcgggggttacggtaacgttcgggggtaacccggtaccccggggtccccgttacgaacggggggtaactttccccccgtaggggaccggaccgtaacgttttccgttccgttcgggaccctaaccccgttaaacctccggttaacggggggaaacccccgtccctaacccccgttggaaccctaacgttccgaaccggtccccgggggggttaccaaaacggggccggggggtatacgggaagggtaccccgaacgggtttacctaaaccggttcggtaccgtaaggggttcggtacggggtaattacggggtttacggggtaacggttcgggggtttacgggttaccgggttttaccggttttaccgggggtaaacgggttccgggtttaaccggggggtaccccggtaaacgggggtttaaccgtaaccccccgggttttaccgggtttaacggggttaccccggaaccgggttaccccccggtaaaacgggggtaccccccctaaaaccccggtaccccggttttaaagggtaccccggtacccgttttaaccccggttacccggggtttttttaaaccccccccgaacccccctttttcccccggttccccccgttttaccgttacccccgggttttacccgtaacccccgggtttaaccccggg

SEQ ID NO: 135813 - DNA, 287 bp, Homo sapiens
  misc_feature: GYAE6OF02GW9FG.49.11.A11.1.454.CMB.1.raw
  modified_base (193)..(193): a, c, t, g, unknown or other
  misc_feature (193)..(193): n is a, c, g, or t
  modified_base (255)..(287): a, c, t, g, unknown or other
  misc_feature (255)..(287): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcggtcttcggagctgggaccagggtcaccgtcctaggtcagcccaaggcccaaccccntgtcactctgtccccaccctctctctcgtcgactctgagcgggcttggacaaggcacatagnnnnnnnnnnnnnnnnnnnnnnnnnnnnnnnnn

SEQ ID NO: 135814 - DNA, 265 bp, Homo sapiens; identical to SEQ ID NO: 135184
  misc_feature: GYAE6OF02HPR0K.49.11.A11.1.454.CMB.1.raw
  modified_base (252)..(265): a, c, t, g, unknown or other
  misc_feature (252)..(265): n is a, c, g, or t

SEQ ID NO: 135815 - DNA, 929 bp, Homo sapiens
  misc_feature: GYAE6OF02I3ZUO.49.11.A11.1.454.CMB.1.raw
tcagagtcgagagacacgaccggtgctcgatttagctacgactgcaggggggggcctaaggaagcagcactggtggtgcctcagccatggcctggaccgttctcctcctcggcctcctctctcactgcacagctctgtgacctctatgtgctgactcagccaccctcggtgtcaggtcggcccctggaccagacggccaggtacttaccgtgggtagggggaaacactagtttagggaaagttaacgactggtgaccacgttcggtaccagcaagaagccgaggccacggtcccctgtcgcgttgggtcgtctagtgggtacgagtgggccggtacccggcccgttcgaacggggtaccttcccggtagacggtaccgtatttccgttcggttacgggccttaccccgtaaaacgtttcccggggtaacccggggggaaacccccggtccccctaaccccgttcggtaaacccacgtttacccgtaacccggggggaccccgggggttacggaaaaaccgggggtaacccggggtaggtttaaccggggacccgggtacccggttaaaccgtttaaaccggtttaaccggttacggtacccgggttaggggttacggggttacgggggtaagttttaagggggttacggggtttacgggttacggggtttcgggtttacccgggttcccggttttacgggggtacggtcccggggttcgggggtaaccccggggttacgggggttaccccgttaacccgggttccccgggttaacgggtaccggtaacccgggtaccccgggtaaccggacccccgtaaaccccgtaccgtttacccggtaccgtttaccggttcccgttacccggttttacccccaccccgtttacccgttccttaccgtttacccgttcccggaaccgtttcccggg

SEQ ID NO: 135816 - DNA, 877 bp, Homo sapiens
  misc_feature: GYAE6OF02GU5XY.49.11.A11.1.454.CMB.1.raw
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcacgccacccgtcggtgtcagtcggcccctggacaggacggccgaggtacttaccgtgggtacgggggaaaacacgtagtttagggaaagtaacggtacgtaggtcgacctaacgttcgggtaaccaggaccgaaaggaaacggcccgaacgggcccaacgggcccccttggtcgtcgtcgggttcgttctaggtcgggtggtagtccgggccggaccccggtcccgtaggacgggtaccttcccgtaggacggtacgtacgtttcctcgtcggaccctaccgtaaccgtccgggtaccggggaacccccgtaccctacccgtacgaaccgtacgtaccggaccgggtacccggggtaacgggaaacgggtacgggggtaactacgggaaccgggtaccctaacgttaacgttaacgttcgttacggtacggtaggggttagggtacgggtaagttaacggttacgggtttaggtccgggttaccgtttccgggggtttccgggggttacgggttccggggggaaccggtaccggggtaaccgttagggtttaaccgggtaccgggtttcggttaccgggacgtaacccgtcccggaacgggttcccgtacccgggtcccccggtttacggttaccccgttaccgttacccgtttaccccgtttcccccgtaacccctttcccgttaccccgttccggtttccccgttaccgttacccgg

SEQ ID NO: 135817 - DNA, 549 bp, Homo sapiens
  misc_feature: GYAE6OF02FOTKD.49.11.A11.1.454.CMB.1.raw
tcagagtcgagagacacgaccggtgctcgatttagctacgactgcaggggggggcctaaggaagcagcactggtggtgcctcagccatggcctggaccgttctcctcctcggcctcctctctcactgcacagactctgtgacctcctatgtgctgactcagccaccctcggtgtcagtggcccctggacagacggccaggattacctgtgggggaaacacattggaagtaagactgtgcactgggtaccagcagaagccaggccaggcccctgtgctggtcgtctatggtgatggcgaccggccctcagggactccctgagcgattctctggctccaactctcgggaacccgccaccctgaccatcagccgggtcgaagacgggatgaggccgactattactgtcaggtgtgggataggtggtagtggtcgttcgtcgtttcgggagtcgtgggacctagggtccaccggtcctaggtcagcccgaaggccccaaacccacgtcgtaccacgtcctcgttccccacccttcctcctcctctccgatccg

SEQ ID NO: 135818 - DNA, 789 bp, Homo sapiens
  misc_feature: GYAE6OF02INKLY.49.11.A11.1.454.CMB.1.raw
tcagagtcgagagacacgaccggtgctcgatttagctacgactgcaggggggggcctaaggaagcagcactggtggtgcctcagccatggcctggaccgttctcctcctcggcctccctctctcactgcacagactctgtgacctcctatgtgctgactcagccacctcggtgtcagtggccctggacagacggccaggattacctggtagggggaaacgacagttaggaagtaagactgtgcactggtaccagcagaagccaggccaggcccctgtgctggtctctagtggtgagtgggcgacccggtcctcgacggggactcccgtgagcgtattctcgtcggctccaactcgtacgggacccggccacctcgaccgatcgacggccgggtacgaacgggaacggggtatacggacgggacccgtaacgttaacgtttaacgtcggtacggtagggttaggtacggggtaagttaggttaggggttaacggtttggggttcgttaccgggtttccgttttaccggggacggttaccgggttacgggggtaacccggtaacgggggttacccgttaacccgggttccccgtttaaaggggtccccgtaaacccgggtaccccccgtaaaaaccggggtacccccaaaaccccccggtaccggttccggttaaccccgttaacccggttaccccgttttacccggttttaccccccctaaccggtttttaccccccttcccccgttttcccgttacccccgtttttacccgtaccccggtttaaccccg

SEQ ID NO: 135819 - DNA, 258 bp, Homo sapiens
  misc_feature: GYAE6OF02HPJZ9.49.11.A11.1.454.CMB.1.raw
  modified_base (252)..(258): a, c, t, g, unknown or other
  misc_feature (252)..(258): n is a, c, g, or t
tcagagtcgagagacacgaccggtgctcgatttagctacgactgcggggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttccccaccctcctctctctcgactctgagcggctggcaaggcgcatagnnnnnnn

SEQ ID NO: 135820 - DNA, 725 bp, Homo sapiens
  misc_feature: GYAE6OF02JU110.49.11.A11.1.454.CMB.1.raw
  modified_base (175)..(175): a, c, t, g, unknown or other
  misc_feature (175)..(175): n is a, c, g, or t
  modified_base (211)..(211): a, c, t, g, unknown or other
  misc_feature (211)..(211): n is a, c, g, or t
tcagagtcgagagacacgaccggtgctcgatttagctacgactgcagggggggcctaaggaagcagcactggtggtgcctcagccatggcctggaccgttctcctcctcggcctcctctctcactgcacagactctgtcgacctcctatgtgctagactcagcccacccgtggtntcagtcggcccctggacagcggccaggtattaccgngggtacggggaaacactgttagggaaagtaagactggtcgacctacgtacgggtaaccaggacaagaacgccgaaggccacggcccctagtgctgggtccgtctagtggtagagtcgggccggacccggtcctacggagggtaccttcccgtaggacgcgttattccgtcgtcggtcctaccgaacgtcggtaccgggaaccccgcctacccgtagaacctacgtccgacggggtcccgggtacgaaacgggacggggtatacgggacggaccgtacgttacgttacgtcgtacggtacggtggtacggtacgttggtacgggttaggtcgggttcgttaccggttcggttacgggtcggtccggtacgggtacccggtagggttcccgtaacccggtcgtacggtaccaccggacccgaacggccccaaacccgtggttcccggtactaccgttcccgttacccggttcccctaccccgttccttccggttcctccggttacgtcccgtccgg

SEQ ID NO: 135821 - DNA, 255 bp, Homo sapiens
  misc_feature: GYAE6OF02GJ5UA.49.11.A11.1.454.CMB.1.raw
  modified_base (251)..(255): a, c, t, g, unknown or other
  misc_feature (251)..(255): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccatgtcactctgttcccgccctcctctctctcgactctgagcgggctggcaaggcgcatagnnnnn

SEQ ID NO: 135822 - DNA, 261 bp, Homo sapiens
  misc_feature: GYAE6OF02GDCK5.49.11.A11.1.454.CMB.1.raw
  modified_base (251)..(261): a, c, t, g, unknown or other
  misc_feature (251)..(261): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccgcctcctctctctcgactctgagcgggctggcaaggcgcatagnnnnnnnnnnn

SEQ ID NO: 135823 - DNA, 173 bp, Homo sapiens
  misc_feature: GYAE6OF02G9HT5.49.11.A11.1.454.CMB.1.raw
  modified_base (161)..(173): a, c, t, g, unknown or other
  misc_feature (161)..(173): n is a, c, g, or t
tcagagtcgagagacacgaccggtgctcgatttagctacgactgcagggagcttactgactaggccggccttaattaaggtcagcctaaggctgcccccagcgtcactctgttcccaccctcctctctctcgactctgagcgggctggcaaggcgcatagnnnnnnnnnnnnn

SEQ ID NO: 135824 - DNA, 267 bp, Homo sapiens
  misc_feature: GYAE6OF02I4S0F.49.11.A11.1.454.CMB.1.raw
  modified_base (251)..(267): a, c, t, g, unknown or other
  misc_feature (251)..(267): n is a, c, g, or t
tcagagtcgagagacacgaccggtgctcgatttagctacgactgcagggaacccggccaccctgaccatcagccggtcgaagacggggatgaggccgactattactgtcaggtgtgggatagtggtagtggtgtcgtcttcggagctgggaccagggtcaccgtctaggtcagcccaaggccaaccccactgtcactctcgttcccacctcctctctctcgactctgacgcgggctggcaaggcgcatagnnnnnnnnnnnnnnnnn

SEQ ID NO: 135825 - DNA, 625 bp, Homo sapiens
  misc_feature: GYAE6OF02F1ERN.49.11.A11.1.454.CMB.1.raw
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagcccacctcggtgtcagtggcccctggacagacggccaggattacctggtagggggaaacacagttggaaagtaagactgtgcactggtaccagcagaagccaggccaggcccctgtcgctggtcgtctagtggtgagtggccgaccggccctcgagggactcccgtgacgcgtattcgtcgtcggcctaccgaacgtccgtacgggaaccccgcctacccgtcgaccactcgacggtccgggtacgaacgggacgggagtcggacggccgtaacttacgttacgtgtcgagggttcgtgggagttggttggtaggttggtgttcgttcgttcgggagtcggtaggggaccgtaggggtcctaccggtcgtacggtcaccggacccaacggacccctaacccgacgtcggtaccaccgttccgttcccggtaccccgtcccttcctcttccctcgtcctcgtccgg

SEQ ID NO: 135826 - DNA, 782 bp, Homo sapiens
  misc_feature: GYAE6OF02H6EST.49.11.A11.1.454.CMB.1.raw
  modified_base (433)..(433): a, c, t, g, unknown or other
  misc_feature (433)..(433): n is a, c, g, or t
tcagagtcgagagacacgaccggtgctcgatttagctacgactgcaggggggggcctaaggaagcagcactggtggtgcctcagccatggcctggaccgttctcctcctcggcctcctctctcactgcacagactctgtgacctcatatgtgctgactcagcccaccctcggtgtccaggtcggcccctgggacaggacggccagggacttaaccgtgggtacgggggaaacacgtagttggaagtaagactggtgctacgtggtaccagccaaggaacgccgacggccacggcccctggtgctggtcgttctatcgggtgagtcggccgaccgcctacggagggtactcccgtaggacgtcgtattcctcgtacggccttaacccgaacgttccgtacggggaaccccgcccaacccgttagaaccccgtanaccggaccgggtacccggggacgaaacgggtcggggaacgtggggaaccgggtaccgttacgttaacttacgtcgtacggtacgggtgggttagggtaacgttggttagggtaggtttacgggttcgtccggtttacgggttcggaacgggtcgggttaccggggacccggttacggggtacccgtaacccggtttaccggtaggtaacccgtaccggaaccccggtaaccggtaccccctaacccggtcgtttaacccggtaccgtaacccgtttcccgttacccccggttccccggtacccctttcccgttaccccgtttccttaccccggttacccgttaccccgg

SEQ ID NO: 135827 - DNA, 305 bp, Homo sapiens
  misc_feature: GYAE6OF02F3N9R.49.11.A11.1.454.CMB.1.raw
  modified_base (253)..(253): a, c, t, g, unknown or other
  misc_feature (253)..(253): n is a, c, g, or t
  modified_base (255)..(305): a, c, t, g, unknown or other
  misc_feature (255)..(305): n is a, c, g, or t
tcagagtcgagagacacgaccggtgctcgatttagctacgactgcaggggaacccgggccaccctgaccatcagccgggtcgaagacgggggatgaggccgactattactgtcaggtgtgggatagtggtagtggtgtcgtcgttcggagctgggaccagggtctaccgtctaggtcagcccaaggccaaccccatgtcgactctcgttcccaccctctctcttcgactctgagcggctggcaggcgcatagncnnnnnnnnnnnnnnnnnnnnnnnnnnnnnnnnnnnnnnnnnnnnnnnnnnn

SEQ ID NO: 135828 - DNA, 849 bp, Homo sapiens
  misc_feature: GYAE6OF02HU1Q8.49.11.A11.1.454.CMB.1.raw
tcagagtcgagagacacgaccggtgctcgatttagctacgactgcaggggggcctaaggaagcagcactggtggtgcctcagccatggcctggaccgttctcctcctcggcctcctctctcactgcactagactctgtcgaccttcctatgtgctgactcagcccacctcggtgtcagtcgcccctggacacgaccggccagggatttaccgtggtcgggggaaacgacactttgggaagttaagacttggtgacactgggtaccaggcaggaaacgccgaaggcccacgggtcccccgtaggttgccgttagggtccggttacttaagttgggtacgtagttcggggacccgtacccgggcccttcggacgggactccccgttgacggccgtattcgtcgtcggccttaccaaccgttcgtaccgggggaaacccccggccgaaccccttaggaaccctaacgttaccgaacgggtacccgggggttacgaaaacgggtacccgggggggtattacgggaaccggggcccgttaaacgtttaacgtttaaccgtggtttaaccggacggggttagggtacgggggtaaatttaggggttaggggtttaagttcgggggtttgtccgggttaccgtttaccggggattccgggttagggggaacccgtacgggggttcccaacccgggtttcccgttaagggttcccaaacggggccccctaaacgggtacccccgaacccccgtaacggtttcccgggtaacccttaccggttcccgttttaacccggttcccctaccccgtttacccgttccttaccccgttaccgttaccggtacccttacccggg

SEQ ID NO: 135829 - DNA, 643 bp, Homo sapiens
  misc_feature: GYAE6OF02I9J8T.49.11.A11.1.454.CMB.1.raw
  modified_base (375)..(375): a, c, t, g, unknown or other
  misc_feature (375)..(375): n is a, c, g, or t
  modified_base (523)..(523): a, c, t, g, unknown or other
  misc_feature (523)..(523): n is a, c, g, or t
tcagagtcgagagacacgaccggtgctcgatttagctacgactgcagggggggcctaaggaagcagcactggtggtgcctcagccatggcctggaccgttctcctcctcggcctcccctctcactgcacagactctgtgacctcctactgtgctgactcacgccaccctccggtgtcagtcggccccgtcggacgacgacggaccgacggaagttacctcggtgggggaaacggaacagttaggtaaggtaaagacgtgtgcgactcggtaccgacgcgagaagccaggccacggcccctgtgctggtcgtctatgggtgagtcgggccggacccggtcccctcgagggacttcccctggaagtcgatttctcgnggcctacccaagttccgcggggaaccccgccaccctggaaccatcgacggcccggggtacgaaagggtaccggggatggacggacccgaacttagttacgtgtcgtagggtggtgggagtaggtggtagtggttggtcgtcgttcggnggtcgtcgggaccgcgggtcctaccgtcgtagtccgacgacccgaacgcccacccacgtccgtccaccttccgttccgtacccctacccttccgttcctccgtcctccgtacctcgtcgg

SEQ ID NO: 135830 - DNA, 661 bp, Homo sapiens
  misc_feature: GYAE6OF02GHT0R.49.11.A11.1.454.CMB.1.raw
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagccaccctcggtgtcagtcggcccctggacagacggccaggtacttaccgtgggtacgggggaaaaccgactagtttagggaaagtaaagacttgtcgcacgtgggtaaccagcagaacgccgaggccacggcccctgtgctggtctctagtggtgagtcgggccggacccggccctacggacgggtactccccgtagacgcgtacttctcgtcggctaccaactccgtaccgggaccccgcctacccgtcgacctacgtccgacggtccgggtacgaacgggacgggtatacggacggacccgtagttacgtacgtcggtacggtagggtcggtagggtattagggttggtaggttggtcgtcgtcgttggacgtggcgggtaccgtgggtcccgtaccgtacgtacggtcaccggtacccgaacggacccaaccccgtagtccgttaccaccttccgttcccgtccccgtcccttcctcccttctccgtccgaccttcgg

SEQ ID NO: 135831 - DNA, 267 bp, Homo sapiens
  misc_feature: GYAE6OF02GL28L.49.11.A11.1.454.CMB.1.raw
  modified_base (252)..(267): a, c, t, g, unknown or other
  misc_feature (252)..(267): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccaccctcctctctctcgactctgagcgggctggcaaggcgcatagnnnnnnnnnnnnnnnn

SEQ ID NO: 135832 - DNA, 256 bp, Homo sapiens; identical to SEQ ID NO: 134784
  misc_feature: GYAE6OF02GC4ZO.49.11.A11.1.454.CMB.1.raw
  modified_base (252)..(256): a, c, t, g, unknown or other
  misc_feature (252)..(256): n is a, c, g, or t

SEQ ID NO: 135833 - DNA, 271 bp, Homo sapiens
  misc_feature: GYAE6OF02HR8KV.49.11.A11.1.454.CMB.1.raw
  modified_base (255)..(271): a, c, t, g, unknown or other
  misc_feature (255)..(271): n is a, c, g, or t
tcagagtcgagagacacgaccggtgctcgatttagctacgactgcagggaacccggccaccctgaccatcagccgggtcgaagacgggatgaggccgactattactgtcaggtgtgggatagtggtagtggtgtcgtcttcggagctgggaccagggtcaccgtcctaggtcagcccaaaggcccaaccccactgtcactctgttccccaccctcctctctctcgactctgagcgggctggacaaggcgcatagnnnnnnnnnnnnnnnnn

SEQ ID NO: 135834 - DNA, 685 bp, Homo sapiens
  misc_feature: GYAE6OF02GJ012.49.11.A11.1.454.CMB.1.raw
  modified_base (229)..(229): a, c, t, g, unknown or other
  misc_feature (229)..(229): n is a, c, g, or t
  modified_base (244)..(244): a, c, t, g, unknown or other
  misc_feature (244)..(244): n is a, c, g, or t
tcagagtcgagagacacgaccggtgctcgatttagctacgactgcagggggggtccttaacggagcagccactggtggtgcctcaggcctatggtcctggaccgttctcctctcggcctccgtctctcgactgcctacacgactcctggtcgtaccttccgtactaggtgctgactcagccacctggtcgtcgagtcgcccgtggacgacgacgccgaggtattaccgnggtacgggggaaacnctagttaggaaagtaacgactggtgactacgttcggtacagtctaagtacaccaggtcacggccctggcgtcgtggtccgtctagtcggtagacggtaggaccgaccggtccgtacggacggggtacttcccggagtacggtacttactttcgtacgtcgggtaccctacctaaacgttcggtaaccgggaccccggactaccgtacgtaacctacgtccgacggtccggaacggaacgggacggactacgaacggtccaacgttacgtacgtacgtacgtaggttcgaggactacggtaggtacgtcggtcgtcgtcgtacgcggtcgtacgggtaccgtcggtaccgacgttcggtacgtcacgtaccgacgacccgccgaacgttcgactacgtccgtacggttccgcctccgtcgtaccgtcgttacgtcgtaccgg

SEQ ID NO: 135835 - DNA, 260 bp, Homo sapiens
  misc_feature: GYAE6OF02H1RW0.49.11.A11.1.454.CMB.1.raw
  modified_base (252)..(260): a, c, t, g, unknown or other
  misc_feature (252)..(260): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccatgtcactctgttccccaccctcctctctctcgactctgagcgggctggcaaggcgcatagnnnnnnnnn

SEQ ID NO: 135836 - DNA, 669 bp, Homo sapiens
  misc_feature: GYAE6OF02HMEZM.49.11.A11.1.454.CMB.1.raw
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagccaccctcggtgtcagtcggcccctggacagacggccaggtattaccgtggtagggggaaaacacagttagggaaagttaagactgtgacacgtggtaccagcagaagccaggccaggcccctgtgctggtcgtctagtggtgagtggccgaccggccctcgacgggactcccgtgacgcgtattccgtcgtggcctaccaacgtcgtacgggaacccgccacccgtgaccatccgacggccgggtacggaacgggaccggggatcgggacggccgtaacttacgttacgtgtcgtagggttggtacgggtatacggtagtacgtaaccggtaccgtagtttggggtcgttcgggcgggtaacgggaccgtaagggtccggtaccgttaccgtagggtaccacgggacccaagggtccctccggtcccccgttcgggtaccctaccgttccgttcccgttacccctacccctcccgttcccgttcccttaccgtcccggtacttcccgg

SEQ ID NO: 135837 - DNA, 257 bp, Homo sapiens
  misc_feature: GYAE6OF02I4210.49.11.A11.1.454.CMB.1.raw
  modified_base (244)..(244): a, c, t, g, unknown or other
  misc_feature (244)..(244): n is a, c, g, or t
  modified_base (250)..(257): a, c, t, g, unknown or other
  misc_feature (250)..(257): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggcccaaccccatgtcactctgttcccacctcctctctctcgactctgagcggctggcaaggcncatagnnnnnnnn

SEQ ID NO: 135838 - DNA, 259 bp, Homo sapiens
  misc_feature: GYAE6OF02GD1BX.49.11.A11.1.454.CMB.1.raw
  modified_base (251)..(259): a, c, t, g, unknown or other
  misc_feature (251)..(259): n is a, c, g, or t
tcagagtcgagagacacgaccggtgctcgatttagctacgactgcggggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccgcctcctctctctcgactctgagcgggctggcaaggcgcatagnnnnnnnnn

SEQ ID NO: 135839 - DNA, 795 bp, Homo sapiens
  misc_feature: GYAE6OF02JVILJ.49.11.A11.1.454.CMB.1.raw
  modified_base (741)..(741): a, c, t, g, unknown or other
  misc_feature (741)..(741): n is a, c, g, or t
tcagagtcgagagacacgaccggtgctcgatttagctacgactgcaggggggccgtaaggaagcagcactggtggtgcctcagccatggcctggaccgttcgtcctcctcggcctcctctctcactgcacagactctgtgacctcctatgtgctgactcagccaccctcggtgtcagtcggcccctggacagaccggccagggacttaccgtggtagggggaaacgacagtttagggaaacgttaagactggtgactacgttcggtaccagcaaggaacgcgacggccacggcccctggtcgcgttggtcgtctagttcgggtagagtcgggtccggacccggtcccgtacggaacgggtcctcccgttgggacggcgttaacttccgtacgttcgggccttacctaaccgtccggttaccggggaaccccggtacccctacccgtaccggaacctacgtaccccggaacgggtcccggggttaacccgggaaacgggtacccgggggtaagtccgggtaaccggggtacccgtaacggtttaaccgtttaacccggttcggttaaccggtaacggggttgggttaacggggtaacgttaagggtttcggggttaaggttgggttacggttcgtttcgggttacgggacgggtccggtagggttacccggacgggttaccggtacccgttcgtagggtacccacggacccgtaccgacccgaacccgtaggtcgtaacccnctttccgtcccgttccccacccgttcctaccgttcctacccgtcgaccttccgg

SEQ ID NO: 135840 - DNA, 723 bp, Homo sapiens
  misc_feature: GYAE6OF02FHYBJ.49.11.A11.1.454.CMB.1.raw
  modified_base (227)..(227): a, c, t, g, unknown or other
  misc_feature (227)..(227): n is a, c, g, or t
tcagagtcgagagacacgaccggtgctcgatttagctacgactgcagggggggcctaaggaagcaggcactggtggtgcctcagccatggcctggaccgttctcctcctcggcctcctctctcactgcacagactctgtgacctcctatgtgctgactcagcccaccctcggtgtcagtggcccctggaccagaccggccaggacttaccgtggtagggggaaaccncagttggaagtaagactgtgacactggtaccagcagaagccaggccaggcccctgcgctggtcgtctatggtagatggccgaccggcctcgagggactcccgtaggagccgtatttcctcgtcgggtcctacccgaaaccgttccggtaccgggggtaaaccccccgccctaacccccgttcggaacccctaagttcccgaacggggtccccggggttaacggaaaaccggggaccgggggaacgttacggacgggtaccccggtacttaaccgtttaccgtacgtaccgagggttacggtacgggaactaggttaagtacgtggtactcgagtttggtgggttacggttacggggacgggtacggaaccgagtcctacgacccgttacgtacggtaccaccggcccgaagggtccctaccgggccccccgttcgggtacctaccgttccgttcccgttcccccggtaccccttccccttaccttccgttaccccg

SEQ ID NO: 135841 - DNA, 263 bp, Homo sapiens
  misc_feature: GYAE6OF02JF9UF.49.11.A11.1.454.CMB.1.raw
  modified_base (252)..(263): a, c, t, g, unknown or other
  misc_feature (252)..(263): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccaccctcctctctctcgactctgagcgggctggcaaggcgcatagnnnnnnnnnnnn

SEQ ID NO: 135842 - DNA, 743 bp, Homo sapiens
  misc_feature: GYAE6OF02JIRDO.49.11.A11.1.454.CMB.1.raw
  modified_base (710)..(710): a, c, t, g, unknown or other
  misc_feature (710)..(710): n is a, c, g, or t
  modified_base (718)..(718): a, c, t, g, unknown or other
  misc_feature (718)..(718): n is a, c, g, or t
tcagagtcgagagacacgaccggtgctcgatttagctacgactgcagggggggcctaaggaagcagcactggtggtgcctcagccatggcctggaccgttctcctcctcggcctcctctctcactgcacagactctgtagaccctcctatgtgctgactcagccaccctggtgtcaggtcggcccctggacagacggccaggtattaccgtgggtacgggggaaacactagttagggaaagtaaggactggtgacaacgtcggtaaccagacaaggaacgccgaacggccacgggtcccctggtcgcgtcggtcgtctagtggtagagtcggaccggtacccggcccgtacggacgggtacctcccgtaggacggtcgtacttccgtcgtcggccgtacccgaacgtccggtacgggaccccgaccctacccgtacgacccgtactccgacgggtacccggggtacggaaacgggaccggggacgtacgggaccgggtacccgtaacgtttaacgttaccgttgggtaccgtaggggttggttacgggtaagttagggtagggtacgggtttgggtcggttccggttacggtttccgggaggtcggtacggggaaccgtcggggttccacccggttcgtaacgggtcaaccggtacccggaacgcccctaaaccgtcgtacgtacctaccggttcctacccgttaccccncccttacnccgttacctccgtacctagttcccg

SEQ ID NO: 135843 - DNA, 710 bp, Homo sapiens
  misc_feature: GYAE6OF02F10HB.49.11.A11.1.454.CMB.1.raw
tcagagtcgagagacacgaccggtgctcgatttagctacgactgcaggggggggcctaaggaagcagcactggtggtgcctcagccatggcctggaccgttctcctcctcggcctcctctctcactgcacagactctgtgacctcctatgtgctgactcagccaccctcggtgtcaggtcggcccctggacagaccggccaggtacttaccgtgggtacgggggaaaccactagttagggaaaggtaagacttatgacctacgtcgggtaaccagcaagaacgccaggcccaggcccctggtcgctggtcgtctagtggtgagtcggcgacccgcccgtgacgggtactcccgtaggacgccgtatttccacgttcgggccttacccgtaactccggtaaccggggaaccccgccctaacccgtgaccctactccgacggggtacccgggacgaacggggaccggggatacgggaaccggcccgtaacgttactttaacggtgtacggtagggttcggtaggggtacttagggttggtgttaggtcgttacgttcgttcgggagcgttcggggaccgtagggtccgaccgttccgtagccgacgacccgacggtaccccaacccgtcgttccggtactacccgtttcccgtaccgtttaccccaccccgtttccttacccgttcccttcccgtacggtacctttaccggg

SEQ ID NO: 135844 - DNA, 602 bp, Homo sapiens
  misc_feature: GYAE6OF02IUJ7E.49.11.A11.1.454.CMB.1.raw
  modified_base (311)..(311): a, c, t, g, unknown or other
  misc_feature (311)..(311): n is a, c, g, or t
  modified_base (314)..(314): a, c, t, g, unknown or other
  misc_feature (314)..(314): n is a, c, g, or t
  modified_base (335)..(335): a, c, t, g, unknown or other
  misc_feature (335)..(335): n is a, c, g, or t
  modified_base (340)..(340): a, c, t, g, unknown or other
  misc_feature (340)..(340): n is a, c, g, or t
  modified_base (371)..(371): a, c, t, g, unknown or other
  misc_feature (371)..(371): n is a, c, g, or t
  modified_base (376)..(376): a, c, t, g, unknown or other
  misc_feature (376)..(376): n is a, c, g, or t
  modified_base (379)..(379): a, c, t, g, unknown or other
  misc_feature (379)..(379): n is a, c, g, or t
  modified_base (382)..(382): a, c, t, g, unknown or other
  misc_feature (382)..(382): n is a, c, g, or t
  modified_base (387)..(387): a, c, t, g, unknown or other
  misc_feature (387)..(387): n is a, c, g, or t
  modified_base (392)..(392): a, c, t, g, unknown or other
  misc_feature (392)..(392): n is a, c, g, or t
  modified_base (397)..(397): a, c, t, g, unknown or other
  misc_feature (397)..(397): n is a, c, g, or t
  modified_base (404)..(404): a, c, t, g, unknown or other
  misc_feature (404)..(404): n is a, c, g, or t
  modified_base (409)..(409): a, c, t, g, unknown or other
  misc_feature (409)..(409): n is a, c, g, or t
  modified_base (411)..(411): a, c, t, g, unknown or other
  misc_feature (411)..(411): n is a, c, g, or t
  modified_base (413)..(413): a, c, t, g, unknown or other
  misc_feature (413)..(413): n is a, c, g, or t
  modified_base (419)..(419): a, c, t, g, unknown or other
  misc_feature (419)..(419): n is a, c, g, or t
tcagagtcgagagacacgaccggtgctcgatttagctacgactgctagggaacccggccaccctggaccatcaagccgggtcgaagacggggatgaggccgacctattactggtcaggtggtgggatagtcggtagtggtgtcgtcttcggagctgggaccagggtcaccgtcctaggtcagcccaaggccaaccccattgtccaccttcgtcgttcccgcccctccgttcgtacgtctccggacttccgtagacggccgggtacttcgggaccctaaagggccgtacgaacgtaagcactagtatatgtntanacagtgcgagagtcagcgtanaccgngtcaatcaggctagactggtcagaaccgctngtcgngtnagncgtangacgngtacnctagtcnctacncncncactanatacgatacgacgtacgtacgtagacgtacgtactactactagtacgacgtacgtactacgtacgtacgtacgtacgtacgtacgtactacgtacgtaacgtacgtacgtacgtacgtacgtacgacgtacgtactacgtacgtacgtacgtacgtacgcgtacctacgtacgtactacgtcg

SEQ ID NO: 135845 - DNA, 266 bp, Homo sapiens
  misc_feature: GYAE6OF02GOU8I.49.11.A11.1.454.CMB.1.raw
  modified_base (246)..(246): a, c, t, g, unknown or other
  misc_feature (246)..(246): n is a, c, g, or t
  modified_base (252)..(266): a, c, t, g, unknown or other
  misc_feature (252)..(266): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggcccaaccccactgtcactctgttcccaccctcctctctctcgactctgagcggctggcaaggcncatagnnnnnnnnnnnnnnn

SEQ ID NO: 135846 - DNA, 630 bp, Homo sapiens
  misc_feature: GYAE6OF02FSWPX.49.11.A11.1.454.CMB.1.raw
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagccaccctcggtgtcagtggcccctggacagacggccaggattacctggtgggggaaacgacattggaagtaagactgtgcactggtaccagcagaagccaggccaggcccctgtcgcgtggtcgtctatggtgagtcggcgaccggccctcgagggactcccgtgacgcgtattccgtctggcctccaactcgtacgggacccgccacccgtcgaccactccgacggtcccgggtacgaacgggacgggatggacggaccgtataacttacgtgtcgagggtcggtgggagttaggttggtaggtggttgttcgtcgttcggagtcggtacggggacccgtaggggtcctacccggttcgtacgggtccgacgcccgaacggtaccccaaccccgtcgttcggtcctaaccgttccgttaccgttcccccgtacccgttcccttcctccctccgttcccgtaccttccgg

SEQ ID NO: 135847 - DNA, 270 bp, Homo sapiens
  misc_feature: GYAE6OF02H60AO.49.11.A11.1.454.CMB.1.raw
  modified_base (253)..(270): a, c, t, g, unknown or other
  misc_feature (253)..(270): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggcccaaaccccactgtcactctcgttcccacctcctctctctcgactctgagcggctggacaggcgcatagnnnnnnnnnnnnnnnnnn

SEQ ID NO: 135848 - DNA, 265 bp, Homo sapiens
  misc_feature: GYAE6OF02HKG0I.49.11.A11.1.454.CMB.1.raw
  modified_base (253)..(265): a, c, t, g, unknown or other
  misc_feature (253)..(265): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaaggccaaccccactgtcactctgttcccgccctcctctctctcgactctgagcgggctggcaaggcgcatagnnnnnnnnnnnnn

SEQ ID NO: 135849 - DNA, 274 bp, Homo sapiens
  misc_feature: GYAE6OF02GMV0H.49.11.A11.1.454.CMB.1.raw
  modified_base (250)..(274): a, c, t, g, unknown or other
  misc_feature (250)..(274): n is a, c, g, or t
tcagagtcgagagacacgaccggtgctcgatttagctacgactgcagggaacccggccaccctgaccattcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccacctctctctctcgactctgagcgggctggcaggcgcatagnnnnnnnnnnnnnnnnnnnnnnnnn

SEQ ID NO: 135850 - DNA, 782 bp, Homo sapiens
  misc_feature: GYAE6OF02J0RK5.49.11.A11.1.454.CMB.1.raw
  modified_base (295)..(295): a, c, t, g, unknown or other
  misc_feature (295)..(295): n is a, c, g, or t
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcacgccaccctcggtgtcaggtcggcccctggacagaccggccaaggatttaccgtgggtagggggaaacactagttaggaaagtaagtactggtgcacgtcggtaaccagcaagaacgccgaggccacggcccctgngcgtcggtcgtctagtggtgagtcggcgacccggccgtacgagggacctcccgtggacgacgtacttcgtcgtcggtcctaccaacgttcgtaccgggaaccccgtccacccgtcgaccacgtcgacggtaccgggtacgaacgggtacgggatcgggaacggtccgtaacgttaacttacggtggtaccgtagggttggtacggggtataacgggtttaggttacgggttgggtttcggttcccgggtttccggttcggggaacgttccgggggttaacggggtaaccccgtagggggtttacccgaaccccgggttttccgtaaccggggttaccggaacccgtaacccggaaaccgggtacccccgtaaaccccgtaacggttcccggtacccgttaaccgtttccccggttcccgtttacccccgttaccccggttaccctttcccgtaccgtttcccggttaaccgtcccgtttaacccggg

SEQ ID NO: 135851 - DNA, 263 bp, Homo sapiens; identical to SEQ ID NO: 134865
  misc_feature: GYAE6OF02I8ODO.49.11.A11.1.454.CMB.1.raw
  modified_base (252)..(263): a, c, t, g, unknown or other
  misc_feature (252)..(263): n is a, c, g, or t

SEQ ID NO: 135852 - DNA, 255 bp, Homo sapiens
  misc_feature: GYAE6OF02GW0B8.49.11.A11.1.454.CMB.1.raw
  modified_base (246)..(255): a, c, t, g, unknown or other
  misc_feature (246)..(255): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccatgtcactctgttcccacctctctcttcgactctgagcggctggcaggcgcatagnnnnnnnnnn

SEQ ID NO: 135853 - DNA, 255 bp, Homo sapiens
  misc_feature: GYAE6OF02G5QG4.49.11.A11.1.454.CMB.1.raw
  modified_base (249)..(255): a, c, t, g, unknown or other
  misc_feature (249)..(255): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaacccactgtcactctgttcccgcctcctctctctcgactctgagcggctggcaaggcgcatagnnnnnnn

SEQ ID NO: 135854 - DNA, 257 bp, Homo sapiens; identical to SEQ ID NO: 134898
  misc_feature: GYAE6OF02IIS0V.49.11.A11.1.454.CMB.1.raw
  modified_base (252)..(257): a, c, t, g, unknown or other
  misc_feature (252)..(257): n is a, c, g, or t

SEQ ID NO: 135855 - DNA, 630 bp, Homo sapiens
  misc_feature: GYAE6OF02GCTJK.49.11.A11.1.454.CMB.1.raw
  modified_base (210)..(210): a, c, t, g, unknown or other
  misc_feature (210)..(210): n is a, c, g, or t
  modified_base (233)..(233): a, c, t, g, unknown or other
  misc_feature (233)..(233): n is a, c, g, or t
  modified_base (245)..(245): a, c, t, g, unknown or other
  misc_feature (245)..(245): n is a, c, g, or t
  modified_base (506)..(506): a, c, t, g, unknown or other
  misc_feature (506)..(506): n is a, c, g, or t
  modified_base (556)..(556): a, c, t, g, unknown or other
  misc_feature (556)..(556): n is a, c, g, or t
tcagagtcgagagacacgaccggtgctcgatttagctacgactgcaggggggggcctaaggaagcagcactggtggtgcctcagccatggcctggaccgttctcctcctcggcctcctctctcactgcacagactctgtgacctcctatgtgctgactcagccacctcggtgtcagtcggccctggacagacggccaggatcacctgctntggcatgctattcgaccaaaaanatatgacttacnggtaccagcagcggcacggcctacggcccgtgtcgttggtagtattttaagtaaaacgtacgttttggaacggtacggtaccctacgaacgggtacccctggacgcggtaattcgtcgtggccttaccagtccgtaacgacgggtaacaaacgtagtacctaaccgttacgaaccagttacgagggtacggacggtacccggacgtaggacgggacgaggtacgtacgtaacctaattacgtgtacgacgtaccgacgtanacgagtaccaggtcgactaagttacgtacgttacgtagtacgggtacggnggtacctacggtcgtacgaccgttacgtacgtccgaacgtccgacgtccgtccgtccccggtacgtcgtaaccg

SEQ ID NO: 135856 - DNA, 699 bp, Homo sapiens
  misc_feature: GYAE6OF02F0GHQ.49.11.A11.1.454.CMB.1.raw
  modified_base (171)..(171): a, c, t, g, unknown or other
  misc_feature (171)..(171): n is a, c, g, or t
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagccaccctggtntcagtgcccctggacagacgccaggattaccgtggtgggggaaacacattggaaagtaagactgtgcactggtaccagcagaagccaggccaggcccctgtgctggtcgtctagtggtagagtggccgacccggccctcgagggactcccgtgacgcgtacttcgtcgtcggcctaccaacgtcgtacgggaaccccgccaccccgtgaccacgtcgacggtcccgggtagaacgggacggggatcggaacggccgtaactaacgttcgtagtacgagggttggtacgggtagttagggttaggttaggttggttcggttacgttccggtttgggacgtcggtacggggtaccgtacggggtcctaacccggtccgttaacgggtaccaaccggtaaccccgaaacggggtaccccctaaaaccccgtcggttacccggttacccaccgtttcccgttaacccggtttacccccctaaccccgttccctttaccgttacccttcccggttacccgtaccgttcccggg

SEQ ID NO: 135857 - DNA, 706 bp, Homo sapiens
  misc_feature: GYAE6OF02IZ8H2.49.11.A11.1.454.CMB.1.raw
  modified_base (294)..(294): a, c, t, g, unknown or other
  misc_feature (294)..(294): n is a, c, g, or t
  modified_base (359)..(359): a, c, t, g, unknown or other
  misc_feature (359)..(359): n is a, c, g, or t
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctctatgtgctgactcagccaccctcggtgtcagtcggcccctaggacaggaccggccaagggattacccgtgggtagggggaaaaccacagttagggaaagtaagacgtgtcgacacgtggtaaccagcgaagagccaggccaggcccctgngctggtcgtctagtggtcgagtcggaccggaccgccctgacgggactccctaggacgcgtattcncgtggactccgtaacttcggaccgggaacccgcctaacccgtcgaccagtccgacgggccgggtacggaacgggacggggtcacgggacggaccgtaacgtacttacgtcggtcgagggttggtaggggaagttcgggttagggtaggttacgggttcggttaccggttcggtttaccgggaggtaccggttcggggaaccggtacggggttaccaacccgggtttcgtaacgggttaccgacgacccggtaacgaccccgtacccgtaacgttcggtcctaacccggttcttaccggttaccccacccgtttccgtaccttaccgtaccgttaccgtccgtaccgg

SEQ ID NO: 135858 - DNA, 727 bp, Homo sapiens
  misc_feature: GYAE6OF02GL25P.49.11.A11.1.454.CMB.1.raw
  modified_base (276)..(276): a, c, t, g, unknown or other
  misc_feature (276)..(276): n is a, c, g, or t
tcagagtcgagagacacgaccggtgctcgatttagctacgactgcagggggggcctaaggaagcagcactggtggtgcctccagccatggcctggaccgttctcctcctcggcctcctctctcactgcacagactctgtcgacctcctatgtgctgactcagccaccctcggtgtcaggttcggcccctggacacggacggccagggatttacccgtggtcgggggaaacgactattgggaaagttaacgactggtgcacgtggtaccagcagaanccagccaggcccctgtacgctgggtcgtcctattgggtgatcgggccgaccgggtccctacgaacggggtcctcccgtgacgccgtagttccttcgtggtacctaccgaaaccttcggtaccggggaacccccggccctaaccccgtacgacccgtaatccgtaacgggccgggttacgaaacgggacgggggtacacgggaacggcccggtaactaacgtttacgtaggttaccgaggggttacggtaggggaagttaggggttaggtgggttagggtcggttacgttcgttaccgggacgtcggtacgggtaccgtacgggttccctaccgttaccgttacggtccgacgtacccccgtaaggaccccgtaacccgacgtacgttacccaccgttccgttccgttacccccgcccttaccctccttacccgtcgttaccggtcctccgg

SEQ ID NO: 135859 - DNA, 718 bp, Homo sapiens
  misc_feature: GYAE6OF02I9XIM.49.11.A11.1.454.CMB.1.raw
tcagagtcgagagacacgaccggtgctcgatttagctacgactgcaggggggggcctaaggaagcagcactggtggtgcctcagccatggcctggaccgttctcctcctcggcctcctctctcactgcacagactctgtgacctcctatgtgctgactcagcccaccctcggtgtcaggtcggccccgtggacaggaccggccgaggtactttaccgtgggtacgggggaaacacgtagttagggaaagtaagactgtgactacgtggtaccagcgaagaacgccgaggcccacggccccctgtcgcgttgggtcgtctagtgggtgagtcggccggacccggcccgtacggacgggtctcccgtaggacggtcgtacttcgtcgtcggtcctacctaacgtccggtaccggggaacccccgtcccgtaccccgtacggaaccctacgtccgaccgggtacccggggtaacggaaacgggtaccggggtatacgggaaccggtacccgtaacgttacgttaccgtggttacggtagggttgggtacggtagttagggttggttaggttcggttcgtacgttcgtacgggcgtcggtacgggaccgtggtaccgtccgtacgtcggaccacggacccgtacggacccacccgtgtccgtacctacgttcccgttcccgtccccgtacccttccgtccttcctacgttccgtaccttcgg

SEQ ID NO: 135860 - DNA, 812 bp, Homo sapiens
  misc_feature: GYAE6OF02IKTJG.49.11.A11.1.454.CMB.1.raw
tcagagtcgagagacacgaccggtgctcgatttagctacgactgcaggggggggcctaaggaagcagcactggtggtgcctcagccatggcctggaccgttctcctcctcggcctcctctctcactgcacagactctgtgacctcctatgtgctgactcagccaccctcggtgtcagtcggcccctggacaggaccggccaggtactttaccgtgggtacgggggaaaacacgtaagtttagggaaagtaaacgacgttggtcgaccacgttggtacccaggacaaggaacgccgaacggacccgaccggtcccctggtcggcgttggttcgttctagtgggtgacgtcgggccggaccggccctcggacggctcccgtgacgcgtacttccgtcgtcggcctaccaaccgtcggtccggggaaaccccgtcccaaacccgtcgaacctacgtacccggaacggggtacccggggtacggaaacggggtaaccgggggtatacggggaccggtacccgtaaacgtttacgttacggttcggtacggtaacggggttgggttacggggtaagttagggttacggggttacggttgggtttaccggttccgggtttaccggttacggggcggttaccgggttacggggaacccgttacggggtaccctacccgggtttacccgttacgggtaccgtaacccggaacccgtaaccgggccccctaaacccgtcggttaccgtccctaccgtttcccgtacccgttacccccgtaccctttcccgtaccgttcccgtacccgttccgtaccgtcgg

SEQ ID NO: 135861 - DNA, 284 bp, Homo sapiens
  misc_feature: GYAE6OF02IXNMX.49.11.A11.1.454.CMB.1.raw
  modified_base (207)..(207): a, c, t, g, unknown or other
  misc_feature (207)..(207): n is a, c, g, or t
  modified_base (250)..(253): a, c, t, g, unknown or other
  misc_feature (250)..(253): n is a, c, g, or t
  modified_base (255)..(284): a, c, t, g, unknown or other
  misc_feature (255)..(284): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccatgtcactctgttcccncctcctctctctcgactctgagcgggctggcaaggcgcatagnnnngnnnnnnnnnnnnnnnnnnnnnnnnnnnnnn

SEQ ID NO: 135862 - DNA, 664 bp, Homo sapiens
  misc_feature: GYAE6OF02FY651.49.11.A11.1.454.CMB.1.raw
  modified_base (400)..(400): a, c, t, g, unknown or other
  misc_feature (400)..(400): n is a, c, g, or t
  modified_base (442)..(442): a, c, t, g, unknown or other
  misc_feature (442)..(442): n is a, c, g, or t
  modified_base (482)..(482): a, c, t, g, unknown or other
  misc_feature (482)..(482): n is a, c, g, or t
  modified_base (547)..(547): a, c, t, g, unknown or other
  misc_feature (547)..(547): n is a, c, g, or t
  modified_base (658)..(658): a, c, t, g, unknown or other
  misc_feature (658)..(658): n is a, c, g, or t
tcagagtcgagagacacgaccggtgctcgatttagctacgactgcgagggggggtccgtaaggaagcagcactggtggtgcctcagccagtcggcctggaccgttcctccgtcctccggcctcctctcgtcactcgcacgagactctgtcgacctcgtatgtcgctgactcacgtcccaccgtggtagtcacggttcggaccccgtgggaccacggaccggaccgagggtactttaaccgtgggtagggggaaaaccacgagtttagggaaagtaacgacttggtacgaccgtagtacgggtaaccaggacctaaggaacgccgacggcccgtacgggcccctggttcgctcggtacgttctagtcggtgagtcggaccgccgtcctggaggactcccgngacgcgtattcgcgttacggctccaagtcgtaccgggacccncctactacgcacgtgaacggtcccgggagaacggacgggntaggacgcgacttgtacgtgtacgcgttggaggtacgtggtaggtgttggtcgtcgtcgttcggngtcgtacggtaccgtcgggttacacccggttcgtaccgtcgacgtaccgaacgaccctaaccgactcgtacctacgtctaccgttccctacctccgtcctcgtctaccgtntcccgg

SEQ ID NO: 135863 - DNA, 527 bp, Homo sapiens
  misc_feature: GYAE6OF02HHT0T.49.11.A11.1.454.CMB.1.raw
  modified_base (493)..(493): a, c, t, g, unknown or other
  misc_feature (493)..(493): n is a, c, g, or t
  modified_base (515)..(515): a, c, t, g, unknown or other
  misc_feature (515)..(515): n is a, c, g, or t
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagccaccctcggtgtcagtggcccctggacagacggccaggattacctggtgggggaaacacattggaagtaagactgtgcactggtaccagcagaagccaggccaggccccctgtgctggtcgtctatggtgatggcgaccggccctcgagggactcccgtgagcgattctctggctccactcgtcgggaacccgccaccctgaccatcagccgggtacgaagacgggatgaggccgactattactgtcaggtgtgggataggtggtagtggtcgtcgtcgttcggagcgtgggaccgagggtcaccgtcctaggtcacgccaggcccaacccnctcgcactctcgtcccgcctcnctctctcgctcg

SEQ ID NO: 135864 - DNA, 575 bp, Homo sapiens
  misc_feature: GYAE6OF02JANL6.49.11.A11.1.454.CMB.1.raw
  modified_base (271)..(271): a, c, t, g, unknown or other
  misc_feature (271)..(271): n is a, c, g, or t
  modified_base (376)..(376): a, c, t, g, unknown or other
  misc_feature (376)..(376): n is a, c, g, or t
  modified_base (527)..(527): a, c, t, g, unknown or other
  misc_feature (527)..(527): n is a, c, g, or t
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagccaccctcggtgtcagtcggcccctgggacagacggccaggattacctggtgggggaaacacattggaagtaagactgtgcatggtaccagcagagccaggccaggccccngtgctggtcgtctatggtgatggcgacccggtccctcgagggactcccgtgacgcgattctctcggctccgaactcgtacgggaaccccgcaccctcgaccatcncggccggtcggaaggacggggatcggacggccgtaatattacgtcggtacgaggtgtacgggattaggtagggtagtgggtgttcggtcgtttcgggagtcgtagggacgtagggtcctacgtccgtagtcacgcccgaacggccaacccncgtctacctacgtcctacgttccccaccctccgtcctctcctcgctcg

SEQ ID NO: 135865 - DNA, 300 bp, Homo sapiens
  misc_feature: GYAE6OF02IS1LS.49.11.A11.1.454.CMB.1.raw
  modified_base (245)..(245): a, c, t, g, unknown or other
  misc_feature (245)..(245): n is a, c, g, or t
  modified_base (251)..(251): a, c, t, g, unknown or other
  misc_feature (251)..(251): n is a, c, g, or t
  modified_base (254)..(256): a, c, t, g, unknown or other
  misc_feature (254)..(256): n is a, c, g, or t
  modified_base (258)..(259): a, c, t, g, unknown or other
  misc_feature (258)..(259): n is a, c, g, or t
  modified_base (261)..(261): a, c, t, g, unknown or other
  misc_feature (261)..(261): n is a, c, g, or t
  modified_base (263)..(264): a, c, t, g, unknown or other
  misc_feature (263)..(264): n is a, c, g, or t
  modified_base (267)..(267): a, c, t, g, unknown or other
  misc_feature (267)..(267): n is a, c, g, or t
  modified_base (270)..(300): a, c, t, g, unknown or other
  misc_feature (270)..(300): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccgcctcctctcgtctcgactctgagcggctggcaaggcncatagnagnnngnngncnnagncannnnnnnnnnnnnnnnnnnnnnnnnnnnnnn

SEQ ID NO: 135866 - DNA, 750 bp, Homo sapiens
  misc_feature: GYAE6OF02FG7HF.49.11.A11.1.454.CMB.1.raw
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagcccaccctcggtgtcagtggcccctggacagacggccaggattacgtggtagggggaaacacattggaagtaagactgtgacactggtaccagcagaagccaggccaggcccctgtcgctggtcgtctatggtgagtggccgaccggtccctacgagggtactcccgtgagcgatttcctcgtggcctccaacgtcgtaccgggaacccgtccacccgtcgaccagtccgaggtcccgggtacgaaaggacgggggatcggaacggccgtaactaacgtttacgtgtaccgtagggttgggacgggtaagttagggttacgggtaagggtttcgggttacggttccggtttcggtttacggggacgttcggtacggggtacccggtaacggggttaccgtaacccgggtttacccgtaagggttccgaacccggggtaccccgtaaaacccgggccccgtaaaaccccccgtcggtttaaccggtacccctaacccgttcccggtttaccccggtttcccccccggtccccggtttacccctttaccgtttaccccggttccccgtttacccgggtaccctttacccggg

SEQ ID NO: 135867 - DNA, 267 bp, Homo sapiens
  misc_feature: GYAE6OF02JIZ08.49.11.A11.1.454.CMB.1.raw
  modified_base (230)..(230): a, c, t, g, unknown or other
  misc_feature (230)..(230): n is a, c, g, or t
  modified_base (243)..(243): a, c, t, g, unknown or other
  misc_feature (243)..(243): n is a, c, g, or t
  modified_base (249)..(250): a, c, t, g, unknown or other
  misc_feature (249)..(250): n is a, c, g, or t
  modified_base (252)..(267): a, c, t, g, unknown or other
  misc_feature (252)..(267): n is a, c, g, or t
tcagagtcgagagacacgaccggtgctcgatttagctacgactgcagggaacccggccgaccctcgaccatcagccgggtcgaagacgggatgaggccgactattactgtcaggtgtgggatagtggtagtggtgtcgtcttcggagctgggaccagggtcacgtcctaggtcacgcccaaggccaacccactgtcactctgttcccgcctcctctctctccgatctgancggctggcaggcncatagnntnnnnnnnnnnnnnnnn

SEQ ID NO: 135868 - DNA, 261 bp, Homo sapiens
  misc_feature: GYAE6OF02IHZE6.49.11.A11.1.454.CMB.1.raw
  modified_base (248)..(248): a, c, t, g, unknown or other
  misc_feature (248)..(248): n is a, c, g, or t
  modified_base (254)..(261): a, c, t, g, unknown or other
  misc_feature (254)..(261): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggcccaaccccactgtcactctcgttccccaccctcctctctctcgactctgagcggctggacaggcncatagnnnnnnnn

SEQ ID NO: 135869 - DNA, 760 bp, Homo sapiens
  misc_feature: GYAE6OF02G7B1A.49.11.A11.1.454.CMB.1.raw
tcagagtcgagagacacgaccggtgctcgatttagctacgactgcaggggggggcctaaggaagcagcactggtggtgcctcagccatggcctggaccgttctcctcctcggcctcctctctcactgcacagactctgtgacctcctatgtgctgactcacgccaaaccctcggtgtcagtcggcccctggacagaccggccagggattaccgtggtagggggaaaccactagttagggaaagtaagactggtagcacgtgggtaccagcaagaacgccaggccaggcccctggtcgctgggtcgtcgtaatcggtgattgggccgacccggccctagaggggactcccgtgacgcgtacttccgtcgtcggccttacccgaacttccgtaggggaaccaccggcccacccgtgacccgtcgagcgaggggtaccgaacgggccggggatcggacggaccgtactaagttactcgtgttaccgagggttggtacgggtaagttaggttaggttacggtcgtaccgtttccgggtttaccggggggtttggttaccggggaccggggtaacggggtaaacccgttaaggggtttccggtaacccgggtttcggtttacgggtacccgtaaccgggtaccccgaaacgggtcccgttaacccgggtccccccgttacgggtacccgttacccgtttcccggttacccggtttcccccgtaccccgtttcccccgttaccgtttcccgttcccgttaacccgg

SEQ ID NO: 135870 - DNA, 610 bp, Homo sapiens
  misc_feature: GYAE6OF02F9N2H.49.11.A11.1.454.CMB.1.raw
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagccaccctcggtgtcagtggcccctggacagacggccaggattaccgtggtacgggggaaacacagttgggaaataagactgtgcatggtaccagcagaagccaggccaggcccctgtcgctggtctctagtggtgatggcgacccggcctcgagggactcccgtgacgcgtacttctcgtggcctaccaacgtccgtacggggaaccccgccaccccgtcgacctactccgacggcccgggtacggaacggacggggatggacggccgactattacgtgtcgtaggtgtggataggtggtagtggtgtcgtcgtcggcgtggcggacgtgggtccgtacgtccgtagtcgacgtacccgaacggaccccaacccgtcgtcggtacctaccgtaccgttccgttacccccgtacccgttccctaccgttccctaccttcccgtacttccgg

SEQ ID NO: 135871 - DNA, 652 bp, Homo sapiens
  misc_feature: GYAE6OF02HMF0Y.49.11.A11.1.454.CMB.1.raw
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagccaccctcggtgtcagtcggcccctggacagaccggccaggattaccgtggtaggggaaaacgacattaggaaagtaagactgtgcacgtggtaccagacaagaagccaggccaggcccctgtgcgtggtcgtctagtggtgagtggccgaccggccctcgagggactcccgtgacgtcgtacttctcgtggcctaccaacgtcgtacgggaaccccggcctacccgtcgaccacgtaccgacgggtcccggggtacgaaacgggaccggggatcgggacggcccgtaacttaacgtacgtgtacgtagggtgtacggggtatacgggttaggttaggtggtagtcgttcgttacggagtcggtacgggaccgtagggtaccaccggttaccgtaggtccgacggacccaacgggcccaaacccgtcgtcgtacccacgttccgttccggttccccgtacccttccgtccttccgtcccgtccgtactccgg

SEQ ID NO: 135872 - DNA, 273 bp, Homo sapiens
  misc_feature: GYAE6OF02FU22L.49.11.A11.1.454.CMB.1.raw
  modified_base (252)..(273): a, c, t, g, unknown or other
  misc_feature (252)..(273): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtccactctgttcccacctcctctctctcgactctgagcgggctggcaaggcgcatagnnnnnnnnnnnnnnnnnnnnnn

SEQ ID NO: 135873 - DNA, 716 bp, Homo sapiens
  misc_feature: GYAE6OF02FJU4H.49.11.A11.1.454.CMB.1.raw
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagccaccctcggtgtcagtcggcccctggacagacggccaggattacctgtcgggggaaacacattggaagtaagactgtgcactcggtaccagcagaagccaggccaggcccctgtcgctggtcgtctagtggtgagtcggcgaccggccctcgagggactccctgagcgtattctcgtcggctccgaactcgtacgggaacccgcccacccgtcgaaccactccgacggcccggtacggtaacggaacggggaggtacggacggacccggtacgtaacgttacgttagtcgtacggtagggttcgggtaggtaggttagggtacggttagggttacgggttcgttcggtttaccgggtacgggtacggtacggggtaccgggtaacgggtccggttaacccggtaccgttacggtaccgtaccgggaccccgaacgggtaccccgaaccccgtaacccgtaccgtccggtaacccgttcccgttaccggttacccccgttacccccgttcccgttaccccgtttcccgttacccgttccggtacccgtttacccgg

SEQ ID NO: 135874 - DNA, 258 bp, Homo sapiens
  misc_feature: GYAE6OF02GDIGS.49.11.A11.1.454.CMB.1.raw
  modified_base (251)..(258): a, c, t, g, unknown or other
  misc_feature (251)..(258): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccatgtcactctgttccccacctcctctctctcgactctgagcgggctggcaaggcgcatagnnnnnnnn

SEQ ID NO: 135875 - DNA, 795 bp, Homo sapiens
  misc_feature: GYAE6OF02IL5JW.49.11.A11.1.454.CMB.1.raw
tcagagtcgagagacacgaccggtgctcgatttagctacgactgcaggggggggcctaaggaagcagcactggtggtgcctcagccatggcctggaccgttctcctcctcggcctcctctctcactgcacagactctgtgacctcctatgtgctgactcagccaccctcggtgtcaggtcggcccctggacagacggccaggattaccgtggtagggggaaacacattgggaagtaagactgtgcacgtggtaccagacagaacgccaggccacggcccctgtcgcgtggtctctagttggtagagttcgggccgaccccgggtccctacggacgggtactcccgtaggacgcgtaactttcgtcgtggtcctacctaaccgtcggttaccggggaacccccgccctacccgtacgaaccctataccgacgggacccggggtacgaaaacggggtccgggggaagtacgggaaccggtacccgtaacgttaacgtttaccgtaggttaccgtaaggggttgggttacggggtaagttagggttacggggttaacggttcggggttaccgggtttcggtttaccggtttcggggacggttccgggttacgggggaaccccggttaggggtaccccgtaaccgggtttacccgttaaccggggtaccgtaacccgggaccccgaaaccgggtacccccaaaccccgtacgttccggtaccctacccgttcccgttcccgttaaccccctaccccgttcccttcccgttacccgttacccttcccggtaaccttccgg

SEQ ID NO: 135876 - DNA, 703 bp, Homo sapiens
  misc_feature: GYAE6OF02F1LQM.49.11.A11.1.454.CMB.1.raw
tcagagtcgagagacacgaccggtgctcgatttagctacgactgcaggggggggcctaaggaagcagcactggtggtgcctcagccatggcctggaccgttctcctcctcggcctcctctctcactgcacagactctgtgacctcctatgtgctgactcagcccaccctcggtgtcaggtcggcccctggacagacggccaggattaccgtggtgggggaaacgacagttaggaagtaagactgtgcactcggtacagcagaacgccgaggccacggcccctgtgctggtcgtctagtggtgagtggccgacccggccctcgacggggctcccgtggacgccgtatttctcgtcggcctaccgaacgttccgaccggggaaccccgcccaacccgtacggacccacgtccgaccgggtacccggggtacggaacggggacggggtagtacgggacgggtacccgtaacgttaagtttaccgtggtaccggtaggggttcggtaggggtacgttaggggttagggttagggttgggttcggttacgttccggttacgggtgccggttaggggacccgtaggggtaccgtacccggttcgtacgggtccaccggaccccgaacggccccaaccgtccgttacgtacctaccgttccgttacccgtccccgtccccttcctccgttcctccgttccgaccgttcgg

SEQ ID NO: 135877 - DNA, 258 bp, Homo sapiens
  misc_feature: GYAE6OF02F1ZM5.49.11.A11.1.454.CMB.1.raw
  modified_base (253)..(258): a, c, t, g, unknown or other
  misc_feature (253)..(258): n is a, c, g, or t
tcagagtcgagagacacgaccggtgctcgatttagctacgactgcggggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccaccctcctctctctcgactctgagcgggctggcaaggcgcaatagnnnnnn

SEQ ID NO: 135878 - DNA, 858 bp, Homo sapiens
  misc_feature: GYAE6OF02JGACM.49.11.A11.1.454.CMB.1.raw
  modified_base (101)..(101): a, c, t, g, unknown or other
  misc_feature (101)..(101): n is a, c, g, or t
  modified_base (201)..(201): a, c, t, g, unknown or other
  misc_feature (201)..(201): n is a, c, g, or t
  modified_base (265)..(265): a, c, t, g, unknown or other
  misc_feature (265)..(265): n is a, c, g, or t
tcagagtcgagagacacgaccggtgctcgatttagctacgactgcagggggggcctaaggaagcagcactggtggtgcctcagccatggcctggaccgttntcctcctcggcctcctctctcactgcacagactctgtgacctcctatgtgctgactcagcccaccctcggtgtcaggtcggcccctggaccagacggccncgaagtacctgggtagggaacgaactgtaggtaagaactacgtgtgactagtaccgtacgaacngacgaacggacgacgacggaccgtccgtccggtcgtcgtcgttcggtacgttacgtaggttagtgggcgtaccgggtccctacgaccgggtactccccggtggaaccgtcggaagtttccgtacgttcgggccttccgaacgtttcccgtaacggggtaaacccccggtccgaacccccggttcggaaccccgtacgttacccgaacggtccccggggttaccggaaccggggtaccggggggtaaactacggggaacggtacccggtaacggttaaccgtttaaccgttacggttaccgtagggttacgggtacggggtaacgtagggttacgggttacggttagggtttacggtacgggtttaccggtttccggtacggttccgggttaaccggggtacccggtacggggttaacccgtaacccgggtttacccgttaaccgggttccgtaaaccgggtagtaaacccccccccccccgggacgtaacccccggtacgtacccggttaaccgtacccgttccgttaccgttccccgtcccgtttaccccgttaccttacccgttccgttacccggtaccgttccgtaccgg

SEQ ID NO: 135879 - DNA, 897 bp, Homo sapiens
  misc_feature: GYAE6OF02HY98Q.49.11.A11.1.454.CMB.1.raw
  modified_base (396)..(396): a, c, t, g, unknown or other
  misc_feature (396)..(396): n is a, c, g, or t
tcagagtcgagagacacgaccggtgctcgatttagctacgactgcagggggggcctaaggaagcagcactggtggtgcctcagccatggcctggaccgttctcctcctcggcctcctctctcactgcacagactcttgtcgaccccttactgtgtctcgtacgtacctacgaccgaccccgttccggtcggttccgtacggtccgggtcccccggaccggtaccggaacgacgggtacccgaaggtacgttaaccgttaccgggttagggggaaaccgggaaactaagttacggtaaaggtaagtaacgtagttgcgtacgtacggtacgacgacgaacgaacgaccgcggtaaccgccgtacccggtgtgccgtggttacgttcgttacgttggnggtactcgggccggtaaccccgggtcccgtacgtacgggaccttaccccggtcgaggaccggttactttccggttctccggggtacccttacccctaaacgtacccggggtttaccgggaaaccccccgggacccttacccggaacccgtaacccggaccgttaccgtaacccgggggacccggtaaccggggtaaacgaacgggggacggttaccggaccgggtacccggtaaccgttaacgttaaccgttcggttacggtaggtagggttacggtagggtacggtcgggttaggttgggtcggttcggttcggttcggacggtcggtacgggtaccggtacggtccggttacggtcccggttaacgtccggtaccgtaaccggacccgtacccggaccccgtaccgttaccggtcgtaaccccgttcgttacccgtttacccccgaccctttccccttaccgtcccgtttcccggtaacgttccccgtacgttaccggg

SEQ ID NO: 135880 - DNA, 662 bp, Homo sapiens
  misc_feature: GYAE6OF02JJ7T8.49.11.A11.1.454.CMB.1.raw
  modified_base (554)..(554): a, c, t, g, unknown or other
  misc_feature (554)..(554): n is a, c, g, or t
  modified_base (636)..(636): a, c, t, g, unknown or other
  misc_feature (636)..(636): n is a, c, g, or t
tcagagtcgagagacacgaccggtgctcgatttagctacgactgcagggggggccgtaaggaagcagcactggtggtgcctcagccatggcctggaccgttctcctcctcggcctcctctctcactgcacagactctgtgacctctatgtgctgactcagccaccctcggtgcagtcggcccctggacacgacggcctagggacttaccgtgggtagggggaaacgactagtttgggaaagtaagactgtgcacgtggtaccagacagaagccgacggccgacggccccgtgtcgacgtcggtccgtctagtcgggttgagtcggccggtacccggccctcgacggggtactccgtagaggccggtatttcacgtcggctaccctaacgtccggtacgggtaccccgcctacccggtcgacgactacccgacgggcccgggtacggaacggtacgggggacgtacgggacggtaccggtaacgttacgttaacgtcggtacgtcgggtaggtcgggtagttaggtggttagttgggttcgtcgttcgttcgggngtccggtacggtaccgtacgggtctaccggtctacggtccgacgaccgacgcccaaccgcgtcgcctactcgtaccgtcccncccttcctaccgtctccgcgtcctcg

SEQ ID NO: 135881 - DNA, 258 bp, Homo sapiens; identical to SEQ ID NO: 134826
  misc_feature: GYAE6OF02GK4LL.49.11.A11.1.454.CMB.1.raw
  modified_base (252)..(258): a, c, t, g, unknown or other
  misc_feature (252)..(258): n is a, c, g, or t

SEQ ID NO: 135882 - DNA, 267 bp, Homo sapiens
  misc_feature: GYAE6OF02FSFRP.49.11.A11.1.454.CMB.1.raw
  modified_base (251)..(267): a, c, t, g, unknown or other
  misc_feature (251)..(267): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccatgtcactctgttcccaccctcctctctctcgactctgagcgggctggcaaggcgcatagnnnnnnnnnnnnnnnnn

SEQ ID NO: 135883 - DNA, 279 bp, Homo sapiens
  misc_feature: GYAE6OF02JI100.49.11.A11.1.454.CMB.1.raw
  modified_base (193)..(193): a, c, t, g, unknown or other
  misc_feature (193)..(193): n is a, c, g, or t
  modified_base (254)..(258): a, c, t, g, unknown or other
  misc_feature (254)..(258): n is a, c, g, or t
  modified_base (260)..(279): a, c, t, g, unknown or other
  misc_feature (260)..(279): n is a, c, g, or t
tcagagtcgagagacacgaccggtgctcgatttagctacgactgcagggaacccggccaccctgaccagtcagccgggtcgaagacggggatgaggccgactattactgtcaggtgtgggatagtggtagtggtgtcgtcgttcggagctgggaccagggtcaccgtcctaggtcagcccaaggccaaccccntgtcactctgttcccaccctcctctctctcgactctgagcgggctggcaaggcgacatagnnnnnannnnnnnnnnnnnnnnnnnn

SEQ ID NO: 135884 - DNA, 604 bp, Homo sapiens
  misc_feature: GYAE6OF02G4FMV.49.11.A11.1.454.CMB.1.raw
  modified_base (256)..(256): a, c, t, g, unknown or other
  misc_feature (256)..(256): n is a, c, g, or t
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagccacctcggtgtcagtcggcccctggacagacggccaggattacctggtgggggaaacacattggaagtaagactgtgcactggtaccagcagaancaggccaggcccctgtgctggtcgtctatggtgatggcgaccggcctcgagggactccctgacgcgacttcgtacgtggcctaccaacgtcgtacgggaaccccgcctaaccctgacctataccgaggacccgggtacgaacggaacggggtatcggaacggtccgaacttaagttacgtggtacgtaacgggttggtagggagttacggttgggtagtcgggttgtcgttcgtcggagtcgtagggaccagggtccaccgttctacggtcaacgacctaacgacccaaccctagtcgtaccactccgtacgttaccccaccttccctctccctacgtccgactaccg

SEQ ID NO: 135885 - DNA, 757 bp, Homo sapiens
  misc_feature: GYAE6OF02JQZD4.49.11.A11.1.454.CMB.1.raw
  modified_base (173)..(173): a, c, t, g, unknown or other
  misc_feature (173)..(173): n is a, c, g, or t
  modified_base (319)..(319): a, c, t, g, unknown or other
  misc_feature (319)..(319): n is a, c, g, or t
  modified_base (427)..(427): a, c, t, g, unknown or other
  misc_feature (427)..(427): n is a, c, g, or t
tcagagtcgagagacacgaccggtgctcgatttagctacgactgcagggggggcctaaggaagcagcactggtggtgcctcagccatggcctggaccgttctcctcctcggcctcctctctcactgcacagactctgtcgacctctatgtgctgactcagccacccgtcggtntcagtcggcccctggacacggaccggtccaaggtactttaccgtgggtacgggggaaaccactagttacggaagtaacgacttgtgctacgtggtaccagcagacgcaggtccacggtccctagtcgcgtaggtcgtctagtcggngacgtcggccgtaccgcccgtacgagggtctcccgtagacggacgtactttcgtcgtggaccctacgtaaccgtcgtacgggaaccccgtccctaacccgtcgtaccnggttaccacggggtaccgggtacggtaaacgggccgggacgtacggtacgggtacccgtaacgtttacgttaacgtccgttacggtaacggttcgggtaacgggtcggtttaagggttacgggttaacggtttgggttaccggtttacgggttccggttcgggaacggtcggtaacggggaccgtcgggggtacctaccggttcgtacggtacccgacggtacccgaaccggtacccgacccgtacggtcccgtaccgtcccgtaccgttccccttacccgtaccccgttccgtacccgttacccgttcccgtaccggttaccttccggg

SEQ ID NO: 135886 - DNA, 257 bp, Homo sapiens
  misc_feature: GYAE6OF02HAGGG.49.11.A11.1.454.CMB.1.raw
  modified_base (244)..(244): a, c, t, g, unknown or other
  misc_feature (244)..(244): n is a, c, g, or t
  modified_base (250)..(257): a, c, t, g, unknown or other
  misc_feature (250)..(257): n is a, c, g, or t
tcagagtcgagagacacgaccggtgctcgatttagctacgactgcagggaacccggccaccctgaccatcagccgggtcgaagacggggatgaggccgactattactgtcaggtgtggatagtggtagtggtgtcgtcttcggagctgggaccagggtcaccgtcctaggtcagcccaaggccaaccccatgtcactctgttcccaccctcctctctctcgactctgagcgggctggcaaggcncatagnnnnnnnn

SEQ ID NO: 135887 - DNA, 791 bp, Homo sapiens
  misc_feature: GYAE6OF02I2BD2.49.11.A11.1.454.CMB.1.raw
  modified_base (326)..(326): a, c, t, g, unknown or other
  misc_feature (326)..(326): n is a, c, g, or t
tcagagtcgagagacacgaccggtgctcgatttagctacgactgcaggggggggcctaaggaagcagcactggtggtgcctcagccatggcctggaccgttctcctcctcggcctcctctctcactgcacagactctgtgacctcctatgtgctgactcagccaccctcggtgtcaggtcggccctggacagaccggccaggtacttaccgtgggtacgggggaaacacgtagttagggaaagtaagaccgtggtcgacgtacgtcggtaccagcaagaacgccgaggcccacggcccctgtcgcgtggttcgtacttaggtcggngagttcgggccgaccccggtccacgacgggtacctcccgtgacgtacgtcttcgcgtcgtccctaccacgtccgtaccggggaaccccgcccgtaccgcgaacctacgtcggaaccgggtacccggggtaacggaacgggtacgggggtcgtacgggaccgggtaacccgtacgttacgtttacgtggttacggacggggttaggtcgggtaacggtttggttagggttacggttcgggttacgttccgggtttccggtacgggacggtcggttaccggggtaccgtcgggttacccggtaccggttccggtaacggttaccgtaacccgaccccggtaaccgttacccccgaaaccccgttacggttcccggttaaccttaccgtttacccgttaccccgtttacccccgtaccccttttcccggttccttcccggttacccgttacccggtacgtttcccggg

SEQ ID NO: 135888 - DNA, 938 bp, Homo sapiens
  misc_feature: GYAE6OF02H26EF.49.11.A11.1.454.CMB.1.raw
tcagagtcgagagacacgaccggtgctcgatttagctacgactgcgagggggggcctaaggaagcagcactggtggtgcctcagccatggcctggaccgttctcctccgtcggcctcctctctcactgcacagactctgtcgacctcctatgtgctgactcacgcccacccgtggtcgtcgaggtccggcccctaggaccgacggaccggccgaaggtacttaccgtgggtacgggggaaaaccacgtagttagggaaagtaacgacgttggtcgactacgtacggtaccagcaaaggacgccgacgggcccgaccggtcccctggtcgcgttcggtccgttcgttaggttggtaggtagtccgggccggaccccggcccgtacggacggtaccttcccgagaccgtacgtacgttccgtccggtccggtaccctaaccgtaccgtacccgggtaacccgggaacccccgtcccgtaaccccgtaccgaacccgtacgtaccgggtacccggggtaccccggggtaaaggaaaccgggggtaccggggtaacggtacggggtaacccggggtaacccgtttaaaccgttttaaaccggtttaccgggttacgggttacgggttaacggggttgggttaacgggggtaacgtttaacggggtttaggggttaacgggtttcgggttacgggtttaccgggttaccgggtaccggggtaacgtacccggggttaaccggggtacccgggttaaccggggttccccgtaacccgggtttaaccgggtacgggtacccgtaaacccggaacccgggtaacccgaaccccccgtaaccgtaccgggttacccgttcccgtaccggttccccgtttacccccggtcccccttaccccgtttcccttccccgtacccgttaccgttcccggtaccgttacccggg

SEQ ID NO: 135889 - DNA, 279 bp, Homo sapiens
  misc_feature: GYAE6OF02IXQOK.49.11.A11.1.454.CMB.1.raw
  modified_base (259)..(279): a, c, t, g, unknown or other
  misc_feature (259)..(279): n is a, c, g, or t
tcagagtcgagagacacgaccggtgctcgatttagctacgactgcagggaacccggccaccctgaccatcagccgggtcgaagacggggatgaggcccgactattactgtcaggtgtgggatagtggtagtggtgtcgtcttcggagctgggaccagggtcaccgtcctaggtcagcccaaggcccaaccccactgtcacttctcgttccccaccctcctctcctctcgactctgagcgggctggcaaggcacagtagnnnnnnnnnnnnnnnnnnnnn

SEQ ID NO: 135890 - DNA, 721 bp, Homo sapiens
  misc_feature: GYAE6OF02FGTGL.49.11.A11.1.454.CMB.1.raw
  modified_base (226)..(226): a, c, t, g, unknown or other
  misc_feature (226)..(226): n is a, c, g, or t
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagcccaccctcggtgtcagtcggcccctggacagaccggccaggacttaccgtggtagggggaaaccncagttggaagtaagactgtgccacttggtaccagcagaacgccaggccaggcccctagtcgcttgggtccgttctatgggtagactggccgaccgggccctacgagggtactccccgtgacgtcgtattcctactcggctaccctaacttccggtacgggaaccccggtccaccccgttacggaccacgttacgacgggtcccgggttacggaacggacggggtactacggacgggtacccgtacgttaacttacgtcgtaccgtaagggttggtacgggattaggtggtagttgggtcgttcggtcgtttcgggagtccgtaggggaacccgtaggggttaccaacccggtttccgtacgtacgtacgttacccgaacgggtacccccaacccgacgtttcccggtacctacccgttcccgttaccgttttaccccccgaccccgtttccccgttaccgttccgttacccgttaccccggttaccttacccggg

SEQ ID NO: 135891 - DNA, 266 bp, Homo sapiens
  misc_feature: GYAE6OF02J1J2U.49.11.A11.1.454.CMB.1.raw
  modified_base (252)..(266): a, c, t, g, unknown or other
  misc_feature (252)..(266): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctcgttcccaccctcctctctctcgactctgagcggctggcaaggcgcatagnnnnnnnnnnnnnnn

SEQ ID NO: 135892 - DNA, 499 bp, Homo sapiens
  misc_feature: GYAE6OF02FHR96.49.11.A11.1.454.CMB.1.raw
  modified_base (133)..(133): a, c, t, g, unknown or other
  misc_feature (133)..(133): n is a, c, g, or t
  modified_base (230)..(230): a, c, t, g, unknown or other
  misc_feature (230)..(230): n is a, c, g, or t
  modified_base (257)..(257): a, c, t, g, unknown or other
  misc_feature (257)..(257): n is a, c, g, or t
  modified_base (259)..(259): a, c, t, g, unknown or other
  misc_feature (259)..(259): n is a, c, g, or t
  modified_base (262)..(262): a, c, t, g, unknown or other
  misc_feature (262)..(262): n is a, c, g, or t
  modified_base (268)..(268): a, c, t, g, unknown or other
  misc_feature (268)..(268): n is a, c, g, or t
  modified_base (271)..(271): a, c, t, g, unknown or other
  misc_feature (271)..(271): n is a, c, g, or t
  modified_base (275)..(275): a, c, t, g, unknown or other
  misc_feature (275)..(275): n is a, c, g, or t
  modified_base (279)..(279): a, c, t, g, unknown or other
  misc_feature (279)..(279): n is a, c, g, or t
  modified_base (300)..(300): a, c, t, g, unknown or other
  misc_feature (300)..(300): n is a, c, g, or t
  modified_base (310)..(310): a, c, t, g, unknown or other
  misc_feature (310)..(310): n is a, c, g, or t
  modified_base (315)..(315): a, c, t, g, unknown or other
  misc_feature (315)..(315): n is a, c, g, or t
  modified_base (325)..(325): a, c, t, g, unknown or other
  misc_feature (325)..(325): n is a, c, g, or t
  modified_base (332)..(332): a, c, t, g, unknown or other
  misc_feature (332)..(332): n is a, c, g, or t
  modified_base (360)..(360): a, c, t, g, unknown or other
  misc_feature (360)..(360): n is a, c, g, or t
  modified_base (364)..(364): a, c, t, g, unknown or other
  misc_feature (364)..(364): n is a, c, g, or t
  modified_base (367)..(369): a, c, t, g, unknown or other
  misc_feature (367)..(369): n is a, c, g, or t
  modified_base (371)..(373): a, c, t, g, unknown or other
  misc_feature (371)..(373): n is a, c, g, or t
  modified_base (375)..(375): a, c, t, g, unknown or other
  misc_feature (375)..(375): n is a, c, g, or t
  modified_base (377)..(377): a, c, t, g, unknown or other
  misc_feature (377)..(377): n is a, c, g, or t
  modified_base (381)..(381): a, c, t, g, unknown or other
  misc_feature (381)..(381): n is a, c, g, or t
  modified_base (383)..(383): a, c, t, g, unknown or other
  misc_feature (383)..(383): n is a, c, g, or t
  modified_base (385)..(388): a, c, t, g, unknown or other
  misc_feature (385)..(388): n is a, c, g, or t
  modified_base (390)..(390): a, c, t, g, unknown or other
  misc_feature (390)..(390): n is a, c, g, or t
  modified_base (395)..(395): a, c, t, g, unknown or other
  misc_feature (395)..(395): n is a, c, g, or t
  modified_base (397)..(397): a, c, t, g, unknown or other
  misc_feature (397)..(397): n is a, c, g, or t
  modified_base (401)..(401): a, c, t, g, unknown or other
  misc_feature (401)..(401): n is a, c, g, or t
  modified_base (410)..(410): a, c, t, g, unknown or other
  misc_feature (410)..(410): n is a, c, g, or t
  modified_base (412)..(413): a, c, t, g, unknown or other
  misc_feature (412)..(413): n is a, c, g, or t
  modified_base (415)..(415): a, c, t, g, unknown or other
  misc_feature (415)..(415): n is a, c, g, or t
  modified_base (417)..(417): a, c, t, g, unknown or other
  misc_feature (417)..(417): n is a, c, g, or t
  modified_base (421)..(421): a, c, t, g, unknown or other
  misc_feature (421)..(421): n is a, c, g, or t
  modified_base (440)..(440): a, c, t, g, unknown or other
  misc_feature (440)..(440): n is a, c, g, or t
tcagagtcgagagacacgaccggtgctcgatttagctacgactgcaggggaacccggccaccctgaccatcagccgggtcgaagacgggggatgaggccgactattactgtcaggtggtcggatagtggtagnggtgtcgtcttcggagctgggaccaggtcacgtccaggtcagccaaggccaaccccatgtcactctgttcccgcctcctctctctccgactctgacncgggctggcaaacgggcgcactacggntntcnactgcnctnctgnactnacgagcttcatacctggtccntcaaggttcnggttnaaccttgggnttccggnttaacggcttcaacggtctgaaactcgnactnctnnncnnncncncacncncnnnncngacananctanactacacananncnancacnctcgacgacgtcgacgacncgtacgacactactacgtacgactacacgtcgtacgcgtactacacgtcgactacgtac

SEQ ID NO: 135893 - DNA, 254 bp, Homo sapiens
  misc_feature: GYAE6OF02IDPA3.49.11.A11.1.454.CMB.1.raw
  modified_base (245)..(245): a, c, t, g, unknown or other
  misc_feature (245)..(245): n is a, c, g, or t
  modified_base (250)..(254): a, c, t, g, unknown or other
  misc_feature (250)..(254): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctcgttcccgccctcctctctctcgactctgagcggctggcagcgnatagnnnnn

SEQ ID NO: 135894 - DNA, 289 bp, Homo sapiens
  misc_feature: GYAE6OF02H4Y43.49.11.A11.1.454.CMB.1.raw
  modified_base (258)..(258): a, c, t, g, unknown or other
  misc_feature (258)..(258): n is a, c, g, or t
  modified_base (267)..(289): a, c, t, g, unknown or other
  misc_feature (267)..(289): n is a, c, g, or t
tcagagtcgagagacacgaccggtgctcgatttagctacgactgcagggaacccggccaccctgaccatcagccggtcgaagacgggatgaggcgactatactgtcaggtgtggatagtggtagtggtgtcgtcttcggagcgtgggaccagggtcaccgtcctaggtcagcccaaggccaaccccgacttgcacctctcgttcccgccctcctcgtcctcgtccgacctctgagccgggtctcgggaccaagggccncgagtagcnnnnnnnnnnnnnnnnnnnnnnn

SEQ ID NO: 135895 - DNA, 257 bp, Homo sapiens
  misc_feature: GYAE6OF02F9F08.49.11.A11.1.454.CMB.1.raw
  modified_base (251)..(257): a, c, t, g, unknown or other
  misc_feature (251)..(257): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccatgtcactctgttcccgccctcctctctctcgactctgagcgggctggcaaggcgcatagnnnnnnn

SEQ ID NO: 135896 - DNA, 296 bp, Homo sapiens
  misc_feature: GYAE6OF02GEZFR.49.11.A11.1.454.CMB.1.raw
  modified_base (258)..(296): a, c, t, g, unknown or other
  misc_feature (258)..(296): n is a, c, g, or t
tcagagtcgagagacacgaccggtgctcgatttagctacgactgcaggggaacccggccaccctgaccagtcagccgggtcgaagacggggatgaggccgactattactgtcaggtgtgggatagtggtagtggtgtcgtcttcgggagctgggaccagggtcaccggtcctaggtcagcccaaggccaaccccatgtcactctgttcccgcctcctctcgtctcgactctgagccgggtctggacaaggcgcatagnnnnnnnnnnnnnnnnnnnnnnnnnnnnnnnnnnnnnnn

SEQ ID NO: 135897 - DNA, 258 bp, Homo sapiens
  misc_feature: GYAE6OF02HDGWM.49.11.A11.1.454.CMB.1.raw
  modified_base (249)..(258): a, c, t, g, unknown or other
  misc_feature (249)..(258): n is a, c, g, or t
tcagagtcgagagacacgaccggtgctcgatttagctacgactgcagggaacccggccaccctgaccatcagccgggtcgaagacgggatgaggccgactattactgtcaggtgtgggatagtggtagtggtgtcgtcttcggagctgggaccagggtcaccgtctaggtcagcccaaggccaaccccactgtcactctgttcccacctcctctctctcgactctgagcgggctggcaaggcgcatagnnnnnnnnnn

SEQ ID NO: 135898 - DNA, 731 bp, Homo sapiens
  misc_feature: GYAE6OF02IG38N.49.11.A11.1.454.CMB.1.raw
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagccaccctcggtgtcagtcgccctggacagaccggccaggtacttaccgtgggtacgggggaaaacacgtagtttagggaaagtaagacgttggtcgactacgttggaacccagacaacggaacgccgaagggcccaccgggcccctaggtcgtcgttcgggtacgtctagttggtgtacgtcgggccgtacccggcctcggaacggctcccgtaggacgtcgtacttacctgtccggtcctacccgtaacgttccggaccggggaaccccgtcccaaccgtacgacccagtaccgaccgggcgggtaacgaacggggacgggacgtacgggacggaccgtaactttaacgtacgtacggtacgaggggtacggtgggtaagttagggttgggttacggtgggttcgttcggttcgtcgggcgtcgggtacgggaccgtacggggtaccgtaccggttcgtacgggtaccacgtaccgacgaccccgaccgtacgtccggtacctaccgttaccttcccgttacccccgtcccgttacccgttccgttccgtaccgtccgttacgttaccgg

SEQ ID NO: 135899 - DNA, 290 bp, Homo sapiens
  misc_feature: GYAE6OF02FQTN4.49.11.A11.1.454.CMB.1.raw
  modified_base (248)..(248): a, c, t, g, unknown or other
  misc_feature (248)..(248): n is a, c, g, or t
  modified_base (253)..(254): a, c, t, g, unknown or other
  misc_feature (253)..(254): n is a, c, g, or t
  modified_base (257)..(290): a, c, t, g, unknown or other
  misc_feature (257)..(290): n is a, c, g, or t
tcagagtcgagagacacgaccggtgctcgatttagctacgactgcaggggaacccgggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccgccctctctctctcgactctgagcgggctggcaaggcgnatagnngannnnnnnnnnnnnnnnnnnnnnnnnnnnnnnnnn

SEQ ID NO: 135900 - DNA, 276 bp, Homo sapiens
  misc_feature: GYAE6OF02FIP79.49.11.A11.1.454.CMB.1.raw
  modified_base (253)..(276): a, c, t, g, unknown or other
  misc_feature (253)..(276): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccgccctcctctctctcgactctgacgcgggctggcaaggcgcatagnnnnnnnnnnnnnnnnnnnnnnnn

SEQ ID NO: 135901 - DNA, 278 bp, Homo sapiens
  misc_feature: GYAE6OF02FLGK9.49.11.A11.1.454.CMB.1.raw
  modified_base (252)..(252): a, c, t, g, unknown or other
  misc_feature (252)..(252): n is a, c, g, or t
  modified_base (258)..(278): a, c, t, g, unknown or other
  misc_feature (258)..(278): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggcccaaccccactgtcactctcgttccccaccctcctctctctcgactctgacgccgggctggcaagggcncatagnnnnnnnnnnnnnnnnnnnnn

SEQ ID NO: 135902 - DNA, 708 bp, Homo sapiens
  misc_feature: GYAE6OF02HXUWA.49.11.A11.1.454.CMB.1.raw
  modified_base (260)..(260): a, c, t, g, unknown or other
  misc_feature (260)..(260): n is a, c, g, or t
  modified_base (314)..(314): a, c, t, g, unknown or other
  misc_feature (314)..(314): n is a, c, g, or t
  modified_base (583)..(583): a, c, t, g, unknown or other
  misc_feature (583)..(583): n is a, c, g, or t
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcacgccaccccgtcggtgtcaggtcggcccctaggacacggacggccgaaggtacttaccgtggtacgggggaaaacgtactagttaggaaagtaagacgtgngcacgtggtaccagacaaggaacgccgacggccacggccctgcgtcgtggtctntagtggtgagtcgggccgacccgtccgtacgacggtacctcccgtagacgtcgtagttcctcgtcggtcctacccgtaacgtccgggtaccgggaaccccggccctaacccgtcgaaccgtacgtaccgaaccgggtccgggtacggaaacggggacggggtaagtcggaaccgggtacccgtacgttaacgttacgtcggtcgtacgggtggtaagggtacgttaggtagggtaggttggtacggttcggtcgttacgggaggtccgngggtaccgtacggtccgtaccgttcgtaacgcgaaccgacccgtacgacccgtaaccccgtgtaccgtacctcctccgttaccgtccccgtacccttccgtcctcgttcccgtacgtactcccgg

SEQ ID NO: 135903 - DNA, 901 bp, Homo sapiens
  misc_feature: GYAE6OF02H40L1.49.11.A11.1.454.CMB.1.raw
tcagagtcgagagacacgaccggtgctcgatttagctacgactgcaggggggggcctaaggaagcagcactggtggtgcctcagccatggcctggaccgttctcctcctcggcctcctctctcactgcacagactctgtcgaccttcctatgtgctgactcacgccctaccctcggtgtcaggtcggccccgtaggacacggaccggccgaaggtacttaccgtgggtacgggggaaacacgtagttaggaagtaacgacttggtcgacacgtcggtaaccaggacgaaggacgaccgacggaccgacggccccgtggtcgcgttcggtcgttacgttagtggtacggtgtcgggacccggtacccggtcccgtcggacgggtaccttcccggtaggacggtacgtcgtttccgtaccgtccggtacccttacccgtaacccgtccgggtacccggggaacccccggaccctaaccccgtacggaacccaccgtacccgggaaccggggtacccggggtaacgggaaaccgggggtaacgggggtacgtaacggggtaccgggtaccgtaacgtttaaccgtttaacgttcgggtaccgggtaggggttacgggttaggggtaaggtttaagggttcggggtttacggggttggggtttccgggttacccgggttcgggttaccggggtacgggtcgggttacccgggggaaccggttaacccgggggtttacccgtaacccgggttaccggtacccgggtaccggtaaacccggtaccccggaaacccggtacccccaacccccggttacgttacccggttacccttcccgtttcccgttccccggttacccccttaccccgttcccttccgttacccgtcccgttccgtacccgtccgg

SEQ ID NO: 135904 - DNA, 282 bp, Homo sapiens
  misc_feature: GYAE6OF02IC9R8.49.11.A11.1.454.CMB.1.raw
  modified_base (256)..(282): a, c, t, g, unknown or other
  misc_feature (256)..(282): n is a, c, g, or t
tcagagtcgagagacacgaccggtgctcgatttagctacgactgcagggaacccggccaccctgaccatcagccgggtcgaagacggggatgaggcccgactattactgtcaggtgtgggatagtggtagtggtgtcgtcttcggagctgggaccagggtcaccgtcctaggtcagcccaaggcccaaccccactgtcactctgttcccgccctcctctctctcgacctctgagcgggctggcaaggcgcaatagnnnnnnnnnnnnnnnnnnnnnnnnnnn

SEQ ID NO: 135905 - DNA, 886 bp, Homo sapiens
  misc_feature: GYAE6OF02F3Y57.49.11.A11.1.454.CMB.1.raw
  modified_base (178)..(178): a, c, t, g, unknown or other
  misc_feature (178)..(178): n is a, c, g, or t
  modified_base (231)..(231): a, c, t, g, unknown or other
  misc_feature (231)..(231): n is a, c, g, or t
tcagagtcgagagacacgaccggtgctcgatttagctacgactgcgtaggggggggtccgtaaggaagcagcactggtggtgcctcagccatggcctggaccgttctcctcctcggcctcctctctcactgcacagactctgtgacctctatgtgctgactcagtcccaccgtcggtntcagtcggccactggacagtacggccaggacttaccgtggtacgggggaaacnctagttacgggaagttaagcgtgtcgcacgtggtaccagccagaagtccacggtaccagggtcccctggtgcctagggtccgttactacgtggtagtagttcgggaccggtaccccggtccctcggtaagggtccgttccccgttggacggtccgttaagtttaccgttccggttcgggcccttaaccggtaaacctttccggggtaaccggggtaaacccccgtccccggtaaaccccgttcgggaaaccccctacgtttacccggaccgggtaacccggggggtttcccgaaaacggggtacccgggggtaacgtttaaccgggggaaacccggtaccccggtaaacccggtttaaacgttttaaacccggtacgggtttaacccgtaacgggggtttaagggtttaccgggggtaaagttttaccggggtgggggttttaaaccggttggggggttaaacgtttccggggtttaccggttttacggggaacgttaccgggttaccggggtaaccgttacgggggttacccgtacccggttacgttaccggttacgaccggaccggtaacccgacccgtaacccgtaagtccgttaccgaacttccgttaccgttcccggtaccctccgttacgtccgttaccctcgttaccc

SEQ ID NO: 135906 - DNA, 296 bp, Homo sapiens
  misc_feature: GYAE6OF02I1QLT.49.11.A11.1.454.CMB.1.raw
  modified_base (256)..(296): a, c, t, g, unknown or other
  misc_feature (256)..(296): n is a, c, g, or t
tcagagtcgagagacacgaccggtgctcgatttagctacgactgcagggaacccgggccaccctgaccatcaggccgggtcgaagacgggggatgaggccgactattactgtcaggtgtggggatagtggtagtggtgtcgtcgttcggagctgggaccagggtcaccgtctaggtcagcccaaggccaaccccactgtcactctgttcccacctccgtctctctcgactctgagcgggctggcaaggcgcatagnnnnnnnnnnnnnnnnnnnnnnnnnnnnnnnnnnnnnnnnn

SEQ ID NO: 135907 - DNA, 739 bp, Homo sapiens
  misc_feature: GYAE6OF02G7MCS.49.11.A11.1.454.CMB.1.raw
  modified_base (129)..(129): a, c, t, g, unknown or other
  misc_feature (129)..(129): n is a, c, g, or t
  modified_base (174)..(174): a, c, t, g, unknown or other
  misc_feature (174)..(174): n is a, c, g, or t
  modified_base (486)..(486): a, c, t, g, unknown or other
  misc_feature (486)..(486): n is a, c, g, or t
tcagagtcgagagacacgaccggtgctcgatttagctacgactgcagggggggcctaaggaagcagcactggtggtgcctcagccatggcctggaccgttctcctcctcggcctcctctctcactgcanagactctgtgacctctatgtgctgactcagcccacccgttcggtntcaggtcggcccctggacacggaccggccaggtattaccgtgggtagggggaaacactagttgggaaagtaagactggtgcctagtacgggaccagacagacgcgacggcacggtccctgtcgcgttgggtcgtactagttggagtacgtcggaccggaccccggtcccttcggacgggtaccgttccccgtaggacggcccggttatttcgtaccgttcgggtacccttaccgtaaacccgtcgggtaccgggaaacccccgtcccctaacccggtacaaccgttactaccggccggtacccgggggttanaaacggggtacgggtcgaacggtcgggtaacccgtactttaacggtacctaggtacgtacggggtgtaacgggtagtagggtagtttagggtcgtcgggttcgtggtacgggtcgtacggtcgggtaccgacgggttcctaccgggtccgtaaggtaccgaccgtaccgacccgtactaaccccgtagtccgtccgaacttcccgttaccttcccccgcccttcgttcccttacggtccttccgtcttacggg

SEQ ID NO: 135908 - DNA, 797 bp, Homo sapiens
  misc_feature: GYAE6OF02F34WA.49.11.A11.1.454.CMB.1.raw
  modified_base (174)..(174): a, c, t, g, unknown or other
  misc_feature (174)..(174): n is a, c, g, or t
  modified_base (761)..(761): a, c, t, g, unknown or other
  misc_feature (761)..(761): n is a, c, g, or t
tcagagtcgagagacacgaccggtgctcgatttagctacgactgcaggggggggccgtaaggaagcagcactggtggtgcctcagccatggcctggaccgttctcctcctcggcctcctctctcactgcacagactctgtgacctcctatgtgctgactcagcccaccctggtntcagtcggcccctggacagaccggccaggactttaccgtgggtagggggaaaccacgtattagggaaaagttaaggacttggtacgacctacgttcgggtaaccagaccgaaggaaacgtcccgaaggcccgacggtcccccgtgtcgcgttcggtccgttactaggttcggtggtacgttcgggaccggtaccccggccccgttaggacgggaccttccccgtaggacggtcgtacttccgtacgtccggtcctaccgtacgttcggtacccgggaaccccggtccctacccggtacgacctacgtaccgaaccggggtcccgggtaacggaacggggtacgggacgtacgggaccggtacccgtaacgtttaacgttaaccggtcgttaccgggtaggggttacgggtaggggtaagttacggggttgggttaaggttcgggttaccggttacgttcggttacgggacggtcggtacggggtaccgtacggggttccgacccggttcggttaacggtccaacggtacccgaaccgtaccccaacccggtcgtacgtcccgtaccttccgtaccccgtttaccccnccccgttccctccttcctcccttacgcccgttccgg

SEQ ID NO: 135909 - DNA, 743 bp, Homo sapiens
  misc_feature: GYAE6OF02H1XXW.49.11.A11.1.454.CMB.1.raw
  modified_base (173)..(173): a, c, t, g, unknown or other
  misc_feature (173)..(173): n is a, c, g, or t
  modified_base (225)..(225): a, c, t, g, unknown or other
  misc_feature (225)..(225): n is a, c, g, or t
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagcccaccctcggtntcagtcggccctggacaggaccggccaggacttacctgggtaggggaaaacncattgggaaagtaagactgtgcacgtggtaaccagcaagacgccaggccacggtcccctgcgtcctggttcgtcttacgtggatagtcgggaccggtacccggtccctcggacgggaccttcccgtagacggcgttacttccgtccgtacggtcctaccgtaaaccgttcggtaccggggaaaccccgtcccgtacccgttcgaacccgtactcgacgggtcccgggtaggaacgggtaggggactcggggacggaccgtacttaacgtcgtagtacggagggttggtaaggggtataggttacggttacggtgggttaccgttccggttcgtaccggggtagtaccggttacgggacccgtaggggttacccgtaaccgggttcctaacggggttccaaccggaacccgtaaccggtacccctaaccccggagtttcccggtaccctccgtttaacccttccggtccccccgtccctttaccggttcccgttacccttacgtcccggtacgtaccgg

SEQ ID NO: 135910 - DNA, 571 bp, Homo sapiens
  misc_feature: GYAE6OF02H5O1H.49.11.A11.1.454.CMB.1.raw
  modified_base (411)..(411): a, c, t, g, unknown or other
  misc_feature (411)..(411): n is a, c, g, or t
  modified_base (419)..(419): a, c, t, g, unknown or other
  misc_feature (419)..(419): n is a, c, g, or t
  modified_base (421)..(421): a, c, t, g, unknown or other
  misc_feature (421)..(421): n is a, c, g, or t
  modified_base (435)..(435): a, c, t, g, unknown or other
  misc_feature (435)..(435): n is a, c, g, or t
  modified_base (439)..(439): a, c, t, g, unknown or other
  misc_feature (439)..(439): n is a, c, g, or t
  modified_base (452)..(453): a, c, t, g, unknown or other
  misc_feature (452)..(453): n is a, c, g, or t
  modified_base (455)..(455): a, c, t, g, unknown or other
  misc_feature (455)..(455): n is a, c, g, or t
  modified_base (457)..(457): a, c, t, g, unknown or other
  misc_feature (457)..(457): n is a, c, g, or t
  modified_base (461)..(461): a, c, t, g, unknown or other
  misc_feature (461)..(461): n is a, c, g, or t
  modified_base (481)..(481): a, c, t, g, unknown or other
  misc_feature (481)..(481): n is a, c, g, or t
tcagagtcgagagacacgaccggtgctcgatttagctacgactgcaggggggcctaaggaagcagcactggtggtgcctcagccatggcctggaccgttctcctcctcggcctcctctctcactgcacagactctgtgacctcctatgtgctgactcagcccacccgtggtgtcgagtcggcccctggacaggacggccaggtacttacctgggtacggggaaacgacgtagttaggaaagtaagacgtgtgcgacgtaggtaccagacgagaacgccaggaccacggcccctggtcgtcgtcggtcgtacgttagtgggttgaacgtggcccggacccggcccgtcgacgggtacctccccggtggacggcgggtctccggagacggcctacgaacgttagcgtccgacncctagacncncgcggacgacgagngacngctgtactgtagnngngngtgngtgtgtgtgtgtcgtgtcgngcgcgcgcgcgcgtcgtcgcgcgacgaccgaccgaccgtacgctcctacgtcgttccgtcccgtcctccgtccgtccgtctacgtcgtcg

SEQ ID NO: 135911 - DNA, 771 bp, Homo sapiens
  misc_feature: GYAE6OF02GRQ95.49.11.A11.1.454.CMB.1.raw
  modified_base (722)..(722): a, c, t, g, unknown or other
  misc_feature (722)..(722): n is a, c, g, or t
tcagagtcgagagacacgaccggtgctcgatttagctacgactgcaggggggggcctaaggaagcagcactggtggtgcctcagccatggcctggaccgttctcctcctcggcctcctctctcactgcacagactctgtgacctcctatgtgctgactcagccaccctcggtgtcagtggccctggacagacggcaggattaccgtggtaggggggaaaacactagttagggaaaagttaaacggacttggtagacctaacgtaggtaacccaggacaaggaaagccccgaagggcccaacggggtccccccttagtcggtaccgtgggttccgttaccgtaagttggggtagtaacgttcggggaccgtaaccccgggccctacggacggggtaacctcccgtaggacgtacgtagttcctacgtcggcccttaccaaccttcggtaccggggaaccccgtcccaacccgttagaccctaacgtccgaacgggtacccggggtaagaaaccggggaacggggtaggtacgggaacgggtacccgtaaacgtttaaacgtttacccgtcggtacgtaggggttacgggttaggggaactttaggggtagggttaagggttcgggttacggtcggttacgtttcgggacgtcgggtcggggtaaccgtaggggtaccctaacggttcctaagggtcaacggaccgtaacggcccaaacccgtntcgtacacttctaccgtccctaccgtcctctactcgttacgccttacgg

SEQ ID NO: 135912 - DNA, 263 bp, Homo sapiens
  misc_feature: GYAE6OF02IXHE6.49.11.A11.1.454.CMB.1.raw
  modified_base (246)..(246): a, c, t, g, unknown or other
  misc_feature (246)..(246): n is a, c, g, or t
  modified_base (249)..(249): a, c, t, g, unknown or other
  misc_feature (249)..(249): n is a, c, g, or t
  modified_base (252)..(263): a, c, t, g, unknown or other
  misc_feature (252)..(263): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagcgtgggaccagggtcaccgtctaggtcagcccaaggcccaacccactgtcactctgttcccaccctcctctcctctcgactctgagcgggctggcaggcncanagnnnnnnnnnnnn

SEQ ID NO: 135913 - DNA, 267 bp, Homo sapiens
  misc_feature: GYAE6OF02GG70Q.49.11.A11.1.454.CMB.1.raw
  modified_base (245)..(245): a, c, t, g, unknown or other
  misc_feature (245)..(245): n is a, c, g, or t
  modified_base (250)..(267): a, c, t, g, unknown or other
  misc_feature (250)..(267): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccatgtcactctgtcccgcctctctctctcgactctggacgcgggctggacaaggcncatgnnnnnnnnnnnnnnnnnn

SEQ ID NO: 135914 - DNA, 275 bp, Homo sapiens
  misc_feature: GYAE6OF02FGIIQ.49.11.A11.1.454.CMB.1.raw
  modified_base (252)..(275): a, c, t, g, unknown or other
  misc_feature (252)..(275): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccaccctcctctctctcgactctgagcgggctggcaaggcgcatagnnnnnnnnnnnnnnnnnnnnnnnn

SEQ ID NO: 135915 - DNA, 277 bp, Homo sapiens
  misc_feature: GYAE6OF02IHS6R.49.11.A11.1.454.CMB.1.raw
  modified_base (235)..(235): a, c, t, g, unknown or other
  misc_feature (235)..(235): n is a, c, g, or t
  modified_base (247)..(247): a, c, t, g, unknown or other
  misc_feature (247)..(247): n is a, c, g, or t
  modified_base (261)..(277): a, c, t, g, unknown or other
  misc_feature (261)..(277): n is a, c, g, or t
tcagagtcgagagacacgaccggtgctcgatttagctacgactgcggggaacccggccaccctgaccatcagccgggtcgaagacggggatgaggccgactattactgtcaggtgtgggatagtagtagtgctcgttccggggtgttcggcggagggaccaagttcgaccggtcgttggtcacgcccaaggcctcgccccctcggtcactctcgttcccaccctctctctctacncctgagcggcgngcgacggcgcatannnnnnnnnnnnnnnnn

SEQ ID NO: 135916 - DNA, 606 bp, Homo sapiens
  misc_feature: GYAE6OF02GYJJN.49.11.A11.1.454.CMB.1.raw
  modified_base (328)..(328): a, c, t, g, unknown or other
  misc_feature (328)..(328): n is a, c, g, or t
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagcccaccctcggtgtcagtcggcccctggacagaccggccaggattaccgtggtagggggaaacacagttggaagtaagactgtgcacgtggtaccagcagagccaggccaggcccctgtgctggtcgtctatggtgagtcggcgacccggccctcgagggactcccgngacgcgtattctcgtggcctaccaactccgtacgggaaccccgcctacccgtcgaccagtccgacggaccgggtacggaacggacgggggatcggacggccgtaactacttacgtggttacgaggttggtagggtagttggtaggtaggttggtgttcgtcgtcggagtcgtacgggaccgaggtcctaccggtcgtaggtccaacgcccgaacgacccaacccgcgtcgtacctacctccttccgttcccacccttcctcctcctcgtccgtactcg

SEQ ID NO: 135917 - DNA, 611 bp, Homo sapiens
  misc_feature: GYAE6OF02GL0BB.49.11.A11.1.454.CMB.1.raw
  modified_base (268)..(268): a, c, t, g, unknown or other
  misc_feature (268)..(268): n is a, c, g, or t
  modified_base (271)..(273): a, c, t, g, unknown or other
  misc_feature (271)..(273): n is a, c, g, or t
  modified_base (276)..(276): a, c, t, g, unknown or other
  misc_feature (276)..(276): n is a, c, g, or t
  modified_base (279)..(279): a, c, t, g, unknown or other
  misc_feature (279)..(279): n is a, c, g, or t
  modified_base (281)..(281): a, c, t, g, unknown or other
  misc_feature (281)..(281): n is a, c, g, or t
  modified_base (283)..(284): a, c, t, g, unknown or other
  misc_feature (283)..(284): n is a, c, g, or t
  modified_base (287)..(287): a, c, t, g, unknown or other
  misc_feature (287)..(287): n is a, c, g, or t
  modified_base (289)..(289): a, c, t, g, unknown or other
  misc_feature (289)..(289): n is a, c, g, or t
  modified_base (303)..(303): a, c, t, g, unknown or other
  misc_feature (303)..(303): n is a, c, g, or t
  modified_base (308)..(308): a, c, t, g, unknown or other
  misc_feature (308)..(308): n is a, c, g, or t
  modified_base (312)..(312): a, c, t, g, unknown or other
  misc_feature (312)..(312): n is a, c, g, or t
  modified_base (323)..(323): a, c, t, g, unknown or other
  misc_feature (323)..(323): n is a, c, g, or t
  modified_base (329)..(329): a, c, t, g, unknown or other
  misc_feature (329)..(329): n is a, c, g, or t
  modified_base (331)..(331): a, c, t, g, unknown or other
  misc_feature (331)..(331): n is a, c, g, or t
tcagagtcgagagacacgaccggtgctcgattttagctacgactgcaggggaacccggccacctgaccatcagccgggtcgaagacggggatgaggccgactattactgtcaggtgtgggatagtggtagtggtgtcgtcttcggagctgggacctagggtcaccgtcctaggtcagccctaacggcccaacccatcgtcacgtctcgtcccgccctctcgtcctcgtcgacttcgtgacggcgggctcggccaaggtccgcatacgntcnnnctngcnancnncgntnacctgagcatcgancgcgngctncgtgcaacggnttaccncnctactctcgtcgtcgacgtcggtacgtacgtcgtcgtacgtcgagcgtcactgtacgcgctactacgacgactactacgtactactacgttacgtcgtcgtacgtactacgaacgtaacaacgtacgtaattacgtcgttacgtccgtacgttacggttaccgtacggttaccgtacggtaccgttacggttaccggtaccgtaacgtacggtaacggaacgtacggtacggttaaccgtacggtacgtccgtccgtaccgttaccttaccgtcgtaccg

SEQ ID NO: 135918 - DNA, 310 bp, Homo sapiens
  misc_feature: GYAE6OF02IUILI.49.11.A11.1.454.CMB.1.raw
  modified_base (203)..(203): a, c, t, g, unknown or other
  misc_feature (203)..(203): n is a, c, g, or t
  modified_base (276)..(310): a, c, t, g, unknown or other
  misc_feature (276)..(310): n is a, c, g, or t
tcagagtcgagagacacgaccggtgctcgatttagctacgactgcagggaacccggccaccctgaccattcagccgggtcgaacgacggggatgacggccgacctattacgtgtcaggtgtgggatagtggtagtggtgtcgtcttccggagctaggggaccagggtccaccgtccctaggtcaggccccaaggccaaccccntggtccatcctgttccccgcccttcctcgtctactccgacttcgagagcgggtctaggcaaggtccacatagnnnnnnnnnnnnnnnnnnnnnnnnnnnnnnnnnnn

SEQ ID NO: 135919 - DNA, 676 bp, Homo sapiens
  misc_feature: GYAE6OF02HPRWU.49.11.A11.1.454.CMB.1.raw
  modified_base (300)..(300): a, c, t, g, unknown or other
  misc_feature (300)..(300): n is a, c, g, or t
  modified_base (670)..(670): a, c, t, g, unknown or other
  misc_feature (670)..(670): n is a, c, g, or t
tcagagtcgagagacacgaccggtgctcgatttagctacgactgcagggggggcctaaaggaagcagcactggtggtgcctcagccatggcctggaccgttctcctcctcggcctcctctctcactgcacagactctgtgacctcctatgtgctgactcagccaccctggtgtcagtcggcccctggacaggacggccaggacttaccgtgggtagggggaaacacgagttaggaaagtaagactgtgcacgtggtaccagacagaacgccgaggccgacggcccctgtgcgtggtcgtntagtggtgtagcggccggacccgtcccgtagacggggcccttcccggaggacgtcgtactttccgtcgtcggaccctaccgaaccgtccgggtacccggggtaaccccgccaacccgtcgaacctacgtaccgaccggggtcccgggaaccggaaggggacggggtacgtcggacggtacccgtaagttacttacgttgtacggtagggttgtagggtagttgggtgggttaggtggttcgttcgttccgtcggtcgcggtcggaccggtacggccgtaccgtaccgtacggtcgacgcccgaaccgacccacctacgtctcctacgtccgtttcccgtcccgtccctccttcccttctccgttaccgtnttccgg

SEQ ID NO: 135920 - DNA, 754 bp, Homo sapiens
  misc_feature: GYAE6OF02H7XP2.49.11.A11.1.454.CMB.1.raw
tcagagtcgagagacacgaccggtgctcgatttagctacgactgcaggggggggcctaaggaagcagcactggtggtgcctcagccatggcctggaccgttctcctcctcggcctcctctctcactgcacagactctgtgacctcctatgtgctgactcagccaccctcggtgtcagtggcccctggacagacggccaggattaccgtggtagggggaaaacgactagttagggaagttaaagacttaggtcgcaacttcgggtaaccaggccaaggaaacgcccaacggggtcccacgggccccccttggtcgccgttgggtcgttctagtgggtagagttcgggcccggaccgggccctcggagggactcccgtgacgcgattctcgtcggcctaccacctcgtcgggaacccgcctacgtccgtgaccctatcgacggccgggtacggaagggtaccgggggctagggaccggaccgacttacttacgtcgtacgtgggttacggtggggaattagggttacgggttaggttggggttacgtttcggttccgttacgggtacggtacggtccggggtaaccgacggggttacccgtacccggttccgttaccgggtaccgtaccggacccgtaacccggggtcccccaaaccccgtcgttaccgggtaccctaacccgtttaccgtttccccggttcccccttaacccccgttccccgtttacccttcccccgtttaccgtccctaacccg

SEQ ID NO: 135921 - DNA, 260 bp, Homo sapiens
  misc_feature: GYAE6OF02G1C95.49.11.A11.1.454.CMB.1.raw
  modified_base (251)..(260): a, c, t, g, unknown or other
  misc_feature (251)..(260): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccaccctcctctctctcgactctgagcgggctggcaggcgcatagnnnnnnnnnn

SEQ ID NO: 135922 - DNA, 680 bp, Homo sapiens
  misc_feature: GYAE6OF02IGAJ9.49.11.A11.1.454.CMB.1.raw
tcagagtcgagagacacgaccggtgctcgatttagctacgactgcgagggggggcctaaggaagcagcactggtggtgcctcagccatggcctggaccgttctcctcctcggcctcctctctcactgcacagactctgtgacctcctatgtgctgactcacgccctacccgttcggtgtcgtaggtcggccccgtggacgaggaccggaccgaggtacgttaccgtagggtagggggaaaaccaacgagttagggaaaagtaacgacgtggtcgaccgtacgtcggtaaccagcagaacgcgacggccgacggcccctggtcgccgtgtcgtcttagtggtcgtagtcggccggacccggtcccgtaggagggtacctcccggtggacgcgttacttcctcgttcgtacctaccaccgtcggtaaccgggaccccgccctaaccgacgactacgtcgacggtccgggacggaagggaccgggagtggaccggaccgtaagtcgttcgtggtcgtagggtggtaggtagtggttgggttaggtggttacgtcgttcggtcggcgtggtacgggacgtcggtccgtacgtccgtacgacgtaccgaccgaaccgccccgaccgtacgtccgactaccgtcgtccttccccgtcccgtcttccgtcctccgtcgtccgttcgg

SEQ ID NO: 135923 - DNA, 832 bp, Homo sapiens
  misc_feature: GYAE6OF02IERH2.49.11.A11.1.454.CMB.1.raw
  modified_base (745)..(745): a, c, t, g, unknown or other
  misc_feature (745)..(745): n is a, c, g, or t
  modified_base (826)..(826): a, c, t, g, unknown or other
  misc_feature (826)..(826): n is a, c, g, or t
tcagagtcgagagacacgaccggtgctcgatttagctacgactgcgagggggggcctaaggaagcagcactggtggtgcctcagccatggcctggaccgttctcctcctcggcctcctctctcactgccacagactctgtacgacccttcctatgtgctgacctcacgccctaccccgttcgggtatccgacggtccggtccccctgggaccgtaacggaccggaccaagggtacctttaccggtaggggtaacgggggaaaaacctcgtaaggttagggaaacgttaaacgtccgttaggtcgacctaaccggttacgggaacccaaggaccgaaggaaaccgtccggaaccgggacccgtacccgggtcccccttggtccggtaccgttggggttcccggttacgtaacgggtgggtaacgtccgggtaccggggacccccggtaaccccgggcgtacgggtaccgtaccggttaccggtaggaaccgtgttaccgttcgcggtaccgtaccctaaccgtaccgggttacggaaccccgggaccccacctacggtaccgaaccgttacgtaccggaccggggttaccgggaaagggtaacgggacgggttacggaccgggtacggtaaccttacgttacgtacggtagggtacggtagggtcggtaaggttaggtacggggttggttggtggttcggttaccgtggtaaccggcgttacggacggccgtacgtccgtacggtnacggaccaccgaacgacctacccgaactgtccgaaccgtctacccgtaccccgtacctccgtacttccgcccgtattcccnggtacg

SEQ ID NO: 135924 - DNA, 304 bp, Homo sapiens
  misc_feature: GYAE6OF02ILCV7.49.11.A11.1.454.CMB.1.raw
  modified_base (244)..(244): a, c, t, g, unknown or other
  misc_feature (244)..(244): n is a, c, g, or t
  modified_base (262)..(264): a, c, t, g, unknown or other
  misc_feature (262)..(264): n is a, c, g, or t
  modified_base (266)..(304): a, c, t, g, unknown or other
  misc_feature (266)..(304): n is a, c, g, or t
tcagagtcgagagacacgaccggtgctcgatttagctacgactgcagggaacccggcccaccctgaccatcagccgggtcgaagacgggatgaggccgactattactgtcaggtgtgggatagtggtagtggtgtcgtcgttcggagctgggaaccagggtcaccgttcctaggtcaacgcccaaaggcccaaacccctatgtcactctagttcccaccctcctctctctcgactcgagcggtntcggcaaggcacatacgnnnannnnnnnnnnnnnnnnnnnnnnnnnnnnnnnnnnnnnnn

SEQ ID NO: 135925 - DNA, 286 bp, Homo sapiens
  misc_feature: GYAE6OF02G5L4J.49.11.A11.1.454.CMB.1.raw
  modified_base (248)..(248): a, c, t, g, unknown or other
  misc_feature (248)..(248): n is a, c, g, or t
  modified_base (254)..(286): a, c, t, g, unknown or other
  misc_feature (254)..(286): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggcccaaccccatgtcactctcgttcccacctcctctctcctcgactctgagcggtctggcaagggcncatagnnnnnnnnnnnnnnnnnnnnnnnnnnnnnnnnn

SEQ ID NO: 135926 - DNA, 565 bp, Homo sapiens
  misc_feature: GYAE6OF02G0IVA.49.11.A11.1.454.CMB.1.raw
  modified_base (315)..(315): a, c, t, g, unknown or other
  misc_feature (315)..(315): n is a, c, g, or t
  modified_base (366)..(366): a, c, t, g, unknown or other
  misc_feature (366)..(366): n is a, c, g, or t
  modified_base (422)..(422): a, c, t, g, unknown or other
  misc_feature (422)..(422): n is a, c, g, or t
  modified_base (533)..(533): a, c, t, g, unknown or other
  misc_feature (533)..(533): n is a, c, g, or t
  modified_base (547)..(547): a, c, t, g, unknown or other
  misc_feature (547)..(547): n is a, c, g, or t
tcagagtcgagagacacgaccggtgctcgatttagctacgactgcagggggggggcctaaggaagcagcactggtggtgcctcagccatggcctggaccgctctccttctgagcctccttgctcactttacaggttatgtggcctcctacgaagtgattcagccacgttccgtctcagtggccctgggacagacggccacaattacctgtgacggcgagaacaatcgaaataagaatatcactggtatacaaacaaaagcctggccacggccccttgttttcggtcctttatcgagtacttcaagtccggcccgngtcgggactcccgtggacgtcattctcgtggcctccgacggtcggggaacngggccactcagacatcatcgacgggccaggggcacgagtggacggctgactattcncgtacgacggtacgaacgaccgacctaaacttgtacagttcgtcggacgacggactaagtcgaccgtcgtacggcacgccgagcctccgccctggctacgtccgtctcccnctcctctctcgtcncctcgtcgacggcggtcg

SEQ ID NO: 135927 - DNA, 260 bp, Homo sapiens
  misc_feature: GYAE6OF02I29LL.49.11.A11.1.454.CMB.1.raw
  modified_base (249)..(260): a, c, t, g, unknown or other
  misc_feature (249)..(260): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccgcctctctctctcgactctgagcgggctggcaggcgcatagnnnnnnnnnnnn

SEQ ID NO: 135928 - DNA, 684 bp, Homo sapiens
  misc_feature: GYAE6OF02IE4KT.49.11.A11.1.454.CMB.1.raw
  modified_base (633)..(633): a, c, t, g, unknown or other
  misc_feature (633)..(633): n is a, c, g, or t
tcagagtcgagagacacgaccggtgctcgatttagctacgactgcaggggggggcctaaggaagcagcactggtggtgcctcagccatggcctggaccgttctccctcctcggcctcctctctcactgcacagactctgtgaccttctatgtgctgactcacgccacccgtcggtgtcaggtcggcccctggacaggacggccagggtattaccgtgggtagggggaaaactcagtttacgggaagttaaacgacgtggtacgcacgtggtaccagccgaggaacgccgaacggccacggcccctgtcggcgtggtctctagtggtgagtcggccggacccggccctcggacgggtactcccgtgacgcgtattcgcgtggcctaccgaactcggtaccggggaccccgcctaacccgtagaccctacgtccgacgggccggggttaacggaacggggtacggggatacgggaaccgggtaccgtaacttacgttacgtcggtacggtagggttcggtacggggtaattaggggttaggtacgggttgggttcgttcggttcgttacgggagtcgggtacgggcgtacgggtcctaccgtcgtaggtcacgtacccgacggaccctaacccgntacgacctacgtccttcctacccgcctccttacctccgtccgtactctcgg

SEQ ID NO: 135929 - DNA, 279 bp, Homo sapiens
  misc_feature: GYAE6OF02FN3HG.49.11.A11.1.454.CMB.1.raw
  modified_base (210)..(210): a, c, t, g, unknown or other
  misc_feature (210)..(210): n is a, c, g, or t
  modified_base (257)..(279): a, c, t, g, unknown or other
  misc_feature (257)..(279): n is a, c, g, or t
tcagagtcgagagacacgaccggtgctcgatttagctacgactgcagggaacccggccaccctgaccatcagccgggtcgaagacgggatgaggccgactattactgtcaggtgtgggatagtggtagtggtgtcgtcttcggagctgggaccagggtcaccgtcctagggtcagcccaaggccaacccccatgtcactctcgttccccncctcctctctctcgacttctgacgcgggtctggcgaggcgacatagnnnnnnnnnnnnnnnnnnnnnnn

SEQ ID NO: 135930 - DNA, 262 bp, Homo sapiens
  misc_feature: GYAE6OF02FMIP0.49.11.A11.1.454.CMB.1.raw
  modified_base (246)..(246): a, c, t, g, unknown or other
  misc_feature (246)..(246): n is a, c, g, or t
  modified_base (251)..(262): a, c, t, g, unknown or other
  misc_feature (251)..(262): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggcccaaccccatgtcactctgttcccgccctcctctctctcgactctgagcgggctggcaagcgnatagnnnnnnnnnnnn

SEQ ID NO: 135931 - DNA, 764 bp, Homo sapiens
  misc_feature: GYAE6OF02HA71E.49.11.A11.1.454.CMB.1.raw
tcagagtcgagagacacgaccggtgctcgatttagctacgactgcgagggggggcctaaggaagcagcactggtggtgcctcagccatggcctggaccgttctcctcctcggcctcctctctcactgcacagactctgtcgacctcctatgtgctgactcagcccacccgttggtgtcagtcggcccctgggaacaggaccggccaggtactttaccgtgggtaacgggggaaaacacgtaagtttagggaaagtaagacgttggtcgaccgtaacgttcgggtaacccaggaccaaacggtaaaccgcccgaaacgggcccaacggggtcccccttggtcgtccgtacgggttccgtctaaggtgggttacgagtcgggacccgaccccggtcccgtacggaacggggtccttcccgtaggacgtcgtacgttctcgtcggacctcaacgtcggtaccgggaccccgcctaccgtcgacctacgtacgacgggtccggtaacggaacgggacgggtagtcggaccggtaccgtaacgttacttacgtacggtcggtagggtgggtacgggtaagttcgggttagggttacgggttcggttaccggttccggttcgtacgggaccggttacgggcgggtaacccggtgggtaccctacgggttccgaacggtccgaaccgtacccgacgacccccgaccgtgtccggtacctacgtcccgttaccgtcccacccgttcctaccgttccgtactccgtactccgg

SEQ ID NO: 135932 - DNA, 281 bp, Homo sapiens
  misc_feature: GYAE6OF02IRFTO.49.11.A11.1.454.CMB.1.raw
  modified_base (246)..(246): a, c, t, g, unknown or other
  misc_feature (246)..(246): n is a, c, g, or t
  modified_base (251)..(281): a, c, t, g, unknown or other
  misc_feature (251)..(281): n is a, c, g, or t
tcagagtcgagagacacgaccggtgctcgatttagctacgactgcagggaacccggccaccctgaccatcagccgggtcgaagacgggggatgaggccgactattactgtcaggtgtgggatagtggtagtggtgtcgtcttcggagctgggaccagggtcaccgtcctaggtcagcccaaggccaaccccactgtcactctgttcccgcctcctctctctcgactctgagcgggctggcaaggcncatgnnnnnnnnnnnnnnnnnnnnnnnnnnnnnnn

SEQ ID NO: 135933 - DNA, 338 bp, Homo sapiens
  misc_feature: GYAE6OF02FXL6D.49.11.A11.1.454.CMB.1.raw
  modified_base (194)..(194): a, c, t, g, unknown or other
  misc_feature (194)..(194): n is a, c, g, or t
  modified_base (260)..(260): a, c, t, g, unknown or other
  misc_feature (260)..(260): n is a, c, g, or t
  modified_base (262)..(262): a, c, t, g, unknown or other
  misc_feature (262)..(262): n is a, c, g, or t
  modified_base (265)..(265): a, c, t, g, unknown or other
  misc_feature (265)..(265): n is a, c, g, or t
  modified_base (269)..(269): a, c, t, g, unknown or other
  misc_feature (269)..(269): n is a, c, g, or t
  modified_base (277)..(331): a, c, t, g, unknown or other
  misc_feature (277)..(331): n is a, c, g, or t
  modified_base (333)..(338): a, c, t, g, unknown or other
  misc_feature (333)..(338): n is a, c, g, or t
tcagagtcgagagacacgaccggtgctcgatttagctacgactgcgagggaacccgggccaccctgaccatcagccgggtcgaagacggggatgaggccgactattactgtcaggtgtgggatagtggtagtggtgtcgttgttcggagctgggacctagggtcaccgtcctaggtcagcccaaggccaacccntgtcactctgttcccgcctcctctctctcgactctgacggccgggctcggcaagggccactatagntncgntganctatgatnnnnnnnnnnnnnnnnnnnnnnnnnnnnnnnnnnnnnnnnnnnnnnnnnnnnnnngnnnnnn

SEQ ID NO: 135934 - DNA, 264 bp, Homo sapiens
  misc_feature: GYAE6OF02GBOYJ.49.11.A11.1.454.CMB.1.raw
  modified_base (246)..(246): a, c, t, g, unknown or other
  misc_feature (246)..(246): n is a, c, g, or t
  modified_base (252)..(264): a, c, t, g, unknown or other
  misc_feature (252)..(264): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggcccaaccccactgtcactctcgttcccaccctcctctctctcgactctagagcggctgcaggcncatagnnnnnnnnnnnnn

SEQ ID NO: 135935 - DNA, 270 bp, Homo sapiens
  misc_feature: GYAE6OF02F2OY3.49.11.A11.1.454.CMB.1.raw
  modified_base (252)..(270): a, c, t, g, unknown or other
  misc_feature (252)..(270): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccatgtcactctcgttcccgccctcctctctctcgactctgagcgggctggcaaggcgcatagnnnnnnnnnnnnnnnnnnn

SEQ ID NO: 135936 - DNA, 266 bp, Homo sapiens; identical to SEQ ID NO: 135032
  misc_feature: GYAE6OF02GEXO3.49.11.A11.1.454.CMB.1.raw
  modified_base (252)..(266): a, c, t, g, unknown or other
  misc_feature (252)..(266): n is a, c, g, or t

SEQ ID NO: 135937 - DNA, 282 bp, Homo sapiens
  misc_feature: GYAE6OF02F8LPT.49.11.A11.1.454.CMB.1.raw
  modified_base (251)..(252): a, c, t, g, unknown or other
  misc_feature (251)..(252): n is a, c, g, or t
  modified_base (254)..(282): a, c, t, g, unknown or other
  misc_feature (254)..(282): n is a, c, g, or t
tcagagtcgagagacacgaccggtgctcgatttagctacgactgcagggaacccggccaccctgaccatcagccgggtcgaagacggggatgaggccgaactattactgtcaggtgtgggatagtggtagtggtgtcgtcttcggagctgggaccagggtcaccgtctaggtcagcccaaggccaaccccatgtcactctgttcccgcctcctctctctcgactctgagcgggctggcaaggcgacatagnnannnnnnnnnnnnnnnnnnnnnnnnnnnnn

SEQ ID NO: 135938 - DNA, 266 bp, Homo sapiens
  misc_feature: GYAE6OF02IGHN8.49.11.A11.1.454.CMB.1.raw
  modified_base (191)..(191): a, c, t, g, unknown or other
  misc_feature (191)..(191): n is a, c, g, or t
  modified_base (251)..(266): a, c, t, g, unknown or other
  misc_feature (251)..(266): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtctaggtcagcccaaggcccaaccccntgtcactctcgtcccaccctcctctctcgtcactctgagcgggctggcaaggcacatagnnnnnnnnnnnnnnnn

SEQ ID NO: 135939 - DNA, 267 bp, Homo sapiens
  misc_feature: GYAE6OF02JICZH.49.11.A11.1.454.CMB.1.raw
  modified_base (228)..(228): a, c, t, g, unknown or other
  misc_feature (228)..(228): n is a, c, g, or t
  modified_base (233)..(233): a, c, t, g, unknown or other
  misc_feature (233)..(233): n is a, c, g, or t
  modified_base (242)..(242): a, c, t, g, unknown or other
  misc_feature (242)..(242): n is a, c, g, or t
  modified_base (248)..(267): a, c, t, g, unknown or other
  misc_feature (248)..(267): n is a, c, g, or t
tcagagtcgagagacacgaccggtgctcgatttagctacgactgcagggaacccgccaccctgaccatcagccgggtcgaagacggggatgaggccgactattactgtcaggtgtgggatagtggtagtggtgtcgtcttcggagctgggaccagggtcaccgtcctaggtcagcccaaggcccaaccccatgtcactctcgttcccacctcctctctctcactctgngcggntggcaggcncatagnnnnnnnnnnnnnnnnnnnn

SEQ ID NO: 135940 - DNA, 817 bp, Homo sapiens
  misc_feature: GYAE6OF02IPNLP.49.11.A11.1.454.CMB.1.raw
  modified_base (350)..(350): a, c, t, g, unknown or other
  misc_feature (350)..(350): n is a, c, g, or t
tcagagtcgagagacacgaccggtgctcgatttagctacgactgcaggggggggcctaaggaagcagcactggtggtgcctcagccatggcctggaccgttctcctcctcggcctcctctctcactgcacagactctgtcgacctctatgtgctgactcacgcccacccgttcggtgtcgaggttccggcccctagggacgacggaccgggaccctaaggtaccttaccgtggggtaacgggggaaacacgtagttagggaacgtaagactgtgaccacgttacggtaccgagacgaacgaacgccgacggacccgacggcccctggtcgcgtggtccgttactagtggngtacgtcgggaccggaccggtccgtacggaggccttccgtaggacgcgtacttcgacgtcgcctaccctaacggtccggtaccgggaccccgtaccctaccgtcgtaacctacgtaccgacggggaccgggtaacggaaacgggggaccggggtaaggtacgggaaccgggtaacccggtaaccgttaaccgtttaacggtacggtacggtacgggttgggttacgggtaagggttacgggttagggtttacgggtacgggttcgggttccggtttaccgggtcgggtacgggtccgggttacgggtaccggtacgggtcccgtaccggttaccgttacgggtacgaacccggtaaccggaacccgtacccgaacccgtaccggtccgttacccgtacgttcccgttaacccgttcccctaacccgttccctttacccgtacccgttccgttacccggtctaccggg

SEQ ID NO: 135941 - DNA, 799 bp, Homo sapiens
  misc_feature: GYAE6OF02HMZ8I.49.11.A11.1.454.CMB.1.raw
tcagagtcgagagacacgaccggtgctcgatttagctacgactgcaggggggggcctaaggaagcagcactggtggtgcctcagccatggcctggaccgttctcctcctcggcctcctctctcactgcacagactctgtgacctctatgtgctgactcagccaccctggtgtcagtcggcccctggacagacggccaggattaccgtggtagggggaaacgactagttaggaagtaaagactgtgcacgtggtaccagcagaacgcgaggcccacggcccctgtgcgtcggtcgtactagtgggtagaggtcggaccggaccccggcccgtacgacgggggtactccccggtggacggtacgtacttccgttacggtcggtcctacccgaacgttccggacgggtaacccccgccgtaaccctcggaacctactacgaccggggtacccgggtaacggaaagggtaccggggtagacggacgggtacccgtaaacgttactttaccggttggtaccgtaggggtttcggaagggggtacgttacgggttaaggggttacggttgggttacgggttcccggtttaggtacccggggtacgtcggttaaccgggggggtccgtaaccgggggttcctaacccggttccgggttaaaccggtcgtaaccccgggaacccgaaccccggggtacccccaaaccccgttacggtaccgtacccgttaccttaccggttccccggtttcccccgtaccccccttcgtcccgttaacccgttccggtacccgtaccgttacccggg

SEQ ID NO: 135942 - DNA, 709 bp, Homo sapiens
  misc_feature: GYAE6OF02FOFLQ.49.11.A11.1.454.CMB.1.raw
  modified_base (177)..(177): a, c, t, g, unknown or other
  misc_feature (177)..(177): n is a, c, g, or t
  modified_base (653)..(653): a, c, t, g, unknown or other
  misc_feature (653)..(653): n is a, c, g, or t
tcagagtcgagagacacgaccggtgctcgatttagctacgactgcaggggggggcctaaggaagcagcactggtggtgcctcaggccatggcctggaccgttctcctcctcggcctcctctctcactgcacagactctgcgacctcctatgtgctgactcacgcccaacccttggtntacgaggttccggccccgtaggaaccacgggaccggaccaagggtacttaccgtggggtacgggggaaaacctacgtaggtttagggaaaagttacgacttggtcgactaacgttcggaccagacgaaagtacgcccgaggacccgacggtccccttggacgtcgtgggttacgttacttaggtcggtacgtacgtccggggaccgtaccccggtcctacggcgggaccttccgaggacggtctactttcgcgtcggaccctcctaaggtccggtacggggaccccgacctaccgtctaaccgaccgtacggcggtacccgggtaaggaaccgggtggacggtagacccggtactaacgttactcggtcgtacggagggttggacggtagtaaggtcggtagttagggtcttcggttacgcggttacggcggtacggcgtcgaccgtcgtccgacgtcgacgacccgacgtacccncgacttcgacctacgtccaccgttaccctctcctaccgttccacgtccgtactcgg

SEQ ID NO: 135943 - DNA, 602 bp, Homo sapiens
  misc_feature: GYAE6OF02HHTGL.49.11.A11.1.454.CMB.1.raw
  modified_base (298)..(298): a, c, t, g, unknown or other
  misc_feature (298)..(298): n is a, c, g, or t
  modified_base (420)..(420): a, c, t, g, unknown or other
  misc_feature (420)..(420): n is a, c, g, or t
  modified_base (443)..(443): a, c, t, g, unknown or other
  misc_feature (443)..(443): n is a, c, g, or t
tcagagtcgagagacacgaccggtgctcgatttagctacgactgcaggggggggcctaaggaagcagcactggtggtgcctcagccatggcctggaccgttctcctcctcggcctcctctctcactgcacagactctgtgacctcctatgtgctgactcagccaccctcggtgtcagtcggcccctggacagacgccaggattacctggtagggggaaacacattagggaagtaagactgtgcacgtggtaccagcagaagccgaggccacggcccctgtcgctggtctctagtggtnagtggccgacccggtcctcgagggactccgtgacgcgtattctcgtcggcctacccaacgtccgtacgggaacccccgccacccgtgaccataccgacggtcccgggtagaacggacgggtntacggacggcgtaactagttacngtacgcggtggtggataggtggtgtggtgttcgtcgtcggagtccgtagggaccgtacggtcaccggttcgtacggcacgtacccgaagcccaacccgtcgtcacctaccgttccgtcccgttaccccacccttcctccgtacgtcctaccgcttacgg

SEQ ID NO: 135944 - DNA, 729 bp, Homo sapiens
  misc_feature: GYAE6OF02FNNKO.49.11.A11.1.454.CMB.1.raw
tcagagtcgagagacacgaccggtgctcgatttagctacgactgcagggggggggcctaaggaagcagcactggtggtgcctcagccatggcctggaccgttctcctcctcggcctcctctctcactgcacagactctgtgacctcctatgtgctgactcagccaccctcggtgtcagtggcccctggacagacggccaggattacctggtgggggaaacacattggaagtaagactgtgcatggtaccagcagaagccaggccaggcccctgtgctggtcgtctagtgggtgatgggccgacccggccctacgacggggtactccccgtggaacgccggtagttctacgtcgggcctacccaaacgtccgtaccgggggaaaccccggccctaacccgtcgaacctactccgacgggtcccggggttacgaaacggggtacgggggtaatcgggaacgggacccgtaacgttaagttaaccgtggttaccggagggttaggtaggggtaacttagggttgggtaacgtttcgggtacggttcggtacgtttcgggacgtcgtacggggacctacggggttaccacccggttaccgttaacgggtccaacgggaccccgtaaacgggccccaaaccccgtacgttacggtaccctaaccgttccgttacccgttaccccccgttaaccccttccgttaaccctcctttcccgtaccgtaccgttaccgg

SEQ ID NO: 135945 - DNA, 305 bp, Homo sapiens
  misc_feature: GYAE6OF02HTGJ3.49.11.A11.1.454.CMB.1.raw
  modified_base (227)..(227): a, c, t, g, unknown or other
  misc_feature (227)..(227): n is a, c, g, or t
  modified_base (263)..(305): a, c, t, g, unknown or other
  misc_feature (263)..(305): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagccccaaggcccaaccccactcgtcacttctcgttccccaccctcctctctcnccgtactcgtgacgcgggctgggcaaggcgcaatgnnnnnnnnnnnnnnnnnnnnnnnnnnnnnnnnnnnnnnnnnnn

SEQ ID NO: 135946 - DNA, 678 bp, Homo sapiens
  misc_feature: GYAE6OF02H6O8J.49.11.A11.1.454.CMB.1.raw
  modified_base (537)..(537): a, c, t, g, unknown or other
  misc_feature (537)..(537): n is a, c, g, or t
tcagagtcgagagacacgaccggtgctcgatttagctacgactgcaggggggggcctaaggaagcagcactggtggtgcctcagccatggcctggaccgttctcctcctcggcctcctctctcactgcacagactctgtgacctcctatgtgctgactcacgccctaccctcggtgtcaggtcggcccctaggacacggacggccaggtacttaccgtggtacgggggaaaacgactagttagggaaagttaagacttggcgcacgtcggtaccagcgaggaagccgacggccgacggcccctgcgcgtggtcgtctagtggtcgagtcgggccgacccggccctcgagggctcccgtgacgcgtattcgtcgtcgcctaccactcggtacggaaccccgcctaccctcgaccacgtccgacggtaccggggacgaacgggacggggtactacgggacggaccgtacttaacgttacgtcgtacggtagggtgggtgggagttaggtgggttaggttggtggttcgttcggttcggnggtccggtacgggaccggacggttaccggaccgttcgacggtaccgaccgacccggaaccgtacccaaccccgacgtcgtccctacgttcccgtccgttcccccgtcccttcccttccgtccgtaccgtccgtacgtccgg

SEQ ID NO: 135947 - DNA, 784 bp, Homo sapiens
  misc_feature: GYAE6OF02JD4XZ.49.11.A11.1.454.CMB.1.raw
  modified_base (209)..(209): a, c, t, g, unknown or other
  misc_feature (209)..(209): n is a, c, g, or t
  modified_base (772)..(772): a, c, t, g, unknown or other
  misc_feature (772)..(772): n is a, c, g, or t
tcagagtcgagagacacgaccggtgctcgatttagctacgactgcaggggggggcctaaggaagcagcactggtggtgcctcagccatggcctggaccgttctcctcctcggcctcctctctcactgcacagactctgtgacctcctatgtgctgacctcagcccaccctcggtgtcagtcggccctggacagacggcaggattaccgnggtacggggaaactacattggaagtaagctgtgcacgtcggtaccagcagaagccgaggccgacggcccctgtcgctggtcctgtagtggtgagtcggaccggaccggtcccgtcggtaacggggaccttcccgtaggacggaccggtacgtttcctccgttccgggccttaccctaaacggttcccggtaacccgggggtaaccccgaccccgtacccgttaccgaccctaacgtccggtaaccggacccggggtaacggaacgggaaccgggggtagtacggtacgggcccgtacgtttaacgtttacggtgttaccgaagggttcgggtacgggtaagttacgggttagggttagggttacgggttccgtttacgggttaccggtcggggtaaccgttccgggtaaccggggaccgtacggggtacccgtacccgggtttaccgtacgggttaccggaaccgaccccggtaacgggacccccgtaaccgtaccggtcctaaccgtcccgttacccgttccgtaccccccgtctttccccttaccgtcccttaccgttccnccggttacccgg

SEQ ID NO: 135948 - DNA, 284 bp, Homo sapiens
  misc_feature: GYAE6OF02FN4V2.49.11.A11.1.454.CMB.1.raw
  modified_base (235)..(235): a, c, t, g, unknown or other
  misc_feature (235)..(235): n is a, c, g, or t
  modified_base (252)..(284): a, c, t, g, unknown or other
  misc_feature (252)..(284): n is a, c, g, or t
tcagagtcgagagacacgaccggtgctcgattttagctacgactgcaggggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccatgtcactctgttcccaccctctctctctcgactctgagcggntggcaagcgcagtagcnnnnnnnnnnnnnnnnnnnnnnnnnnnnnnnnn

SEQ ID NO: 135949 - DNA, 272 bp, Homo sapiens
  misc_feature: GYAE6OF02G4KVJ.49.11.A11.1.454.CMB.1.raw
  modified_base (258)..(272): a, c, t, g, unknown or other
  misc_feature (258)..(272): n is a, c, g, or t
tcagagtcgagagacacgaccggtgctcgatttagctacgactgcggggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaacccccatgtcactctgttccccgccctcctctctctcgacctctggagcgggctggacaaggcgtcaatagnnnnnnnnnnnnnnn

SEQ ID NO: 135950 - DNA, 798 bp, Homo sapiens
  misc_feature: GYAE6OF02I4QZZ.49.11.A11.1.454.CMB.1.raw
  modified_base (424)..(424): a, c, t, g, unknown or other
  misc_feature (424)..(424): n is a, c, g, or t
tcagagtcgagagacacgaccggtgctcgatttagctacgactgcagggggggggcctaaggaagcagcactggtggtgcctcagccatggcctggaccgttctcctcctcggcctcctctctcactgcacagactctgtgaccctcctatgtgctagactcacgcccacccgttcggttgtcaggtccgggccccctaggaccacgggaccggaccgaaggtacgtttaccgtgggtacgggggaaaacacgtagttagggaagtaagactgtcgctacgtcggtaccagacaaggaacgccgaacggccacggcccccttaggtcgcgttggtccgttctaggttcggtaggacgttggggacccgaccccggacccgtcgggacgggtaccttccccgtaggaccgtcggtaacttttccnggttccgtacctaccaacgttcgggaaccggggtacccccgcccgtacccgtacgaacctacgtaccggaccgggaccggggttaccgaaacgggggaccgggtaaggtacgggaccggaccggttaacgttacgttacgtacgtcggagggtgggtgggtagttacgggttaggtttaggttgggttcggttcggtttccggttcgggtacggtccggtagggtacccggtacgggtcccggtaccgtaccggttaccggtacggaccgtacccgtaaccggacccctaacccgtaccgtacggttacctaccgttcccttacccgttcccccttaccctccttacccgtccttaccgtcccgtacgttcccg

SEQ ID NO: 135951 - DNA, 745 bp, Homo sapiens
  misc_feature: GYAE6OF02GCVQJ.49.11.A11.1.454.CMB.1.raw
  modified_base (232)..(232): a, c, t, g, unknown or other
  misc_feature (232)..(232): n is a, c, g, or t
  modified_base (326)..(326): a, c, t, g, unknown or other
  misc_feature (326)..(326): n is a, c, g, or t
  modified_base (713)..(713): a, c, t, g, unknown or other
  misc_feature (713)..(713): n is a, c, g, or t
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagccaccctcggtgtcagtggccacgtggacaggaccggcccaagggactttaccgtggtaggggggaaaaccnctagtttagggaaaagttaacggacttggtgaccacttgggtaccagcaagaaacgccaggccacggcccctggtctcgtggtcgtctagtggngagtggccgaccggccctacgacgggtactcccgtgacggcgtacttccgtcgtcggcctacccgtaacgttccggtaacccgggggaaacccccggtccccaacccgtcggaaccctaacgttccgaacggggtacccggggtaaccggaaacggggaccgggggtaataccgggaccgggaccctaacggttaacgtttaccgtggtacggtacgggttgggtaggggtaacttagggtggttaggttgggtacgttccggtttccggttacgggacgtcgggtacgggaccgtaagggtcctaacccgggtccgtagggtaccaccggacccaccggtaccccgaacccctcgttacgaccctaccttccgtcccgttcccccnccgttccctccgttccgtcccgtacgtacccg

SEQ ID NO: 135952 - DNA, 772 bp, Homo sapiens
  misc_feature: GYAE6OF02JJ6AY.49.11.A11.1.454.CMB.1.raw
  modified_base (273)..(273): a, c, t, g, unknown or other
  misc_feature (273)..(273): n is a, c, g, or t
tcagagtcgagagacacgaccggtgctcgatttagctacgactgcaggggggggcctaaggaagcagcactggtggtgcctcagccatggcctggaccgttctcctcctcggcctcctctctcactgcacagactctgtcgacctcctagtgtgctgactcacgcctacccgtcggtgcaggtcggccccgtaggacagtacggcctaggtacttcgtgggtaggggaaacactagttagggaaagtaaggacttggtctactacgtggaccngacaagacgccgacggccgaccggtcccgtgttccgtagactacgttaattaacgtaaacgtacgtttaggaacggtacgggtccgtaccggaaccgggtccccgtaggacgtaccggttactttaccgtcggttaaccggtcctaccgtactaccttacggaacggaccgaacaaccggttaagtacccggtaagttaaccgtacctaacgtacgtacggtacgggtaacggtccgggtaagacggaacgggaaggtcggtacgtacgtacgttaacgttagaccgtagtaccgttaacgacgttacgaaggtaacgttacgggtacggtaccgttaccgttacgtttacgtcgtttacgttacgggtaccgggtaacgggacgttaccgagttaccgtacggtaccggtaccgtacggtacgtaacccggtacccggtaccgtaccgtcccgggtacccttacggttaccgtacccttccggtaccccgttcccccg

SEQ ID NO: 135953 - DNA, 267 bp, Homo sapiens
  misc_feature: GYAE6OF02IO1LD.49.11.A11.1.454.CMB.1.raw
  modified_base (138)..(138): a, c, t, g, unknown or other
  misc_feature (138)..(138): n is a, c, g, or t
  modified_base (243)..(243): a, c, t, g, unknown or other
  misc_feature (243)..(243): n is a, c, g, or t
  modified_base (249)..(267): a, c, t, g, unknown or other
  misc_feature (249)..(267): n is a, c, g, or t
tcagagtcgagagacacgaccggtgctcgatttagctacgactgcagggaacccggccaccctgaccatcagccgggtcgaagacgggatgaggccgactattactgtcaggtgtgggatagtggtagtggtgtcgtnttcggagctgggaccagggtcaccgtcctaggtcagcccaaggccaaccccatgtcactctgttcccacctcctctctctcgactctgagcgggctggcaaggcncatagnnnnnnnnnnnnnnnnnnn

SEQ ID NO: 135954 - DNA, 909 bp, Homo sapiens
  misc_feature: GYAE6OF02JMOLS.49.11.A11.1.454.CMB.1.raw
  modified_base (175)..(175): a, c, t, g, unknown or other
  misc_feature (175)..(175): n is a, c, g, or t
tcagagtcgagagacacgaccggtgctcgatttagctacgactgcaggggggggcctaaggaagcagcactggtggtgcctcagccatggcctggaccgttctcctcctcggcctcctctctcactgcacagactctgtcgacctcctatgtgctgactcagcctaccctcggtntcagtcggcccctggacacggaccggccaggtacttaccgtgggtacgggggaaaccgactagttagggaaacgtaagacgtgtcgctacgtacggtaccagcagaacgccgaggaccacggcccctggtcgcgttggtccgttctagttgggtggtacgtcgggtacccggaccccggtcccgtacggaacggggtaccttaccccggtaggaacggttaccgtacgttttccgtaccgttacgggtcccttaaccccgaacggtttcccggggtaaccgggggtaaacccccccgggtcccctaaaccccggtacgggtaaacccttaaccgttaaccccgggaacccgggggtaaccccggggttaaaccggggaaaccggggttaacccggggggaactttaccgggggaaaccggggttaccccgttaaacgtttaacccggtttaccggttcgggttaaccggtagggggttacgggtttaacggggaacgtttacggggttacgggttacggttcgggggttaccgtccggtttaccgggttcgggaaccgggtccgttacggggaaccggtacgggttacccggtaccgtttaccggtaggtacccgacgggaccccgtacgggacccccttaaccggtccgttccggtaccttccggtccttaaccccggttccccgtacccctttcccgtccttaccccggttccgttacccgtacgtcccggg

SEQ ID NO: 135955 - DNA, 282 bp, Homo sapiens
  misc_feature: GYAE6OF02FJCVH.49.11.A11.1.454.CMB.1.raw
  modified_base (252)..(252): a, c, t, g, unknown or other
  misc_feature (252)..(252): n is a, c, g, or t
  modified_base (258)..(282): a, c, t, g, unknown or other
  misc_feature (258)..(282): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagcgtgggaccagggtcaccgtccaggtcagcccaaggcccaaccccatcgtcactctgttccccaccctcctctctcgtcgacctctgacgcgggctggcaacggcncatagnnnnnnnnnnnnnnnnnnnnnnnnn

SEQ ID NO: 135956 - DNA, 753 bp, Homo sapiens
  misc_feature: GYAE6OF02HL4Q0.49.11.A11.1.454.CMB.1.raw
  modified_base (127)..(127): a, c, t, g, unknown or other
  misc_feature (127)..(127): n is a, c, g, or t
  modified_base (232)..(232): a, c, t, g, unknown or other
  misc_feature (232)..(232): n is a, c, g, or t
  modified_base (716)..(716): a, c, t, g, unknown or other
  misc_feature (716)..(716): n is a, c, g, or t
tcagagtcgagagacacgaccggtgctcgatttagctacgactgcaggggggggcctaaggagcagcactggtggtgcctcagccatggcctggaccgttctcctcctcggcctcctctctcactcncgacagactctgtcgacctcctatgtgctgactcagtccaccgtggtgtcagtcggccctggacagaccgggcaagggtacttaccgtgggtacgggggaaaacnctagttacggaacgtaaggactggtagtcgtaacgttgggtaaccagtacaaggaacgacgaacggccgtaacggccccgttggtcgacttcggtcgtactaggtcggtagacgttacggccggtaacccgggtccctacggtacgggtacctcccggtagtacggtcgtacgttctacggtcggtacctaccgtaaaccgttcggtaaccggggaaccccgtccaaccgttacgaacgtactaccgtacgggccgggtacggaacgggaccggggtataacggacggtaccgaacgttaacgttacgtcgtacggagggttcggtagggtagtacgggttagtaggttcgggttagtcggttcgttacgggtaacgtcggtacgggtaccgtacgggtacctaccgggttcgtacgggtacgaaccggtccgaacggccctaacccgtaacgtcgtacctacggtaccttccgggttaccccnccttaccggttcctccgttacctacgtacccttacgg

SEQ ID NO: 135957 - DNA, 791 bp, Homo sapiens
  misc_feature: GYAE6OF02JBUKI.49.11.A11.1.454.CMB.1.raw
  modified_base (750)..(750): a, c, t, g, unknown or other
  misc_feature (750)..(750): n is a, c, g, or t
tcagagtcgagagacacgaccggtgctcgatttagctacgactgcaggggggggcctaaggagcagcactggtggtgcctcagccatggcctggaccgttctcctcctcggcctcctctctcactgcacagactctgtgacctcctatgtgctgactcagcccaccctcggtgtcaggtcggcccctggacaggaccggccaagggtacttaccgtgggtagggggaaaacgactaagttagggaaagtaaggacgtggtacgccaacgttggtaccaagcaaggaaggcccgaagggcccaacgggtcccctggtcgtcgttcgggtccgtactagtgggtgacgtcgggaccggtacccggcccgtcgacgggtacctcccgtaggacgtcgtacttccgtcgtcgggtaccctaccgtaaccgtccgggtacccggggaaacccccgtcccgtaaccccgtacggaccctagtacccggaccgggtacccggggtaacggaaacggggcggggtaaggtcgggaaccgggtacccgtaacgttaacgttaccgtggtaccgtaggggttggtagggtacgttaaggttcgggtagttcgggtcgttccggttaccggtgggcggtaccgggtacgggaccggttacgggtaccgtacccgttacgggttaacggccgtaaccggacccgtaaccggaccccaaaccccgtgttacccgtacctaccgttccgttcccggtttccccnccccgttcccttaccgtcccttcccgtacccgtcttaccgg

SEQ ID NO: 135958 - DNA, 838 bp, Homo sapiens
  misc_feature: GYAE6OF02FPRQJ.49.11.A11.1.454.CMB.1.raw
  modified_base (230)..(230): a, c, t, g, unknown or other
  misc_feature (230)..(230): n is a, c, g, or t
tcagagtcgagagacacgaccggtgctcgatttagctacgactgcagggggggcctaaggaagcagcactggtggtgcctcagccatggcctggaccgttctcctcctcggcctcctctctcactgctacagactctgtgacctcctatgtgctgactcagccacccgtcggtgtcagtcggcccctggacagaccggccaaggtacttaccgtggtagggggaaaaccnctacgttgggaaagttaacgacttggtctaacgacgtcgggtaaccagccgtaacggaacgcccgaggacccgtacggcccccttggtacgtcgttcgggtccgttaccgttagtcgggtagtacgttcggggaccggtaaccccggtcccttacggaacggggtacttccccgtaggtacgcggttattacccggtcgttacggccgtacctaacgtaccgggtaccccggggaaccccgtaccctaccccgacgtaccctacgtacgacccgggtaccgggtaggaaacggtacggggatcgggacggaccgtaacgtacgtttaccgtgtaaccgtcggttacgggtacggacgttaagggttacgtacgggtagttacgtaaccgttggtttaacggtcggggttacgggttaccggggtacggggtaaaccgggtaccgaaacgttcccgggttaaaccggacccggttacgttacccgggtcgtacccggaaccccggacgggtttcccgacccccgtttacccggggtccctaacgtccccgggtttcccgttaccggtttcccccccggttacccttcccgttacccttccgttaccccg

SEQ ID NO: 135959 - DNA, 790 bp, Homo sapiens
  misc_feature: GYAE6OF02F0JIE.49.11.A11.1.454.CMB.1.raw
tcagagtcgagagacacgaccggtgctcgatttagctacgactgcagggggggcctaaggaagcagcactggtggtgcctcagccatggcctggaccgtttctccctcctcggcctcctctctcactgcacagactctgtcgcctcctatggtgctgactcacgccctacccgtggtcgtcgtaggtccgccccgtaggacgacggaccggccgaaggtacttaccgtgggtacgggggaaaactactagtacggaaagtagacgtgtacgactacgtacggtaccaggtacgaacggaacgacccgaggtaccccgacgggaccccttggtcgtcgttcggtcgtcgttaaggttcggtaggtacggtcgggacccggaccccggtacccgtcggtaacggggtacctcccggtagggacgtcgtacttcgtccgtcgtcctaccgtaaccgtccggtaaccgggaccccgccgtaaccctcggaacctacgtacgccgggtacccggtaacggaacgggacgggtagtacggaccggtaccgtaactacgttacgtacgtacggtaggttggtggtaaggttgggttacggaggttcgggttacggtacgtttaccggtcggggtacgtcgggtacgggtacccgtaggggttaccccgtaccgggttagtaccggtaccgtaccgaacccgtaccggaacccacccgttacgtcggttaacccgtccgttcccgtaccgttcccccgtcccgttacccttcccgtcctcccggttccgacttccggg

SEQ ID NO: 135960 - DNA, 275 bp, Homo sapiens
  misc_feature: GYAE6OF02IG5TK.49.11.A11.1.454.CMB.1.raw
  modified_base (249)..(275): a, c, t, g, unknown or other
  misc_feature (249)..(275): n is a, c, g, or t
tcagagtcgagagacacgaccggtgctcgatttagctacgactgcagggaacccagccaccctgaccatcagccgggtcgaaagacggggatgaggccgactattactgtcaggtgtgggatagtggtagtggtgtcgtcttcggagctgggaccagggtcaccgtctaggtcagcccaaggccaacccatgtcactctgttcccacctcctctctctcgactctgagcgggctggcaaggcacatagnnnnnnnnnnnnnnnnnnnnnnnnnnn

SEQ ID NO: 135961 - DNA, 1061 bp, Homo sapiens
  misc_feature: GYAE6OF02INPVM.49.11.A11.1.454.CMB.1.raw
tcagagtcgagagacacgaccggtgctcgatttagctacgactgcagggggggcctaaggaagcagcactggtggtgcctcagccatggcctggaccgttctcctcctcggcctcctctctcactgacacagactctgtcgacctcctatcgtgctgtactcacgccctaccgtcggtgtcgacggtcgcccctaggacagaccggccaggtactttaccgtagggtacggggaaactatacgtttacgggaaagttaacgactaggttacggacctaacggttacggaaccccgagtaccgtaaggaaccggaccgaacgggccccgaaccgggttccccttaggtcggtaccggttacggttccgttacgttaaggttcgggtacgtacggtcggggacccggtacccgggtaccccgtgggaacggggttccttaccggtacgggtaacgtccgtttaacctttccgacgggtttccgtacccgttaaccgtaacccggttacccggggtaaccccgggggtaaacccccccgtacccggtaacccgttacccgtaaaccgtacccggttaacccgggtaaacccgggggttacccggggttaaaccggggaaaacggggggtttacccgggggtaacgttaacggggaacccgggttaaccccgttaaccgttaaaccggtttacccggtttaacgggtacgggtacgggggtttaacgggtaacggggttaacggtttaaacgggggtttcggggttaacggggtttaccgggtttccgggtttaacgggtttcccgggttaacggggttaccgggtaaccccggggttaggggttaaacccccggggtccggggttaccccgttaacccgggttacccgggttaaccggggtacccgtaaacccgggtacccgaaaaccccgggttaccccctaaaccccggttaccgtttcccggtaaccccgttacgtttccccgttaaccccgggtttacccccttaccccgtttacccgttcccctttaccgggtaccttccccggttaccggttacccgg

SEQ ID NO: 135962 - DNA, 280 bp, Homo sapiens
  misc_feature: GYAE6OF02H1T14.49.11.A11.1.454.CMB.1.raw
  modified_base (231)..(231): a, c, t, g, unknown or other
  misc_feature (231)..(231): n is a, c, g, or t
  modified_base (253)..(253): a, c, t, g, unknown or other
  misc_feature (253)..(253): n is a, c, g, or t
  modified_base (255)..(280): a, c, t, g, unknown or other
  misc_feature (255)..(280): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggcccaaccccactgtcactctcgtccccgccctctctctctcgactctgngcgggctggcaaggcacatagnannnnnnnnnnnnnnnnnnnnnnnnnn

SEQ ID NO: 135963 - DNA, 776 bp, Homo sapiens
  misc_feature: GYAE6OF02G4P7Q.49.11.A11.1.454.CMB.1.raw
  modified_base (277)..(277): a, c, t, g, unknown or other
  misc_feature (277)..(277): n is a, c, g, or t
tcagagtcgagagacacgaccggtgctcgatttagctacgactgcgagggggggcctaaggaagcagcactggtggtgcctcagccatggcctggaccgttctcctcctcggcctcctctctcactgcacagctctgtgacctctatgtgctgactcgacgccacccgtggtgtcgaggtccgcccctggacacggacggaccaggtacttaccgtgggtacgggggaaacactagttagggaaagtaagacgtgtcgcacgtggaccagcagaacncgacggccgacggccctgtcgtcgtggtcgtcgtagtggtgagtcgggaccgtcccggccgtggacggtacctcccgtgacgcggtacttcgacgtcgcctaccgtactccgggtaccgggaccccgtacccgtacccgtacgaacctcgtacccggtacggggtacccgggtaacggaagggtaaccgggacgtacgggaccggtaccgtaacgtttacgttacgtcggtaaccgggtaggttacgggtagggttaagttacgggttaggttacgggttcggttaccggttaccggttcggtaacgggcgggttaccgggtaccgggaaccggttaccgggtcccgttaccggttacggaccgggtaccgtaacccgggacccgtaacccggaccccgtaaacccgtcggtaaccggttccctaacccgttcccggttacccggtcccccgttaccgtccccgtttacctcccggtaccttacccgttactacccggg

SEQ ID NO: 135964 - DNA, 278 bp, Homo sapiens
  misc_feature: GYAE6OF02FX5N0.49.11.A11.1.454.CMB.1.raw
  modified_base (252)..(252): a, c, t, g, unknown or other
  misc_feature (252)..(252): n is a, c, g, or t
  modified_base (257)..(278): a, c, t, g, unknown or other
  misc_feature (257)..(278): n is a, c, g, or t
tcagagtcgagagacacgaccggtgctcgatttagctacgactgcggggaacccggccaccctgaccatcagccgggtcgaagacggggatgaggccgactattactgtcaggtgtgggatagtggtagtggtgtcgtcttcgggagctgggaccagggtcaccggtcctaggtcagcccaaggccaacccccatgtcactctcgttccccgccctcctctctctcgactctgaggcggctggacaggcgtnatagnnnnnnnnnnnnnnnnnnnnnn

SEQ ID NO: 135965 - DNA, 836 bp, Homo sapiens
  misc_feature: GYAE6OF02IOFXY.49.11.A11.1.454.CMB.1.raw
  modified_base (131)..(131): a, c, t, g, unknown or other
  misc_feature (131)..(131): n is a, c, g, or t
  modified_base (328)..(328): a, c, t, g, unknown or other
  misc_feature (328)..(328): n is a, c, g, or t
tcagagtcgagagacacgaccggtgctcgatttagctacgactgcgaggggggggcctaaggaagcagcactggtggtgcctcagccatggcctggaccgttctcctcctcggcctcctctctcactgcanagactctgtcgacctctatgtgctgactcacgcccacccgtcggtgtcgaggtccggcccctggacaggacggccgaggtacttaccgtgggtacgggggaaacacgtagttaggaagtaagacgtgtgactacgtggaccagacgagaacgccgaacggccgacggcccctgtcgcgtcggtctctagtggtacgngtacgggccgaccccgggccctaggtacgggacctcccgtaggacgcgttactttcgtacggttcggcccttaccgtaaccgttccggacccgggtaaccccccggtacccgaaccccgttaccgaacctacggtaacccgtacggggtaccccgggttaacggaaaccggggaacggggtacgtacgggtacccggaacccgttaacgttaacgtttacggttacgttacggtcggttggggttacggttagggttaggttaagggtttgggttagggttccggttacggtttaccggtttcggggtaaccgtcggggtacggttaaccggggtaccggtaccgtttaccccggttaaccgttaaccggtacggtaaaccccgaccgggtaacccgaacccggttacccaaccggtaaccgttcccgttaaccgttccccggttacccgtttacccccgtccccttcccgttacccgtcccgtttacccgtaccgtcttaacccggg

SEQ ID NO: 135966 - DNA, 261 bp, Homo sapiens
  misc_feature: GYAE6OF02HE8MF.49.11.A11.1.454.CMB.1.raw
  modified_base (250)..(261): a, c, t, g, unknown or other
  misc_feature (250)..(261): n is a, c, g, or t
tcagagtcgagagacacgaccggtgctcgatttagctacgactgcagggaacccgccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccgcctcctctctctcgactctgagcgggctggcaaggcgcatagnnnnnnnnnnnn

SEQ ID NO: 135967 - DNA, 302 bp, Homo sapiens
  misc_feature: GYAE6OF02FLQAC.49.11.A11.1.454.CMB.1.raw
  modified_base (253)..(302): a, c, t, g, unknown or other
  misc_feature (253)..(302): n is a, c, g, or t
tcagagtcgagagacacgaccggtgctcgatttagctacgactgcagggaacccggccaccctgaccatcagccgggtcgaagacgggggatgaggccgactattactgtcaggtgtgggatagtggtagtggtgtcgtcttcggagctgggaccagggtcaccgtcctaggtcagcccaaggccaaccccactgtcactctgttcccaccctcctctctctcgactctgagcgggctggcaaggcgcatagnnnnnnnnnnnnnnnnnnnnnnnnnnnnnnnnnnnnnnnnnnnnnnnnnn

SEQ ID NO: 135968 - DNA, 784 bp, Homo sapiens
  misc_feature: GYAE6OF02F3Y9Z.49.11.A11.1.454.CMB.1.raw
  modified_base (102)..(102): a, c, t, g, unknown or other
  misc_feature (102)..(102): n is a, c, g, or t
  modified_base (173)..(173): a, c, t, g, unknown or other
  misc_feature (173)..(173): n is a, c, g, or t
tcagagtcgagagacacgaccggtgctcgatttagctacgactgcagggggggcctaaggaagcagcactggtggtgcctcagccatggcctggaccgttcncctcctcggcctcctctctcactgcacagactctgtgacctcctatgtgctgactcagcccaccctcggtntcagtcggcccctggaccagacggccaaggacttaccgtggtagggggaaaaccactagttacggaaagtaagacgttgtgacactacggaccagctaagaacgccgaggccgacggtcccctgtcgcgtggttccgtatattgggtagacgttggaccggacccgccccgtagacgggtactcccgtagacgtacgtattccgtcgtcggtacctacctaaccgttccggtaaccgggaacccccgtccacccgtacacctaacgtcgaaccggtccggggacgtaacggacgggtaagtcgggaaccgtacccgtaagttaaccgtacggttacgtaccggtaagggttggttacgggacgttaaggggtttaccgggttagggtacgggtttaccggtcgtttcggggttacgtaacggtacccgggttagggtaaccccggtacggggttccctaacccggtttaccgtaaaccggtaccgtaacccgaacccggaaaccggtacccctaaaacccccggtcggttaaccggtacctaccgttacccgtttcccgttacccccgcttacccgtttccccgtactcccggttaccgaccttacccggg

SEQ ID NO: 135969 - DNA, 820 bp, Homo sapiens
  misc_feature: GYAE6OF02G1KKA.49.11.A11.1.454.CMB.1.raw
  modified_base (135)..(135): a, c, t, g, unknown or other
  misc_feature (135)..(135): n is a, c, g, or t
  modified_base (315)..(315): a, c, t, g, unknown or other
  misc_feature (315)..(315): n is a, c, g, or t
  modified_base (495)..(495): a, c, t, g, unknown or other
  misc_feature (495)..(495): n is a, c, g, or t
tcagagtcgagagacacgaccggtgctcgatttagctacgactgcgagggggggcctaaggaagcagcactggtggtgcctcagccatggcctggaccgttctcctcctcggcctcctctctcactgcacagctntgtacgacctctatggtgctgactacacgcccgacccgtcggttgtccgaggtccgaccccgtgggaaccacggacccggaccgtaaggtacctttaccggtggggtaacgggggaaaaccaagttagttaacgggaaaagttaacgcgttacgaggtacccgtaacgtcgggtaaaccncggaactaacggaaccgccggtaacgggtccccaacgggtcccctaggtccgtcggttccgtacgttcgtaggtggttaggcgttaccgggccgtacccggaccgtacggacggtactcgagccggtagtaccttcggtcgtcgaccttaccggtaaccgtccggacccggggtaccccnccggtaacctcaactggcccaacggggtcggtaacgggacggggacgtaggacggaccgtaccgttaccttagttaccgaggtcggtaggtcgggtaggtagttagggttacggttgtacggttcggtcttcgggtcgtacggtcgggtaaaccgggtcgtacccggaccggttcccgttaacgggtacccggccttaaaccgggacccgtaccggtacccccgtaaccggttaccgtccggttacctacccgttaaccgttcccccgttacccgttacccttcccggtttactaccccggtacgtttcccgaagggttcccggg

SEQ ID NO: 135970 - DNA, 776 bp, Homo sapiens
  misc_feature: GYAE6OF02H4TUO.49.11.A11.1.454.CMB.1.raw
  modified_base (230)..(230): a, c, t, g, unknown or other
  misc_feature (230)..(230): n is a, c, g, or t
  modified_base (372)..(372): a, c, t, g, unknown or other
  misc_feature (372)..(372): n is a, c, g, or t
tcagagtcgagagacacgaccggtgctcgatttagctacgactgcagggggggccgtaaggaagcagcactggtggtgcctcagccgatggcctgggaccgttctcctcctcggcctccgtctctcactgcacagactcctgtgacctcctagtgtgctgactcagccaccctcggtgtcagtcggccctggacagacggccaggattaaccgtggtacgggggaaaacnctaagttggaagttaacgacgtaggtcgcaacgtggaccagcaagaacgccaggccacggtccctggtcgctggtcgtgtaacgtggtcgacgagccgtaccggccttaggacggtactcccgttgagtctacgttttacgnggtacctaccgaagtttcgaacggaaccgacgggtaccctaacccgtggtaacccgttcgaacggaccgtaaaggggttccgaaaagggcccggggtaagtacggaacggtacccgacgttaacgtacgtcgttacggtacgtaagggtcgggttacgggaagttaacggtttaacgtaggtacgtcggttcggtttaccggggttcggttacgggtaccgggaacgggtaaccgtaaggttacggtaaccggtttacggttcggttaccgtaccggtaccgtaaccgggtccgtttaacccgggcccccgttaccgggtttacccgtaaccgtttaccgttacccggttaccccgtaccccggttaaccctttcccgttaccgtttaccgtcgttaaccccgg

SEQ ID NO: 135971 - DNA, 758 bp, Homo sapiens
  misc_feature: GYAE6OF02GZ2YZ.49.11.A11.1.454.CMB.1.raw
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcacgcccacccgtcggtgtcgagtcggcccctggacaggaccggccaaggtacttaccgtgggtacgggggaaaacacaggttagggaaagttaacggacttggtacgacctacgtcgggtaacccaggccgaagaacgccgaacgggcccgacggcccccgtggtcgccgtggttccgtcgttaaggtcggtagagtcgggccggacccggcccgtcggacggggtactcccgtaggacgtccgtagttccgtacgtcggcctacccgaaccgttcggtaccggggtaaccccggccctacccgcgaaccctagtaccgcggtacccgggttacggaaaccgggacggggacgtggaaccggccggtaaccttaacgtttacgtcgttcggagggttgggtacggtaggtaggttggtaggttcggtcgttcgttcggtcggtagtcggtacggaccggtaggtccgaccggttccgtaggtaccaaccgtaccgaaccgacccgtaacccctcgtaacgtcccgtaacgttcccgttaccccggttaccccctccccggttcccttacccgttccgtaccgttaccgacccgtttccgg

SEQ ID NO: 135972 - DNA, 825 bp, Homo sapiens
  misc_feature: GYAE6OF02JSII2.49.11.A11.1.454.CMB.1.raw
  modified_base (793)..(793): a, c, t, g, unknown or other
  misc_feature (793)..(793): n is a, c, g, or t
tcagagtcgagagacacgaccggtgctcgatttagctacgactgcaggggggggcctaaggaagcagcactggtggtgcctcagccatggcctggaccgttctcctccgtcggcctcctctctcactgcacagactctgtgacctcctatgtgctgactcacgcccacccgtcggtgtcagtccggcccctggacacggacggccaaggtacgttaccgtcgggtacggggggtaaaacacgttaagttaggggaaaagtaaacggacttcggtggacctaacggttacgggtaaccaggacaaaggaacgtaccgacggccgaacggtccccgtgtcggccgtcgggttccgtcttaaggtgggtgaacgtcgggaccggtaccccggtcctacggaacggggttactccccgtagggacgtacgtacgttccgtaccggtggtccctaccgaacgttccggaaaccgggaccccgacctacccggtacgaaccgtacgtcggaaccggggtccgggttaaacggaacgggtaccggggtacgtcgggaaccgggtaccgtaacgttacgttacggtacggtacggtacgggttcggtaagggtaacgttggggttaacggttaggttacgggtccgttcggtacggttaccgggacgtcgggtaacggtaccggtacgggtacccgtaaccgggttcgacgggtacccgaaccgtacccgaaccgggtacccctaaccgtaccgtcgtaccgttaccgttccgttaccccgttaccccgtccccgttaccncccgtttaccctccggtacccttcggtacggg

SEQ ID NO: 135973 - DNA, 882 bp, Homo sapiens
  misc_feature: GYAE6OF02JVEOT.49.11.A11.1.454.CMB.1.raw
  modified_base (103)..(103): a, c, t, g, unknown or other
  misc_feature (103)..(103): n is a, c, g, or t
  modified_base (509)..(509): a, c, t, g, unknown or other
  misc_feature (509)..(509): n is a, c, g, or t
tcagagtcgagagacacgaccggtgctcgatttagctacgactgcaggggggggcctaaggaagcagcactggtggtgcctcagccatggcctggaccgttcncctcctcggcctcctctctcactgcacagactctgtcgacctctagtgtgctacgactcgacgcccacccgtggtcgtcgaggtccggccccgtaggaccgaacggaccggtcccgaagggtacctttaccggtaggggtacgggggaaaacacgtagtttagggaaacgttaagtcgtggtcgactacgtcgggtaccaggacgagaacgccgaacggccgaccggtccccgttaggccgtacggtcggtccgtcgttaggtggtacgaggtccggacccggacccggtccggacgaccgggtctccccggtagacggtcctacgtttccgcgtacgtaccgtacccgtacggttaccgggtaaccccgggaccccggtaccctaaccccggtacggtaaacccncggtacgggtaaccccggggtaccgggtaaacggaacggggtaccgggggtacgtaccggggaccggtaaccgtacggtttaaccgttacgtaccgggttacggtcgggttaacgggtacgggttaggttaacggggttcggttaacgggttcggttaccgggtttccggttacgggaccgggttaacggtccgggtaccgggtacccggtacgggttccggacccggttacgtccgggtacaaccgggttacccgaaccgggtacccctaacccggtcgtacccgttaccgtacccgttaccgtccccgggtttccccctacccgggtttcccttcggtaccccgtttccggtaaccggtttccctacgggg

SEQ ID NO: 135974 - DNA, 434 bp, Homo sapiens
  misc_feature: GYAE6OF01CQXGX.14.60.F05.1.454.CMB.1.raw
  modified_base (432)..(434): a, c, t, g, unknown or other
  misc_feature (432)..(434): n is a, c, g, or t
tcagcgtctagtaccacgaccggtgctcgatttagtacgtcatcagggaaagggctggagtgggttggccgtattaagagtaaagctaacaattacgcgacagtatatgctgcgtcggtgaaaggcaggttcaccatctccagagatgattcagagaacacggcgtatctgcaaatgaacagcctgaaaaccgaggacacggccgtgtattattgtactagaccgtcttacgatatttgactggtcggcgggggttcgaccccgtggggccagggaaccctggtcaccgtctcctcagcttccaccaagggcccatcggtcttccccctggcgccctgctccaggagcacctctgggggcacagcggccctggctgcctggtcaaggactacttccgtactagacgctgagcgggctggcaaggcgcatagnnn

SEQ ID NO: 135975 - DNA, 438 bp, Homo sapiens
  misc_feature: GYAE6OF01DZCG5.14.60.F05.1.454.CMB.1.raw
  modified_base (434)..(438): a, c, t, g, unknown or other
  misc_feature (434)..(438): n is a, c, g, or t
tcagcgtctagtaccacgaccggtgctcgatttagtacgtcatcagggaaagggctggagtgggttggccgtattaagagtaaagctaacaattacgcgacagtatatgctgcgtcggtgaaaggcaggttcaccatctccagagatgattcagagaacacggcgtatctgcaaatgaacagcctgaaaaccgaggacacggccgtgtattattgtactagaccgtcttacgatattttgactggtcggcgggggttcgacccctggggccagggaaccctggtcaccgtctcctcagcttccaccaagggcccatcggtcttccccctggcgccctgctccaggagcacctctgggggcacagcggccctgggctgcctggtcaaggactacttccgtacttagacgctgagcgggctggcaaggcgcatagnnnnn

SEQ ID NO: 135976 - DNA, 605 bp, Homo sapiens
  misc_feature: GYAE6OF01C2I2T.14.60.F05.1.454.CMB.1.raw
  modified_base (207)..(207): a, c, t, g, unknown or other
  misc_feature (207)..(207): n is a, c, g, or t
  modified_base (519)..(519): a, c, t, g, unknown or other
  misc_feature (519)..(519): n is a, c, g, or t
  modified_base (523)..(523): a, c, t, g, unknown or other
  misc_feature (523)..(523): n is a, c, g, or t
  modified_base (527)..(528): a, c, t, g, unknown or other
  misc_feature (527)..(528): n is a, c, g, or t
  modified_base (532)..(532): a, c, t, g, unknown or other
  misc_feature (532)..(532): n is a, c, g, or t
  modified_base (534)..(534): a, c, t, g, unknown or other
  misc_feature (534)..(534): n is a, c, g, or t
  modified_base (536)..(536): a, c, t, g, unknown or other
  misc_feature (536)..(536): n is a, c, g, or t
  modified_base (538)..(538): a, c, t, g, unknown or other
  misc_feature (538)..(538): n is a, c, g, or t
  modified_base (540)..(540): a, c, t, g, unknown or other
  misc_feature (540)..(540): n is a, c, g, or t
  modified_base (543)..(543): a, c, t, g, unknown or other
  misc_feature (543)..(543): n is a, c, g, or t
  modified_base (548)..(548): a, c, t, g, unknown or other
  misc_feature (548)..(548): n is a, c, g, or t
  modified_base (573)..(573): a, c, t, g, unknown or other
  misc_feature (573)..(573): n is a, c, g, or t
  modified_base (592)..(592): a, c, t, g, unknown or other
  misc_feature (592)..(592): n is a, c, g, or t
tcagcgtctagtaccacgaccggtgctcgatttagtacgtcatcagggaaagggtcgtggggagtgggttggccggtattaagagtaaagctaacgaattacgcgacagtatatgctgcgtcggtgaaagcacggttcaccatctccgagagagtcgagttcagagaacacggtcgtatctgctaaatgaacagcctggaaaaccgnggacacggccgtgtattattgtacgtagaccgttcttacgattagttttcgactgggtcggtcgggggtttccgacccgtgggggccacgggaaccctgggtccaccggttcctcctacacgtccttaccaaccgaacggcccagtccggtcctttcccccgtgggccgcccctggccgtccgacgggacgccgaccgttcgtcgggggcaacgacgccggccgtcgggctcgcctggtacgaacggtctaccgttccgtctagacgtcgtgacggcgggctcgggacgaaggcggacgaagtacgagtagnactncgcnnacanananananagngtcgngcgcgcgacgactcgcgtcgcgcgngacgtcgcgtcgcgtcgcncgtcgtcgtcgtc

SEQ ID NO: 135977 - DNA, 438 bp, Homo sapiens
  misc_feature: GYAE6OF01A29U1.14.60.F05.1.454.CMB.1.raw
  modified_base (429)..(438): a, c, t, g, unknown or other
  misc_feature (429)..(438): n is a, c, g, or t
tcagcgtctagtaccacgaccggtgctcgatttagtacgtcatcagggaaagggctggagtgggttggccgtattaagagtaaagctaacaattacgcgacagtatatgctgcgtcggtgaaaggcaggttcaccatctccagagatgattcagagaacacggcgtatctgcaaatgaacagcctgaaaaccgaggacacggccgtgtattattgtactagaccgtcttacgatattttgactggtcggcgggggttcacccctggggccagggaccctggtcaccgtctcctcagcttccaccaagggcccatcggtcttccccctggccgccctgctccaggagcacctctggggcacagcggcctggctgcctggtcaaggctactccgtactagacgcctgagcgggctggcaaggcgcatacgnnnnnnnnnn

SEQ ID NO: 135978 - DNA, 454 bp, Homo sapiens
  misc_feature: GYAE6OF01BG788.14.60.F05.1.454.CMB.1.raw
  modified_base (444)..(454): a, c, t, g, unknown or other
  misc_feature (444)..(454): n is a, c, g, or t
tcagcgtctagtaccacgaccggtgctcgattttagtacgtcatcagggaaagggctggagtgggttggccgtattaagagtaaagctaacaattacgcgacagtatatgctgcgtcggtgaaaggcaggttcaccatctccagagatgattcagagaacacggcgtatctgcaaatgaacagcctgaaaaccgaggacacggccgtgtattattgtactagaccgtcttacgatattttgactggtcggcgggggttcgaccccgtggggccagggaacccgtggtcaccgtctcctcagcttccaccaagggcccatcggtcttccccctggccgccctcgctccaggagcacctctcgggggcacacggccggccctgggctcgcctggtcaacggactacttccgtactagacgctgagcgggctggcaaggcgcatagnnnnnnnnnnn

SEQ ID NO: 135979 - DNA, 502 bp, Homo sapiens
  misc_feature: GYAE6OF01ERD54.14.60.F05.1.454.CMB.1.raw
  modified_base (488)..(502): a, c, t, g, unknown or other
  misc_feature (488)..(502): n is a, c, g, or t
tcagcgtctagtaccacgaccggtgctcgatttagtacgtcatcagggaaagggctggagtgggttggccgtattaagagtaaagctaacaattacgcgacagtatatgctgcgtcggtgaaaggcaggttcaccatctccagagatgattcagagaacacggcgtatctgcaaaatgaacagcctagaaaaccgaggacacggccgtgtattattgtactagaccgtcttacgattattttgactggtcggcgggggttcgacccgtggggccagggaaccctggtcaccgtctcctcacgtcttccaccgaaggccccatccggtccttcccccgtggccgccctcgcctcccgaggacgccacctcggtcgggggaccacgacggccggccgtgggctcgccgtcggtacgaacggaccttacgtttcccgtactacgacgcgtggacggcggggtcgtgggtaccgaagggtccgacgagtagnnnnnnnnnnnnnnn

SEQ ID NO: 135980 - DNA, 448 bp, Homo sapiens
  misc_feature: GYAE6OF01A16KH.14.60.F05.1.454.CMB.1.raw
  modified_base (440)..(448): a, c, t, g, unknown or other
  misc_feature (440)..(448): n is a, c, g, or t
tcagcgtctagtaccacgaccggtgctcgatttagtacgtcatcagggaaagggctggagtgggttggccgtattaagagtaaagctaacaattacgcgacagtatatgctgcgtcggtgaaaggcaggttcaccatctccagagatgattcagagaacacggcgtatctgcaaatgaacagcctgaaaaccgaggacacggccgtgtattattgtactagaccgtcttacgatattttgactggtcggcgggggttcgaccccgtggggccagggaaccctggtcaccgtctcctcagcttccaccaagggcccatcggtcttccccctggccgccctgctccaggcgcacctctgggggcacagccggccctggactcgcctggtcaaggtctacttccgtactacgacgctgagccgggctgggcaaggcgcatagnnnnnnnnn

SEQ ID NO: 135981 - DNA, 506 bp, Homo sapiens
  misc_feature: GYAE6OF01CLDWR.14.60.F05.1.454.CMB.1.raw
  modified_base (482)..(483): a, c, t, g, unknown or other
  misc_feature (482)..(483): n is a, c, g, or t
  modified_base (485)..(506): a, c, t, g, unknown or other
  misc_feature (485)..(506): n is a, c, g, or t
tcagcgtctagtaccacgaccggtgctcgatttagtacgtcatcagggaaagggctggagtgggttggccgtattaagagtaaagctaacaattacgcgacagtatatgctgcgtcggtgaaaggcaggttcaccatctccagagatgattcagagaacacggcgtatctgcaaatgaacagcctgaaaaccgaggacacggccgtgtattatgtactagaccgtcttacgattattttgactggtcgggcgggggttcgaccccgtggggccacgggacctggtcaccgtctcctcacgcttccaccaacgggccccagtccggtcccttcccccgtcggccgcccctgcctccacggacgccaccgtcgtggggcacgcggccggccgtggctcgccgtggtacaacggacctaccgttccgtacgtagaccgcgtggacggtccggggacgtgggaccgaacgggccgaccgagtaggnncnnnnnnnnnnnnnnnnnnnnnn

SEQ ID NO: 135982 - DNA, 621 bp, Homo sapiens
  misc_feature: GYAE6OF01D9KT9.14.60.F05.1.454.CMB.1.raw
  modified_base (573)..(573): a, c, t, g, unknown or other
  misc_feature (573)..(573): n is a, c, g, or t
  modified_base (577)..(577): a, c, t, g, unknown or other
  misc_feature (577)..(577): n is a, c, g, or t
  modified_base (581)..(581): a, c, t, g, unknown or other
  misc_feature (581)..(581): n is a, c, g, or t
  modified_base (585)..(621): a, c, t, g, unknown or other
  misc_feature (585)..(621): n is a, c, g, or t
tcagcgtctagtaccacgaccggtgctcgatttagtacgtcatcagggaaagggctggagtgggttggccgtattaagagtaaagctaacaattacgcgacagtatatgctgcgtcggtgaaaggcaggttcaccatcctccagagatgattcagagaacacggcgtatctgacaaatgaaacagcctagaaaaccggaggacacggccgtgttatttattgtactacgaccgttcttacgtattattttgacgttggggtcggggtccgggggttccgacccccggtgggggacccgaacggggaacccgttcggtaccacccggttcctcctcgacgtcccttaccgaccgaacgggtccctacgttccggttccccttcccccgcggtcccgtcccgtcgccgtaccgaggacgccgaccgtcgggtcgggggcctacggacggtcccggccgtcgggacctcggtcccgtaggtaccgaacggtacctttacccgttacgtaccgtacggtaccgtcgtacgggacgggtccggggtacggtacgggaccggaagggtccgacggttanaagngacngtcnnnnnnnnnnnnnnnnnnnnnnnnnnnnnnnnnnnnn

SEQ ID NO: 135983 - DNA, 541 bp, Homo sapiens
  misc_feature: GYAE6OF01CF8Y9.14.60.F05.1.454.CMB.1.raw
  modified_base (226)..(226): a, c, t, g, unknown or other
  misc_feature (226)..(226): n is a, c, g, or t
  modified_base (522)..(522): a, c, t, g, unknown or other
  misc_feature (522)..(522): n is a, c, g, or t
  modified_base (524)..(541): a, c, t, g, unknown or other
  misc_feature (524)..(541): n is a, c, g, or t
tcagcgtctagtaccacgaccggtgctcgatttagtacgtcatcagggaaagggctggagtgggttggccgtattaagagtaaagctaacaattacgcgacagtatatgctgcgtcggtgaaaggcaggttcaccatctcagagatgattcagagaacacggcgtatctgacaaatgaacagcctagaaaccgaggacacggccgtgtattatgtactagaccgtnttacgattattttgactgggtcgggcggggttcgacccgtggggccacgggacctggtccaccgtctcctcacgccttccaccgaacgggccctacgtccggtcccttcccccgtcggccgccctcgcctccgaggacgcctaccgtcgggtcgggggccacggacggcccggtcccgtacggtaccgtcggtcccgtcgggtaaccgaaacggtaccttaccgtttacccgtaacgtacggaccgtcgtacgggacgggccggggtcgtcggacggaacgggccgactaagtagngnnnnnnnnnnnnnnnnnn

SEQ ID NO: 135984 - DNA, 505 bp, Homo sapiens
  misc_feature: GYAE6OF01BCHG6.14.60.F05.1.454.CMB.1.raw
  modified_base (296)..(296): a, c, t, g, unknown or other
  misc_feature (296)..(296): n is a, c, g, or t
  modified_base (329)..(329): a, c, t, g, unknown or other
  misc_feature (329)..(329): n is a, c, g, or t
  modified_base (334)..(334): a, c, t, g, unknown or other
  misc_feature (334)..(334): n is a, c, g, or t
  modified_base (351)..(351): a, c, t, g, unknown or other
  misc_feature (351)..(351): n is a, c, g, or t
  modified_base (359)..(359): a, c, t, g, unknown or other
  misc_feature (359)..(359): n is a, c, g, or t
  modified_base (416)..(416): a, c, t, g, unknown or other
  misc_feature (416)..(416): n is a, c, g, or t
  modified_base (463)..(463): a, c, t, g, unknown or other
  misc_feature (463)..(463): n is a, c, g, or t
  modified_base (465)..(465): a, c, t, g, unknown or other
  misc_feature (465)..(465): n is a, c, g, or t
  modified_base (468)..(468): a, c, t, g, unknown or other
  misc_feature (468)..(468): n is a, c, g, or t
  modified_base (470)..(505): a, c, t, g, unknown or other
  misc_feature (470)..(505): n is a, c, g, or t
tcagcgtctagtaccacgaccggtgctcgatttagtacgtcatcagggaaagggcgtggagtgggttggccgtattaagagtaaagctaacaattacgcgacagtatatgctgcgtcggtgaaaggcaggttcaccatctccagagatgattcagagaacacggcgtatctgacaaatgaacagacctagaaaaccgaggaccgacggccgtgtaattattgactagaccgtcttacgattattttgacgtggtcgggcggggttcacccgtgggcacggacctggcacgtctccnagctccacgaggccctagtcggtccttccccgnggccnccctgacctcgaaggcncactcggngggcacgagccggccgtggctcgctggacaacggtcttaccgtccgtacgtagccgngttaggacgggtcgggtctacgggacggaaggccgagttaagaggcngngcngnnnnnnnnnnnnnnnnnnnnnnnnnnnnnnnnnnnn

SEQ ID NO: 135985 - DNA, 700 bp, Homo sapiens
  misc_feature: GYAE6OF01BRBUR.14.60.F05.1.454.CMB.1.raw
  modified_base (614)..(614): a, c, t, g, unknown or other
  misc_feature (614)..(614): n is a, c, g, or t
  modified_base (617)..(617): a, c, t, g, unknown or other
  misc_feature (617)..(617): n is a, c, g, or t
  modified_base (625)..(625): a, c, t, g, unknown or other
  misc_feature (625)..(625): n is a, c, g, or t
  modified_base (627)..(627): a, c, t, g, unknown or other
  misc_feature (627)..(627): n is a, c, g, or t
  modified_base (629)..(630): a, c, t, g, unknown or other
  misc_feature (629)..(630): n is a, c, g, or t
  modified_base (632)..(632): a, c, t, g, unknown or other
  misc_feature (632)..(632): n is a, c, g, or t
  modified_base (643)..(643): a, c, t, g, unknown or other
  misc_feature (643)..(643): n is a, c, g, or t
  modified_base (649)..(649): a, c, t, g, unknown or other
  misc_feature (649)..(649): n is a, c, g, or t
  modified_base (651)..(651): a, c, t, g, unknown or other
  misc_feature (651)..(651): n is a, c, g, or t
  modified_base (660)..(660): a, c, t, g, unknown or other
  misc_feature (660)..(660): n is a, c, g, or t
  modified_base (673)..(674): a, c, t, g, unknown or other
  misc_feature (673)..(674): n is a, c, g, or t
  modified_base (683)..(683): a, c, t, g, unknown or other
  misc_feature (683)..(683): n is a, c, g, or t
  modified_base (695)..(696): a, c, t, g, unknown or other
  misc_feature (695)..(696): n is a, c, g, or t
  modified_base (700)..(700): a, c, t, g, unknown or other
  misc_feature (700)..(700): n is a, c, g, or t
tcagcgtctagtaccacgaccggtgctcgatttagtacgtcatcagggaaagggctggagtgggttggccgtattaagagtaaagctaacaattacgcgacagtatatgctgcgtcggtagaaaggcaggttcaccatctccagagatgattcgagagaacgacggcgtatctagacaaaagtagaacacgcccgtaacggaaaaaccggacggaaccgaccgggtcgttagtttaagtttattacggtaacctaacggtaccgtttaactttaacgttatttattttacggacggttcgggttccgggggtcccggggtttacccgacccgggtacgggaccccggaacgggtaacccgttcggtacccgtacccgttcctccctacgtaccgttacccgtacccgaccgaaccggcccccgttacgttccggttcccctcccccggtggccccgtccgttccgcgtaccgagcgacccgtaccgtcggacgggacaccggtcggcccggtccggtcggacctgtacccggtagtacgtaccgtactcggtcccgtaacgtacggcgtaggacgagggccggacgtacggacccggtagcgtaacgcgtagancgngcgagcgngngnngnacgcacgtagnctgcgngngacgtacgngtcgacgcgacgnngtagtgacncgtcgtgagagnngcgn

SEQ ID NO: 135986 - DNA, 710 bp, Homo sapiens
  misc_feature: GYAE6OF01A73VA.14.60.F05.1.454.CMB.1.raw
  modified_base (148)..(148): a, c, t, g, unknown or other
  misc_feature (148)..(148): n is a, c, g, or t
  modified_base (662)..(662): a, c, t, g, unknown or other
  misc_feature (662)..(662): n is a, c, g, or t
  modified_base (668)..(668): a, c, t, g, unknown or other
  misc_feature (668)..(668): n is a, c, g, or t
  modified_base (672)..(672): a, c, t, g, unknown or other
  misc_feature (672)..(672): n is a, c, g, or t
  modified_base (675)..(681): a, c, t, g, unknown or other
  misc_feature (675)..(681): n is a, c, g, or t
  modified_base (683)..(695): a, c, t, g, unknown or other
  misc_feature (683)..(695): n is a, c, g, or t
  modified_base (697)..(710): a, c, t, g, unknown or other
  misc_feature (697)..(710): n is a, c, g, or t
tcagcgtctagtaccacgaccggtgctcgatttagtacgtcatcagggaaagggctggagtggggttgccgtattaagagtaaagctaacaattacgcgacagtatatgctgcgtcggtggaaaggcaggttcaccatctccagagangattcagagaacacggcgtatctgacaaaatgaaacacgccgtagaaaaaccgaggacaccgggtccgtgttaattattacgtaataacgtaccgttacttaacgtattaatttgacgttgggtccgggcggggggttccgaccccgtagggggaccgtagggaaacccctggttaccgaaccctccttaccgtacaacggtcccttaaccaacccggtaacgggaccccttaacgtccccggggttccctttacccccccgggtgggcccccgtacccgtttacggacccttccggaacggtacggaaccccttacggtaccgggtacggggggtacccaaaacgccccggcccgggtaccggttcggggtcccttcggggtccctaagggggtaaccccttaaaacggtacccgtttaacccggttaacccggtaaaccgtaccgggtacggaaccgttgggaaccggggtcccgggactacggggacgtaacggaccgtactagtaacganctagcngtancgnnnnnnnannnnnnnnnnnnnannnnnnnnnnnnnn

SEQ ID NO: 135987 - DNA, 436 bp, Homo sapiens
  misc_feature: GYAE6OF02IHW3C.14.60.F05.1.454.CMB.1.raw
  modified_base (432)..(436): a, c, t, g, unknown or other
  misc_feature (432)..(436): n is a, c, g, or t
tcagcgtctagtaccacgaccggtgctcgatttagtacgtcatcagggaaagggctggagtgggttggccgtattaagagtaaagctaacaattacgcgacagtatatgctgcgtcggtgaaaggcaggttcaccatctccagagatgattcagagaacacggcgtatctgcaaatgaacagcctgaaaaccgaggacacggccgtgtattattgtactagaccgtcttacgatattttgactggtcggcggggttcgacccctggggccagggaaccctggtcaccgtctcctcagcttccaccaagggcccatcggtcttccccctggcgccctgctccaggagcacctctgggggcacagcggccctgggctgcctggtcaaggctacttccgtactagacgctgagcgggctgggcaaggcgcatagnnnnn

SEQ ID NO: 135988 - DNA, 552 bp, Homo sapiens
  misc_feature: GYAE6OF02HM5XN.14.60.F05.1.454.CMB.1.raw
  modified_base (513)..(513): a, c, t, g, unknown or other
  misc_feature (513)..(513): n is a, c, g, or t
  modified_base (515)..(515): a, c, t, g, unknown or other
  misc_feature (515)..(515): n is a, c, g, or t
  modified_base (517)..(552): a, c, t, g, unknown or other
  misc_feature (517)..(552): n is a, c, g, or t
tcagcgtctagtaccacgaccggtgctcgatttagtacgtcatcagggaaagggctggagtgggttggccgtattaagagtaaagctaacaattacgcgacagtatatgctgcgtcggtgaaaggcaggttcaccatctccagagatgattcagagaacacggcgtatctgcaaatgaacagcctagaaaaccgaggacacggccgtgtattattgtactagaccgtcttacgatattttgactgggtcggcgggggttcgacccccgtggggccagggaacccgtggtcaccgtctcctcagcttccaccaagggcccatcggtcttccccctggcgccctgctccaggacgcacctcgtcgggggctaccgagccgggcccgtcggggcctcgcccgtcggtacaaacgggtaccttaaccgtttcccggtaacctttacggaaccggtccgtggaacgggtccggggaccgttcggggacccgaaacggggccggacctaagttaggacngngnnnnnnnnnnnnnnnnnnnnnnnnnnnnnnnnnnnn

SEQ ID NO: 135989 - DNA, 514 bp, Homo sapiens
  misc_feature: GYAE6OF01E3SXC.36.66.F11.1.454.CMB.1.raw
  modified_base (508)..(508): a, c, t, g, unknown or other
  misc_feature (508)..(508): n is a, c, g, or t
tcagtacgctgtctcacgaccggtgctcgatttagtcacgcgagaaggggggaggaactgctcagttaggacccagacggaaccatggaagccccagcgcagcttctcttcctcctgctactctggctcccagattccactggagaaatagtgatgacgcagtctccagccaccctgtctgtgtctccaggggaaagagccaccctctcctgcagggccaatcagagtattagcagcaacttagcctggtaccagcagaaacctggccaggctcccaggctcctcatctatgatgcttccaaagggcccctggcatcccaaccaggttcagtgccagtgggtctgggacagacttcactctcaccatcagcagcctagacgcctgaagtattttgctacttttatactgtcaacagcgtaccacgtggcgcgttcggccgaagggaccaaggtcgaggtacaaacgactgtcggctgccacatcgtgtcttcacttccttcccgcctntctacg

SEQ ID NO: 135990 - DNA, 487 bp, Homo sapiens
  misc_feature: GYAE6OF01BLXX3.36.66.F11.1.454.CMB.1.raw
  modified_base (196)..(196): a, c, t, g, unknown or other
  misc_feature (196)..(196): n is a, c, g, or t
tcagtacgctgtctcacgaccggtgctcgatttagtcacgcgagaagggggaggaactgctcagttaggacccagacggaaccatggaagccccagcgcagcttctcttcctcctgctactctggctcccagattccactggagaaatagtgatgacgcagtctccagccaccctgtctgtgtctccaggggaaanagccaccctctcctgcagggccaatcagagtattagcagcaacttagcctggtaccagcagaacctggccaggctccaggctcctcatctatggtgcatcccaccagggccactgctatcccagccaggttcagtggcagtggtctgggacagagttcactctcaccatcagcagcctagaacctgaagtatttgctagtttattactgtcagcagcgagagtcttcggcctgggaccaagtgatatacaaacgactgtgctgcaccatctgtcttcatccttcccgctac

SEQ ID NO: 135991 - DNA, 558 bp, Homo sapiens
  misc_feature: GYAE6OF01ELW8Y.36.66.F11.1.454.CMB.1.raw
  modified_base (132)..(132): a, c, t, g, unknown or other
  misc_feature (132)..(132): n is a, c, g, or t
  modified_base (549)..(549): a, c, t, g, unknown or other
  misc_feature (549)..(549): n is a, c, g, or t
tcagtacgctgtctcacgaccggtgctcgatttagtcacgcgagaagggggaggaactgctcagttaggacccagacggaaccatggaagccccagcgcagcttctcttcctcctgctactctggctcccanattccgggggggggggggggggggggggggggggggactggagaaatagtgatgacgcagtctccagccaccctgtctgtgtctccaggggaaagagccaccctctcctgcagggccaatcagagtattagcagcaacttagcctggtaccagcagaaacctggccaggctccaggctcctcatctatggtgcatccaccacggccactcgctatcccacgccacggttcgagtggcgagtgggtcgtgggacgagagttcactctcaccatcagcagcctgcagtctagaagtattttgcttagtttatttctgcctagctaactattaattcgtaggtcccttggttacgtggacgttcggacgaagggtaccaagggtggaaaactacgaaacgtacgtagtgactgaccaccntctgttacc

SEQ ID NO: 135992 - DNA, 556 bp, Homo sapiens
  misc_feature: GYAE6OF01DGVY4.36.66.F11.1.454.CMB.1.raw
  modified_base (196)..(196): a, c, t, g, unknown or other
  misc_feature (196)..(196): n is a, c, g, or t
tcagtacgctgtctcacgaccggtgctcgatttagtcacgcgagaagggggaggaactgctcagttaggacccagacggaaccatggaagccccagcgcagcttctcttcctcctgctactctggctcccagattccactggagaaatagtgatgacgcagtctccagccaccctgtctgtgtctccaggggaagngccaccctctcctgcagggccaatcagagtatagcagcaattagcctggtaccagcagaacctggccaggctcccaggctcctcatctagtggtgcactccaccagggccactgctactcccagccaggttcagtggcaggtgggtctgggacaggtacgttcacgtctcaccatcagcacgcctgcagtctagtaagtatttgcttagtttatttctcgtaccagtcctaattaattaacttacgtcggtaccttacgttacgtcggtacggttcggaccgtaacgggacctaagggtacggtaaacgtaccgaaacggtacgtaggtacggactacgacaccgtattccgtgttaccc

SEQ ID NO: 135993 - DNA, 544 bp, Homo sapiens
  misc_feature: GYAE6OF01ARWJU.36.66.F11.1.454.CMB.1.raw
tcagtacgctgtctcacgaccggtgctcgatttagtcacgcgagaagggggaggaactgctcagttaggacccagacggaaccatggaagccccagcgcagcttctcttcctcctgctactctggctcccagattccactggagaaatagtgatgacgcagtctccagccaccctgtctgtgtctccaggggaaagagccaccctctcctgcagggccaatcagagtattagcagcaacttagcctggtaccagcagaaacctggccaggctcccaggctcctcatctatggtgcatcccaccagggcccactgctatcccagccaggttcagtggcaggtggtctgggacagagttcactctcaccatcagcacgcctgcagtctagaagtattttgactagtttatttctgtcctagcctaactattaacttacgtcgtccttcgtacgtggtacgttccggaccgaagggaccgtaaggtaggtaaacgtacgtaaacggtacgtggtaggacgttcgacctaccgtacttcgttgttacc

SEQ ID NO: 135994 - DNA, 828 bp, Homo sapiens
  misc_feature: GYAE6OF01D6TXD.36.66.F11.1.454.CMB.1.raw
tcagtacgctgtctcacgaccggtgctcgatttagtcacgcgagaagggggaggaactgctcagttaggacccagacggaaccatggaagccccagcgcagcttctcttcctcctgctactctggctcccgagtacttccacgtggaagtaaattaggtgtagtacggaccgctacgttcctaccgacgcccctacccgttgttcgttggttcgttcctaccgggaaagggggaaagccgacccctacccttccttccgcgacggacgggacctaactacgaagtaagttattacgacacgactaacgttacgtccgtacggtaaccacgacgaaacgtaaccgtcggaccgacggtccctaccgaggtccttcctactacttctagtcggtcactactacccgaccggacggaccctacgtcgtaccttacccgtcccgaccgtaccgttacggttacgtacgggtcggtacgtaggggttcgggtcggtacgggaacgtaggttcgttacctaccttcctaccaacctagtaccgaacgccgtaccgtccgtgaacgttacggttcgtaaaggtaaagttttccgttttcgtaaccgtttttaggtttttactttccgccgaaccgttaacgtacctttaaactttaagtttaaaccgttttccggaccggttacccgtttaccgggttaacgggttaccgggttacccgggttaccgggaaaccggttaaaacgggtaccggtaaaggggtaacgtaaaaccgtaacgtaaaacggtcgttagggtccgtacgtaccaacctaccttagttccgttagtttaccc

SEQ ID NO: 135995 - DNA, 642 bp, Homo sapiens
  misc_feature: GYAE6OF01BZ098.36.66.F11.1.454.CMB.1.raw
  modified_base (196)..(196): a, c, t, g, unknown or other
  misc_feature (196)..(196): n is a, c, g, or t
  modified_base (297)..(297): a, c, t, g, unknown or other
  misc_feature (297)..(297): n is a, c, g, or t
  modified_base (341)..(341): a, c, t, g, unknown or other
  misc_feature (341)..(341): n is a, c, g, or t
  modified_base (438)..(438): a, c, t, g, unknown or other
  misc_feature (438)..(438): n is a, c, g, or t
tcagtacgctgtctcacgaccggtgctcgatttagtcacgcgagaagggggaggaactgctcagttaggacccagacggaaccatggaagccccagcgcagcttctcttcctcctgctactctggctcccagattccactggagaaatagtgatgacgcagtctccagccaccctgtctgtgtctccgaggggaancgccaccctctcctgcagggccaatcagagtatagcagcaacttagcctggtaccagcaagaaacctggccaggcctccgaggcctcctcatctatggtcncactaccgacgacggccactcgctactcccagccgtaggttacnggtcggacgtagggtcggtacgtgggaactaggtacgttccacgtctacccacctatcgacgtcgacgtccgtagacgtagttcgtagtaacgtttnttttggtactttagttttactttcgcgtacctacgtacctacgtttaacttaacgtttaccgtccgggttacccgttacgggttacggttaccgggtacccgttaccgggaccgtaaacggggtacccgtaaaggggtacgtaaaacgtaccgaaacggttacgtgtacggtacgtacgtactacctacgttcgtccgtttacc

SEQ ID NO: 135996 - DNA, 793 bp, Homo sapiens
  misc_feature: GYAE6OF01CUQXL.36.66.F11.1.454.CMB.1.raw
  modified_base (197)..(197): a, c, t, g, unknown or other
  misc_feature (197)..(197): n is a, c, g, or t
  modified_base (343)..(343): a, c, t, g, unknown or other
  misc_feature (343)..(343): n is a, c, g, or t
tcagtacgctgtctcacgaccggtgctcgatttagtcacgcgagaagggggaggaactgctcagttaggacccagacggaaccatggaagccccagcgcagcttctcttcctcctgctactctggctcccagattccactggagaaatagtgatgacgcagtctccagccaccctgtctgtgtctccgaaggggaancgcccaccctctcctgcgacgggccaatcagtagtatagcagcaacttagcctaggtaccagacaacgaacctggaccaggcctcccgaggtcctacctcattcgtagtggtacgccactacccgaccgaggccactgaccttacnccccgtaagcccgtaggttaccaggtcggaccgtagggtcgggtaccgtagggaacctaggttacgttcctaccgtcctaccgtaaccgtacgtacgacgtccgtaacgtcccgttacgacgtaacggtttccgtaaagggttaaacgtttacggtttttacggtaccgttttaaacggttttttaaaccttccggtaccgttaacccgtaaggttaccctttaaaacgtttaacggtttaaccggtttacccgttaccggggtacccctttacggggtttaacccgggttacgggtacccggtttaaccggaacccgggttaaaacggggtacccggttaaaaggggttaaaccggaaaacgttaacccggtaaaacggttaccggtttagggacccgggtacttaacccggacccttaaccgtaccttaccgttcggttttaaccccg

SEQ ID NO: 135997 - DNA, 498 bp, Homo sapiens
  misc_feature: GYAE6OF01ALR4C.36.66.F11.1.454.CMB.1.raw
  modified_base (196)..(196): a, c, t, g, unknown or other
  misc_feature (196)..(196): n is a, c, g, or t
  modified_base (491)..(491): a, c, t, g, unknown or other
  misc_feature (491)..(491): n is a, c, g, or t
tcagtacgctgtctcacgaccggtgctcgatttagtcacgcgagaagggggaggaactgctcagttaggacccagacggaaccatggaagccccagcgcagcttctcttcctcctgctactctggctcccagattccactggagaaatagtgatgacgcagtctccagccaccctgtctgtgtctccaggggaaanagccaccctctcctgcagggtccaatcagagtattagcagcaacttagcctggtaccagcagaaacctggccaggctcccaggctcctcatctatggtgcatccaccagggccactgctatccccagccaggttcagtggcagtgggtctgggacagagttcacgctcaccatcagcagcctgcagagtgaagattttgcaacttattactgtctacaagattacaattaccctcgtacgttcgccaagggaccaaggtgaagtcaacgaacgtgtgctgcaccatctgtcttcntctcccg

SEQ ID NO: 135998 - DNA, 595 bp, Homo sapiens
  misc_feature: GYAE6OF01B8KUG.36.66.F11.1.454.CMB.1.raw
  modified_base (198)..(198): a, c, t, g, unknown or other
  misc_feature (198)..(198): n is a, c, g, or t
tcagtacgctgtctcacgaccggtgctcgatttagtcacgcgagaagggggaggaactgctcagttaggacccagacggaaccatggaagccccagcgcagcttctcttcctcctgctactctggctcccagattccactggagaaatagtgatgacgcagtctccagccaccctgtctgtcgtctccgaaggggaangccaccctctacctgcagggccaatcagagtatagcagacaacttacgcctaggtaccagacaagaaaccctggccgaaggcctacccgaggcctcctcatctagtggtcgcactcccaccgagggccacgtgctactcccagcctaggttcagtcggctagggtcgggtctggggaacaggtagttccacctcgtccacctatcacgcacgcctgctagtctagtaattagttttcgactttagttttactttcgtacgaccctagtaccctaagttaattaacgtttacgtcggtaccttcggttacgtcggtacgttaccggacgtaacgggacctaagggtacgaactacgaaaccgtacgtgacgtcgtcgacctactcttcgtcgttaccg

SEQ ID NO: 135999 - DNA, 788 bp, Homo sapiens
  misc_feature: GYAE6OF01EOVY8.36.66.F11.1.454.CMB.1.raw
tcagtacgctgtctcacgaccggtgctcgatttagtcacgcgagaagggggaggaactgctcagttaggacccagacggaaccatggaagccccagcgcagcttctcttcctcctgctactctggctcccagattccatggagaaatagtgatgacgcagtctccagccaccctgtctgtgtctccgaggggaaagacgcccaccctctcctgcgagggccaatcagagtattagcagacaacttagcctggtaccagcaagaaaccgtggaccaggctcccaggcctcctcatctagtggtgcactccaccgagggccacgtcgctactcccagcctaggttcaggtcggacgtaggttggggtctggggaacaggtacgtttcccaacgttcctacctaaccctagtaccgaacgccgaacggccccttagggcctaaggttaccgttaaggtaaacgtttactttttacggtaccgtttaaggttttttactttccgtacgtacccgtaacgtacctaaacgtttaactttaaacgtttaaccggttccggttaaccccggtttaccggggttaaccggtttacgggggtaaacccgggttttaccccggggaaacccgggtaaaaaccgggggttaaaccccggtaaaaacggggggtttaaaccggtaaaaaacgtttaacccggaaaaaaccgggtttaaaccggttacggggttaccggggtaacctttaacccgggaacccgttaaacccgaacgtttacccggttcggttttaaccccg

SEQ ID NO: 136000 - DNA, 739 bp, Homo sapiens
  misc_feature: GYAE6OF01E3NPO.36.66.F11.1.454.CMB.1.raw
  modified_base (196)..(196): a, c, t, g, unknown or other
  misc_feature (196)..(196): n is a, c, g, or t
  modified_base (354)..(354): a, c, t, g, unknown or other
  misc_feature (354)..(354): n is a, c, g, or t
tcagtacgctgtctcacgaccggtgctcgatttagtcacgcgagaaggggaggaactgctcagttaggacccagacggaaccatggaagccccagcgcagcttctcttcctcctgctactctggctcccagattccactggagaaatgtgatgacgcagtctccacgccaccctgtctgtcgctccgaaggggaancgcccacccgtctccgtgcgacggaccaagttcagtacgttaacgttacgccgtaagtacctaaacgtttacggccttacgggtacccagaccgtaacgaaaccgtcggccgaccggtccttacccgacggtcctcctctaacgtctaggtcggtacnctaccgtacccgaccggacggtccctacgttaccgccttacccgtaccgaccggtacccgtaaggtttaccggaggttccggacggttacggggttcgggttaccggtacgggaacgttaacggtttacccgttaaccgtaacccgtttccaccgtaacctaaccgtaccgtaccgtaccgaccgtacgtcgtacgtacttacgggggggggggttaattaacgttacgtttacgttactttacgtttacgttaccgtcgacgtacgtacgtaacttacttacgttacgtacggtaccgttacgttcggtacggtacggtaccggacgacgtacgaacgtacgtacgtaacgaacgtcgtcgtgacgtcacactctcgtcgtacg

SEQ ID NO: 136001 - DNA, 930 bp, Homo sapiens
  misc_feature: GYAE6OF01C0R3A.36.66.F11.1.454.CMB.1.raw
  modified_base (207)..(207): a, c, t, g, unknown or other
  misc_feature (207)..(207): n is a, c, g, or t
  modified_base (909)..(909): a, c, t, g, unknown or other
  misc_feature (909)..(909): n is a, c, g, or t
tcagtacgctgtctcacgaccggtgctcgatttagtcacgcgagaagggggaggaactgctcagttaggacccagacggaaccatggaacgccccagcgcagcttctcttcctcctgctactctggcctcccagtattccacgtaggagtaaataggtgatgacgcacgtctccacgccaccttgtctgtgcctacggaaggggaancgccctaccctctccgtcgacgacgggaccaactcgaagtagttagtacgcgacgactaacttacgccgttacgggaccaagaccgaaacggaacccgtccgggaccgtaacgggtcccttacccgacggtccccttcctactaaccgtttcgtaagggttccggtacgtacccgtaaccgttccccccggaaaccgggtaaccggggacccttaaccgttaccggtacccttaacccgtacccccggacgggtacccggttaacgggtttaccggacgggttacgggacgggtaacggggggtttcgggtaccgggtagggtaaaccgttacgggttaaccggttacccctaacgtttaccctaccgtaaccccgtaagttacccgaaccgttacggacccgtttacccgtaggacccgtttaaggtttacccggttaaaggtttaacggttttaccgtttttacgggtaacgttttttaattttcccgtttaccgtaccgtttaacccgacggttaaaccttaacgttttaaacgtttaccggtttacggttacccggtaccggttacgggtttaccgggtaaccggtttcccggggttaaccggaaccccggtaaaagggtaacccggtaaaggggtaaacgtaaaccggtaaacgggtaaaccggttcgtccgggttaacgcgttaccgaaacccttnttacggttcttacccggttac

SEQ ID NO: 136002 - DNA, 748 bp, Homo sapiens
  misc_feature: GYAE6OF01BW1IP.36.66.F11.1.454.CMB.1.raw
tcagtacgctgtctcacgaccggtgctcgatttagtcacgcgagaagggggaggaactgctcagttaggacccagacggaaccatggaagccccagcgcagcttctcttcctcctgctactctggctcccagattccactggagaaatagtgatgacgcagtctccagcccaccctgtctgtgtctccgaggggaagcgcccaccctctcctgcgagggaccaatcaagtagtatagcagactaacttcgccgtacggtaccagacgaacgaaaccgtcggaccacggccctcccgacggtccctccctcacttcgtagtcggtgacctactacccgaaccggacggtccctaacgtcggtaccgtaccccggtacgggtcccggttacgacggttcggacgtaggggttcgggtacggtacggggaacgtacggtaccgttaacgacccgtcttaacccgacctagtaccgacggtcctaaccggtccgtacggacgaaggtacgggttaaggaacgtttacgtttaccgtagttttaacgttttaagttacttacggtacaagtaccgtaagtttaactaacttaccgggtacggttcccggtaccgttaccgtacgggtttaccgggacgggttaaccggaaccggtaaggggtaccgtaaggtaacgtaaaccggtaaacgttacggttagggtccgacgtacggaccctaacgttacgttcgtttaccttcgttacctacccg

SEQ ID NO: 136003 - DNA, 738 bp, Homo sapiens
  misc_feature: GYAE6OF01BT9TL.36.66.F11.1.454.CMB.1.raw
  modified_base (196)..(196): a, c, t, g, unknown or other
  misc_feature (196)..(196): n is a, c, g, or t
  modified_base (303)..(303): a, c, t, g, unknown or other
  misc_feature (303)..(303): n is a, c, g, or t
tcagtacgctgtctcacgaccggtgctcgatttagtcacgcgagaagggggaggaactgctcagttaggacccagacggaaccatggaagccccagcgcagcttctcttcctcctgctactctggctcccagattccactggagaaatagtgatgacgcagtctccagccaccctgtctgtgtctccgaggggaanagcccaccctctcctgcagggccaatcagagtattagcagctaacttagcctaggtaccagcagaaaccgtggaccaggcctcccgaggctcctcatctagtggtcnctactcccgaccacgggcccacgtgtcctacgtaccccagtcccgaggtttccgtacggtcgggtacgacgggttcggggtccgtacggggtaacaggtacgtttccaaccttccgtacccgaaccctattcccgaggtaccgaccgcccgttcgacgtacggttcgtagtaacggttaacttttgaccgtttaaggttttactttccgtacgcccgtagtaccgtaactttaacgttaacctttaccggttacccggtacccgttaccgggttacccgggttaccggtaccggtttacccgggtacccgtaaaccgggtaacccgggtaaaggggttaaccggaaaacgttacccggaaaaccggttacggttaccggtaggttacccgtaaccggtaccctaaacccgtacgttacccgttgtttaccccccg

SEQ ID NO: 136004 - DNA, 747 bp, Homo sapiens
  misc_feature: GYAE6OF01COOF4.36.66.F11.1.454.CMB.1.raw
  modified_base (219)..(219): a, c, t, g, unknown or other
  misc_feature (219)..(219): n is a, c, g, or t
tcagtacgctgtctcacgaccggtgctcgatttagtcacgcgagaagggggaggaactgctcagttacggacccagacggaaccatggaacgcccagcgcagcttctccttcctcctgctactcgtcggcctcccagtacttccagtaggaataaatgtgaatgacgtcacgtccaccacgcccaccgttgtctggtcgtccgtaccgggaagggaacnccgccctacctctcgcgacgacggactaagtcgagtaagtactacgacgtacgtactaacgttcgaccgtacgaccgagtaaccaacggtaaccgcggaccgtacggtccctccgacggtccttaccgtactattccggttaggtacggtccaccgtaccgacccgaaccggtacgaccctaacgtccgtaaccctcgacccgtacgtaccgtaggttcgacggtacggagtacggggttggtcgtaacggactaggtaccttccacgttcccaacgtacacgaccacggtacacgtccgtaggctacgtacgtaagtacgtttacgttacgtacgtttaagttccttacgacgtacgtagtaacctaactttacgtacggttaccgtacggttacgttaccgggttcggtacggttaaccggacccggtaagaacccgggtaaaggtaacggtaaacgtaaacggttaaccgaagttaaccggtcggtacgttacaaccggtaacctacggtcttacgaccttaccg

SEQ ID NO: 136005 - DNA, 718 bp, Homo sapiens
  misc_feature: GYAE6OF01AQJ5M.36.66.F11.1.454.CMB.1.raw
  modified_base (304)..(304): a, c, t, g, unknown or other
  misc_feature (304)..(304): n is a, c, g, or t
tcagtacgctgtctcacgaccggtgctcgatttagtcacgcgagaagggggaggaactgctcagttaggacccagacggaaccatggaagccccagcgcagcttctcttcctcctgctactctggctcccagattccactggagaaatagtgatgacgcagtctccacgccaccctgtctgtgtctccgaggggaagcgcccaccctctcctgcgaggccaatcagagtattagcagctaactgcctaggtaccagcaagaacctcggccgacggcctccgagcctcctacatctagtggtacncacgtcccgacgacggaccctacgtcgtacctactacccgaggtacccgacggttcgaggtcgacgtagggttcggtacggtacgggtactaggttacgttaccctcgtaccctacaccctattacccgacgtaccgtacgtccgtcgacgtaggttactaggtaagtttacgttcgtaaccgtttagtttacctttcgacgtccgtatactaacgttacgttaacgttacggtaccgtaccgtttacgggtaccgtttacggggtacccgtacccgggtaaacggtaacccgggtaaacccggtaaggggtaaacggttaaaccgtaaccggggtaaaacggttccggttacgggttacggacccggttaacccgaacccgttaacttcccgtttaacggtcccctttaacgg

SEQ ID NO: 136006 - DNA, 852 bp, Homo sapiens
  misc_feature: GYAE6OF01BGVVX.36.66.F11.1.454.CMB.1.raw
  modified_base (624)..(624): a, c, t, g, unknown or other
  misc_feature (624)..(624): n is a, c, g, or t
tcagtacgctgtctcacgaccggtgctcgatttagtcacgcgagaaggggggaggaactgctcagttaggacccagacggaaccatggaagccccagcgcagcttctcttcctcctgctactctcggcctcccagtacttccactagggaagaaatagtgatcggacgctagtctaccgacgccctaccctgtccgtgtgtcctaccggaaggggaaacgtacgccctacccctcgttccgtacgacgacgggtaccaaagtcgaaggtacgttaaacgttacgactacggaacttaacgttacggccgttacgggtaccaacggtaccgaaaccgtaaaacccggttcgggacccgtacgggtacccgtacccggacggtaccttccctactacgttaccgttacgtcggtaccgacctaaccgtaccccggaaccggtaccgggtaccctaaccgttacgacccttaacgttaccccggaacggtcccggtacggttacggacggtgggtaccgtagggttcggacggtcggaacggtagtaccgttactcgtcctaaccgactacgtacaacggttccgaaccgtacgttcggaccttaagtaccgtaagttaaacgtttntttaccgaagtttttacgtttaccgttacgaccgttaaccgaacttaacgtttaacgttaaacgtttaccgttaccggtgttaacccggtttacgggttaaccgttacgggtacccgttaaacggaaccggtaaacgggtaaccgggtaaaggttcgtaaaacggtaacccgtaagttacggtacgggtggaactcggacccgtttaattaccggttctcgttaaccg

SEQ ID NO: 136007 - DNA, 532 bp, Homo sapiens
  misc_feature: GYAE6OF02HIVQ1.36.66.F11.1.454.CMB.1.raw
tcagtacgctgtctcacgaccggtgctcgatttagtcacgcgagaagggggaaggaactgctcagttaggacccacgaccggaaccatggaagccccagcgcagcgttctcttcctccgtgctactctggctcccagattccactggagaaatagtgatgacgcagtctccagccaccctgtctgtgtctccaggggaaagagccaccctctcctgcagggccaatcagagtattagcagcaacttagcctggtaccagcagaaacctggccaggctcccaggctcctcatctatggtgcatccaccagggccactgctatcccagccaggttcagtggcagtggtctgggacagagttcactctcaccatcagcagcctgcagtctgaagtattttgctagttttatttctgccagcctactattaattactggtccttcgtacgtcggtacgttcggaccgaagggaccaagggtaggaaacttacgaaacggaacgttggtaggctggacctaccgattccgtgttacc

SEQ ID NO: 136008 - DNA, 570 bp, Homo sapiens
  misc_feature: GYAE6OF02JMC5L.36.66.F11.1.454.CMB.1.raw
tcagtacgctgtctcacgaccggtgctcgatttagtcacgcgagaagggggaggaactgctcagttaggacccagacggaaccatggaagccccagcgcagcttctcttcctcctgctactctggctcccagattccactggagaaatagtgatgacgcagtctccagccaccctgtctgtgtctccaggggaaagagccaccctctcctgcagggccaatcagagtattagcagcaacttagcctggtaccagcagaaacctggccaggctcccaggctcctcatctatggtgcatccaccgagggcccactgctatccccagccaggttcagtggcaggtcggtctgggacagattccactctcaccatcagcagcctgcagtctagaagtatttgacttagttttattcgtgccagcctacttaagttaacttcgtacggtccttacgttacggttcggtaccgttccgggaccgtaaacgggacctaaggggttcggaaacttaccgaaaccggtaacgttacggttcgggacttacgaccgtaaccgtacttcgttacgttaccg

SEQ ID NO: 136009 - DNA, 493 bp, Homo sapiens
  misc_feature: GYAE6OF02GLJ67.36.66.F11.1.454.CMB.1.raw
  modified_base (491)..(491): a, c, t, g, unknown or other
  misc_feature (491)..(491): n is a, c, g, or t
tcagtacgctgtctcacgaccggtgctcgatttagtcacgcgagaagggggaggaactgctcagttaggacccagacggaaccatggaagccccagcgcagcttctcttcctcctgctactctggctcccagattccactggagaaatagtgatgacgcagtctccagccaccctgtctgtgtctccaggggaaagagccaccctctcctgcagggccaatcagagtattagcagcaacttagcctggtaccagcagaaacctggccaggctcccaggctcctcatctatggtgcatccaccagggccactgctatcccagccaggttcagtggcagtgggtctgggacagagttcactctcaccatcagcagcctgcagtctgaagattttgctagttttatttctgccagcactataattactgcctgtacgtggacgttcgccaagggacaaggtggaaatcaaacgaactgtaggctgcaccatctntc

SEQ ID NO: 136010 - DNA, 540 bp, Homo sapiens
  misc_feature: GYAE6OF02FS51K.36.66.F11.1.454.CMB.1.raw
  modified_base (197)..(197): a, c, t, g, unknown or other
  misc_feature (197)..(197): n is a, c, g, or t
  modified_base (320)..(320): a, c, t, g, unknown or other
  misc_feature (320)..(320): n is a, c, g, or t
  modified_base (366)..(366): a, c, t, g, unknown or other
  misc_feature (366)..(366): n is a, c, g, or t
  modified_base (397)..(397): a, c, t, g, unknown or other
  misc_feature (397)..(397): n is a, c, g, or t
  modified_base (410)..(410): a, c, t, g, unknown or other
  misc_feature (410)..(410): n is a, c, g, or t
tcagtacgctgtctcacgaccggtgctcgatttagtcacgcgagaagggggaggaactgctcagttaggacccagacggaaccatggaagccccagcgcagcttctcttcctcctgctactctggctcccagattccactggagaaatagtgatgacgcagtctccagccaccctgtctgtgtctccgaggggaaanagccaccctctcctgcagggccaatcagagtattagcagcaacttagcctggtaccagcaagaacctggccaggcctcccaggcctcctcatctagtggtgcatcccacgaggccactgctancccagccaggttcagtggcaggtggtctgggacagtagttcactcncaccatccagcagcctgctagtctagaagtntttgcttagtttnttactgaccagtcacttataagttactcggtcctcgttacgtcggtaccgttcggaccgtaagggtaccgtaaggtcggtaaacgtacgaaacgtacgtaggtacggtctgacctacgtactcgtgttcc

SEQ ID NO: 136011 - DNA, 514 bp, Homo sapiens
  misc_feature: GYAE6OF02H0A04.36.66.F11.1.454.CMB.1.raw
  modified_base (352)..(352): a, c, t, g, unknown or other
  misc_feature (352)..(352): n is a, c, g, or t
tcagtacgctgtctcacgaccggtgctcgatttagtcacgcgagaagggggaggaactgctcagttaggacccagacggaaccatggaagccccagcgcagcttctcttcctcctgctactctggctcccagattccactggagaaatagtgatgacgcagtctccagccaccctgtctgtgtctccaggggaaagagcccaccctctcctgcagggccaatcagagtattagcagcaacttagcctggtaccagcagaaacctggccaggctcccaggctcctcatctatggtgcatccaccagggccactgctatcccagccaggttcagtggcagtggtctgggacagngttcactctcacatcagcagcctgcagtctgaagtattttgctagttttattactgtcagcagcgtagcaacgtcggccgtaccggggtactttcgggcggagggacctaagggtggagagttacgaaacggtaacgtgtggctggaccaccattctgttcc

SEQ ID NO: 136012 - DNA, 552 bp, Homo sapiens
  misc_feature: GYAE6OF02GO665.36.66.F11.1.454.CMB.1.raw
  modified_base (197)..(197): a, c, t, g, unknown or other
  misc_feature (197)..(197): n is a, c, g, or t
  modified_base (293)..(293): a, c, t, g, unknown or other
  misc_feature (293)..(293): n is a, c, g, or t
  modified_base (399)..(399): a, c, t, g, unknown or other
  misc_feature (399)..(399): n is a, c, g, or t
tcagtacgctgtctcacgaccggtgctcgatttagtcacgcgagaagggggaggaactgctcagttaggacccagacggaaccatggaagccccagcgcagcttctcttcctcctgctactctggctcccagattccactggagaaatagtgatgacgcagtctccagccaccctgtctgtgtctccgaggggaaanagccaccctctcctgcagggccaatcagagtatagcagcaacttagcctggtaccagcagaaacctggccaggctccaggctcctcatctatggtncactcccaccgagggccacgtgctactcccagcctaggttcagtcggcaggtggtctgggactagagttcacgtctacacctatcagcacgctgctagtctagatntttgcttagtttacttcgcgtcagtactattaattaacttcgtgtccttacggtacgttcggtaccgttacggaccgaagggtaccgtaagggtacggtaaactacgaaacggtacgtcggtaggtactcgacctaccgtagtccgtgttacc

SEQ ID NO: 136013 - DNA, 562 bp, Homo sapiens
  misc_feature: GYAE6OF02HIAG4.36.66.F11.1.454.CMB.1.raw
  modified_base (375)..(375): a, c, t, g, unknown or other
  misc_feature (375)..(375): n is a, c, g, or t
tcagtacgctgtctcacgaccggtgctcgatttagtcacgcgagaagggggaggaactgctcagttaggacccagacggaaccatggaagccccagcgcagcttctcttcctcctgctactctggctcccagattccactggagaaatagtgatgacgcagtctccagccaccctgtctgtgtctccaggggaaagagccaccctctcctgcagggccaatcagagtattagcagcaacttagcctggtaccagcagaaacctggccaggcctcccaggcctcctcatctatggtgcatccaccagggcccactcgctactcccagccaggttcagtggctaggtggtctgggacaggtacgttcactctccacntcagcagcctgcagtctagaacgttatttcgacttagttttacttctcgtccagtacctaatattaacttacgtcggtcctacgttacgttcggtaccgttccggaccgtaacgggactaagggtacgtaaacgtaccgtaaacggtacgtaggtacgacgttcgacctaccgacgttctacgttcc

SEQ ID NO: 136014 - DNA, 706 bp, Homo sapiens
  misc_feature: GYAE6OF02G9VN2.36.66.F11.1.454.CMB.1.raw
  modified_base (218)..(218): a, c, t, g, unknown or other
  misc_feature (218)..(218): n is a, c, g, or t
tcagtacgctgtctcacgaccggtgctcgatttagtcacgcgagaaggggggaggaactgctcaggttaggacccagaccggaaccgattggaaggcccctagcgtcgagcttctcttcctcctagctactctaggcctcccagagttcctacgtggagaaattaggtgttatgacgcagttacgtccagccacctgtctgtgtctccaggggaaacnggccacccgggtctccgttggccgacgggtccgaactacagtagttacttaggcagccaacttagccgtaggtaccagtcaagtaacctggaccaggacctcccgaggcctcctcagtcgtagtggtcgctacgtcccaccgacgggcctacgtcgctactcccgagccgtagggttccaggtcgactaggttcgggtctaggggactaggtacgttccacgttcctctacccatccgacgccacgcctacgacgtacgtctacgtaacgttgttttcgacgttaagttttactttccgacgtacctaggtactaacgttaacgttaaacgttccgtacggttccctttacggttaaccgttcgggtaaccgtttaccgggaaccgtaacgggtaccgttaaggggtttacggaaacgttaccgtaaacggtaaccgttgggtaccgtcgttacggacccgtaacggtacggttccgttacgtttccg

SEQ ID NO: 136015 - DNA, 557 bp, Homo sapiens
  misc_feature: GYAE6OF02FR60R.36.66.F11.1.454.CMB.1.raw
  modified_base (400)..(400): a, c, t, g, unknown or other
  misc_feature (400)..(400): n is a, c, g, or t
tcagtacgctgtctcacgaccggtgctcgatttagtcacgcgagaagggggaggaactgctcagttaggacccagacggaaccatggaagccccagcgcagcttctcttcctcctgctactctggctcccagattccactggagaaatagtgatgacgcagtctccagccaccctgtctgtgtctccaggggaaagagccaccctctcctgcagggccaatcagagtattagcagcaacttagcctggtaccagcagaaacctggccaggcctcccaggctcctcatctatggtgcatcccaccgacgggccactgctactcccagcctaggttcagtggctaggtcggtcgtgggacaggagttcactctcaccatcagcacgcctgctgtctgtaatntttgattagtttatttctgtaccatactacttataacttacgtcgtaccgttcggttacgtcggtaccggttcggaccgtaagggtaccgaagggtacggaaactaccgaaacggtaacgttcggtaggtctacggaccactacttcgtcgttaccg

SEQ ID NO: 136016 - DNA, 639 bp, Homo sapiens
  misc_feature: GYAE6OF02G1K0R.36.66.F11.1.454.CMB.1.raw
  modified_base (196)..(196): a, c, t, g, unknown or other
  misc_feature (196)..(196): n is a, c, g, or t
tcagtacgctgtctcacgaccggtgctcgatttagtcacgcgagaagggggaggaactgctcagttaggacccagacggaaccatggaagccccagcgcagcttctcttcctcctgctactctggctcccagattccactggagaaatagtgatgacgcagtctccagccaccctgtctgtgtctccaggggaaangccaccctctcctgcagggccaatcagagtattagcagcaacttagcctggtaccagcagaaacctggccaggctcccaggcctcctcatctagtggtgcactccaccgacgggccactcgctactcccagccgtaggttcagtggctaggtgggtcgtggacaggtatccgactctacaccagtcacgctacgccgtgactagttctaggaagttattttacgtacctttaagtttttacttttccgtcgttaccgtacggtactaacttaacttaacgtttaccgtacggtcccttacggttaccggttacgggtaaccgttccgggacccgtaaaggggtacccgtaaggggttaacgtaaacggtaaccgtaaaacggtacgttacggttacggaccggtttcggaacccttacccgtaagttcccgttacgttacccg

SEQ ID NO: 136017 - DNA, 761 bp, Homo sapiens
  misc_feature: GYAE6OF02JJRFH.36.66.F11.1.454.CMB.1.raw
tcagtacgctgtctcacgaccggtgctcgatttagtcacgcgagaagggggaggaactgctcagttaggacccagacggaaccatggaagccccagcgcagcttctcttcctcctgctactctggctcccagattccactggagaaatagtgatgacgcagtctccagccaccctgtctgtgtctccgaggggaaagagccaccctctcctgcagggccaatcagagtattagcagcaacttagcctggtaccagcagaaacctggccaggcctccaggcctcctcatctagtggtgcactcccaccgacgggccactgactactccccagcccgtagggttccaggttcggcgtaggttcgggtccgtaggggaacacggtacgtttacccgactcccgttacgacctaacgttccgacggtcctaacgggtcccttcggaccgttacggttaccttaagggtaaacgtttacgttttttcggaccgttttaaaggtttttaccgtttttacccgacgggttaccccgtaaggtaaccctttaaaccgtttaaacgtttaaaccgttttacccggttaccgggggtttaccccttaacccggggtttaacgggtttaccgggttaccgtttacccgggggaacccgttaaacgggggtaccgttaaacggggtaacggtaaaactaacccggtaaaacggtaaccgtgggttacggtacccgtacggtacccgaaccgttaacgtccgtttcgtttaacc

SEQ ID NO: 136018 - DNA, 602 bp, Homo sapiens
  misc_feature: GYAE6OF02GHRGB.36.66.F11.1.454.CMB.1.raw
  modified_base (197)..(197): a, c, t, g, unknown or other
  misc_feature (197)..(197): n is a, c, g, or t
tcagtacgctgtctcacgaccggtgctcgatttagtcacgcgagaaggggggaggaactgctcagttaggacccagacggaaccatggaagccccagcgcagcttctcttcctcctgctactctggctcccagattccactggagaaatagtgatgacgcagtctccagccaccctgtctgtgtctccaggggaaanagccaccctctcctgcagggccaatcagagtattagcagcaacttagcctggtaccagcagaaacctggccaggcctcccaggcctcctcatctatggtgcatccaccagggccactgctactcccagccaggttcagtggcaggtgggtctgggacaggagttcactctcaccatcagccagtccctgctaggtctaggaagttagttttgacttaagttttatttcgtgacctagtacctaacttaattaaacttaccgttgggacccttacgggttacgttcgggtaccggttaccgggaccgtaacgggtaccgtaagggttaacggaaaacttaaccgaaaaccgtaacggttacggtacggtacctacggaccctaacctacgttcgtacgtttacccg

SEQ ID NO: 136019 - DNA, 622 bp, Homo sapiens
  misc_feature: GYAE6OF02GBSOU.36.66.F11.1.454.CMB.1.raw
tcagtacgctgtctcacgaccggtgctcgatttagtcacgcgagaagggggaggaactgctcagttaggacccagacggaaccatggaagccccagcgcagcttctcttcctcctgctactctggctcccagattccactggagaaatagtgatgacgcagtctccagccaccctgtctgtgtctccaggggaaagagccaccctctcctgcagggccaatcagagtattagcagcaacttagcctggtaccagcagaaacctggccaggcctcccaggctcctcatctagtggtgcatccaccgagggccactgctatcccagccaggttcagtggctaggtgggtctgggactaggagttcacttctacacctatcagcacgcctgcgtagtcctaggaacgttagttttcgacgttagtttttactttctacgtccctaagtcctaaactttaagttaactttaccgtacggttacccgttacggttaacggttacggttaccggtttccgggaccggtaaacggggtacccgaagggttaacggaaacgttaccggaaaaccggtaacgttacggtacggtaccgttcggaacccaccgtacttccgtacgtttaccc

SEQ ID NO: 136020 - DNA, 604 bp, Homo sapiens
  misc_feature: GYAE6OF02GX9XM.36.66.F11.1.454.CMB.1.raw
  modified_base (197)..(197): a, c, t, g, unknown or other
  misc_feature (197)..(197): n is a, c, g, or t
  modified_base (295)..(295): a, c, t, g, unknown or other
  misc_feature (295)..(295): n is a, c, g, or t
tcagtacgctgtctcacgaccggtgctcgatttagtcacgcgagaagggggaggaactgctcagttaggacccagacggaaccatggaagccccagcgcagcttctcttcctcctgctactctggctcccagattccactggagaaatagtgatgacgcagtctccagccaccctgtctgtgtctccgaggggaaanagcccaccctctcctgcagggccaatcagagtatagcagcaacttagcctggtaccagcagaacctggccaggcctccaggcctctcatctagtggcncactcccaccgacgggcccactggcctactccccagccctagggttccaggtcggctagggttcgggtctggggacaggtaccttcactctacgaccatcagacagacgtggacgtcctaggaacgttagtttcggccgttagttacttacgtacgtaccaactactagttcggttacccttcgttaccgttacgttaccgttacgttttcggaccggtaacgggtaacctaaggtcgtaggagtacgttaaccgaaacgttacgtggttcgtacgtacgacctaccgtacgtcgttcgttacttaccg

SEQ ID NO: 136021 - DNA, 544 bp, Homo sapiens
  misc_feature: GYAE6OF02F6SBF.36.66.F11.1.454.CMB.1.raw
  modified_base (196)..(196): a, c, t, g, unknown or other
  misc_feature (196)..(196): n is a, c, g, or t
  modified_base (383)..(383): a, c, t, g, unknown or other
  misc_feature (383)..(383): n is a, c, g, or t
tcagtacgctgtctcacgaccggtgctcgatttagtcacgcgagaagggggaggaactgctcagttaggacccagacggaaccatggaagccccagcgcagcttctcttcctcctgctactctggctcccagattccactggagaaatagtgatgacgcagtctccagccaccctgtctgtgtctccaggggaaanagccaccctctcctgcagggccaatcagagtattagcagcaacttagcctggtaccagcaagaaacctggaccaggctcccaggctcctcatctatggtgcatccaccagggccactgctatcccagccaggttccagtgcagtggtctggacagtagttcactctcaccatcagcagcctgcagtntagagtatttgcttagtttatttctgcctagctactaattaacgttaccgtcgtaccgttagtacggtcgttacggtaccgaccggaacggacggtaacggtaaacgaacgtaaacgaaacgtaagtcggtacgtacgcgaccaccgtacttcgtacgttc

SEQ ID NO: 136022 - DNA, 683 bp, Homo sapiens
  misc_feature: GYAE6OF02IDQ1I.36.66.F11.1.454.CMB.1.raw
  modified_base (167)..(167): a, c, t, g, unknown or other
  misc_feature (167)..(167): n is a, c, g, or t
  modified_base (199)..(199): a, c, t, g, unknown or other
  misc_feature (199)..(199): n is a, c, g, or t
  modified_base (209)..(209): a, c, t, g, unknown or other
  misc_feature (209)..(209): n is a, c, g, or t
tcagtacgctgtctcacgaccggtgctcgatttagtcacgcgagaagggggaggaactgctcagttaggacccagacggaaccatggaacgccccagcgcagcttcgtcttcctcctgctactctggctcccagattccacgtggagaaatgtgatggacgcagtcnccagccacctgtctgtgtctccgaggggaacngccacccgtntcctgcaggccaatcagagtattacgcaggactaacttaggccgttaggaaccgtacgcgaagtaaccgtcggccaacggtcctacccggaggtcctacgacttacacgttccgtagtcggtttcgactaacctacccggaaccgtacgggaccctacggttacgtacgtacccctacggtcccttaacgtttacggaggccgtagggttcgggtacgtcggggacctaaggttaccgtccttaacgtccgaaccgtacctacgtccgaacggcctacggtcctacggacgtacgtaccgtagtaacggttcgtttcgactttaagtttacttaccgttacgaaccgtactactactacggttcgaccttcggacctactaccgtacgttacggacggtacgacggtacgtcggaagtcgaacctaacggtacgtgtacggtacgtcaccgtccgttatccgttacgcgtttac

SEQ ID NO: 136023 - DNA, 727 bp, Homo sapiens
  misc_feature: GYAE6OF02GWU2X.36.66.F11.1.454.CMB.1.raw
  modified_base (196)..(196): a, c, t, g, unknown or other
  misc_feature (196)..(196): n is a, c, g, or t
tcagtacgctgtctcacgaccggtgctcgatttagtcacgcgagaagggggaggaactgctcagttaggacccagacggaaccatggaagccccagcgcagcttctcttcctcctgctactctggctcccagattccactggagaaatagtgatgacgcagtctccagccaccctgtctgtgtctccgaggggaangccaccctctcctgcagggccaatcagatatagcagacaacttagcctggtaccagacaacgaacctggaccagggcctacccgaggtcctcctacaacttccgtagtgggtcgactaccgtcccgaccgacgggaccctacgtcgaccttactccccgtacgacccgtaggttccacggtcggtacgtagggttcgggtacgtaggggactaggtacgttccaacgtttcctaccgaaccgtacgttaccgaacggtacccaaccggtccccgttaggtaccgtacggtttaacgtaaggttaaacgttttacgtttttcgggaacctttttaaggtttttaccttccgttaccggacctaacggtaccttaaacttaagtttaaaccgttccggtaccggttaccgttacggttacggttcggtaacccggtttaccgggaaccgtaagggtaccgtaaggtacgtaaactaccggaaagtccgttacgggtacgtccgtacggtacccacgtacgttaccgtgttacc

SEQ ID NO: 136024 - DNA, 647 bp, Homo sapiens
  misc_feature: GYAE6OF02ID28T.36.66.F11.1.454.CMB.1.raw
  modified_base (199)..(199): a, c, t, g, unknown or other
  misc_feature (199)..(199): n is a, c, g, or t
  modified_base (323)..(323): a, c, t, g, unknown or other
  misc_feature (323)..(323): n is a, c, g, or t
  modified_base (441)..(441): a, c, t, g, unknown or other
  misc_feature (441)..(441): n is a, c, g, or t
  modified_base (465)..(465): a, c, t, g, unknown or other
  misc_feature (465)..(465): n is a, c, g, or t
tcagtacgctgtctcacgaccggtgctcgatttagtcacgcgagaagggggaggaactgctcagttaggacccagacggaaccatggaagccccagcgcagcttctcttcctcctgctactctggctcccagattccactaggagaaactagtgatgacgcagtctccgagccacctgtctgtgtctccgaggggaaanagcccaccctctcctcgcacgggccaatcagagttattagcgacgactaacttagccgtaggtaccagacaacgaaacctggaccacggcctacccgaggtcctccgtcattccgagtggtacnctactacccgaccgacgggccacgtcgactacctcccgagaccgtaggttcaggtcggctaggtcggtcgagggacaggtacgttcactcgtcctaactactcaacgtcgactccgtnccgtaagtacgtagtaaacggttntttacggactttaaggttttacttccgacgtacctacggtaccttaagttaactttaagttccgtccgtaccggttcggtacgttacggtccggttacgaccggttaacggacgtaacgggttagaaactacgaaacgtgtaccgtacggtacgtacaccgttactacgttcgtattacccg

SEQ ID NO: 136025 - DNA, 574 bp, Homo sapiens
  misc_feature: GYAE6OF01A70UM.10.80.H03.1.454.CMB.1.raw
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagccaccctcggtgtcagtggccccaggacagacggccacgctgacctgtggggatacacaattggaagtaatcgtgtgcactggtaccagcagaggccaggccaggcccctgtggttgtcgtctataatgataacgaccggcctcgagggatccctgagcgattctctggctcaataggcaacgacggccaccctcactcactcaccgagggtcgaggccggggatggacggccgactacgtactgtcaggtgtgggtatttcacgttacgtgattcgagttgggtggggttcttcggggcgggtaacgggacctaaggccgtacggtaacccggtccgtaagtccgaacgaccccgaaaggtcccgtccggccccccgttgggtccctaccgttccgttaccccg

SEQ ID NO: 136026 - DNA, 723 bp, Homo sapiens
  misc_feature: GYAE6OF01A9BID.10.80.H03.1.454.CMB.1.raw
  modified_base (227)..(227): a, c, t, g, unknown or other
  misc_feature (227)..(227): n is a, c, g, or t
  modified_base (300)..(300): a, c, t, g, unknown or other
  misc_feature (300)..(300): n is a, c, g, or t
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagccaccctcggtgtcagtcggccccaggagagacggccaggataaccgtggtggggganacgagcagttagaaagtgaagctgtccactggtaccagcagaggccaggccacggcccctgtactcggtcctntactgatgatagtcgaccggccctcgaacgggtactcccgtggacgcgtacttctcgtcggacctaccgtaactcgtacgggaaccaccgggtcccaacccgtcgacccagtacccgacgtacgggtaccgaacggcccggggtaatcggaaccgggtaccgtagtacgtttagttcggtacgtagggttgttacgggtttaatttaccgaaggttacgttagtttaccggtaacggggttttcccggggggtttaccggacggggtaacggggtaccctaaacgggtccgttacgggtaccccggttaccgttaacgggtccgtaaccggccccggtaaacgggtcccgttccccggaccccccggttacgggttacccctaacccggtttacccttcccggttaccccccttacccccccg

SEQ ID NO: 136027 - DNA, 739 bp, Homo sapiens
  misc_feature: GYAE6OF01CJS0J.10.80.H03.1.454.CMB.1.raw
  modified_base (226)..(226): a, c, t, g, unknown or other
  misc_feature (226)..(226): n is a, c, g, or t
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagccaccctcggtgtcagtcggccccaggagagacggccaggataacctggtggggganacagcattgaaagtgaagctgtccactggtaccagcagaggccaggccaggcccctgtactggtcctctatgatgatagtcgaccgccctgacgggactcccgtgacgcgtattctcgtggcctccaaactcgtacgggaaaccaccggcccaccctgaacccactccaaccgtagggtaccgaacgggcccgggggaatacgggaacgggtacccgtaacttagttaagtttcggtaccgtagggtttggttagggtttaacttttaccggtaaggtttaacggtttaatttacccggtaacggggttttcccgggggggtttttacgggaccgggggttaacggggtaaccctaaacggggtcccgttacgggtaaccccggttacccggttaacgggttcccgaacgggtacccccggtaaacggggtccccgttccccgggtacccccccgttacgggttacccctacccgtttccccgttcccggtttacccccccgttaaccccccg

SEQ ID NO: 136028 - DNA, 622 bp, Homo sapiens
  misc_feature: GYAE6OF01B7LRT.10.80.H03.1.454.CMB.1.raw
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagccaccctcggtgtcagtggccccaggagagacggccaggataacctgtgggggagacagcattgaaagtgaagctgtccactggtaccagcagaggccaggccaggcccctgtactggtcctctatgatgatagtgaccggccctcgagggactcccgtgacgcgattctcgtggcctaccaactctagggaaccaccggccacccgtgacccatccaccgacgggtcgaacggccggggatcggacggccgtacgtagtttacttggtacgtaggttgtaggttattttacgaagttagttagttcgtacggttcccggggggtttttcggacgggtaacgggacccgaaggtccttacggacccgttccgtaacgggtccacggaccccgaagggcccttccggcccccccgttcggtaccaccttcccgttccgttcccccgtacccccg

SEQ ID NO: 136029 - DNA, 803 bp, Homo sapiens
  misc_feature: GYAE6OF01BSVYP.10.80.H03.1.454.CMB.1.raw
tcagcatagtagtgcacgaccggtgctcgatttagctgtgcgtcgaagggaaagggctgggcctaaggaagcagcactggtggtgcctcagccatggcctggaccgttctcctcctcggcctcctctctcactgcacagaccttctgtcgaccctcctagtcgccgtctacgacctcgaccgccctacccgtggtcgtaccgacggtccggaccccgaaggaccgacggaccgccgtacgtcgtacgaccggttagggtacgggtaactaacgtaacgtaagttaggtaagttacgtcgtcgtacgacgtacgtacgacgacgacgacggaccgacgacggtaccgtaccggtccgttaggttacgttcgtacgttattaacgtacgtacgtaaccgaaccggtcccgtacgtacggtaccgtaccgtccggaacgtccggtacttacgtcgtacgtaccgtaccctacggtacgtacccgaacctacccggcccgtaccctacgtacaccgtaccgacggtaccggtacgggtaccgggtacggtaccgggacgtaccggtaccggtacgtaccgtactacggtcgtacggtacggttcggtacgttacgtacttaccgacgttacggtacgttcgggtaggtcggggttacgggttaccgggttaaccggcgggtaacggtaccgtaaccgtaccggttaccggtacccgttaacccggtacggacccgtccggtaaacccggtcccgtaccgttcccgtacccggtaccttaccgtacccttccgtacccccgttacccg

SEQ ID NO: 136030 - DNA, 620 bp, Homo sapiens
  misc_feature: GYAE6OF01D917D.10.80.H03.1.454.CMB.1.raw
  modified_base (224)..(224): a, c, t, g, unknown or other
  misc_feature (224)..(224): n is a, c, g, or t
  modified_base (380)..(380): a, c, t, g, unknown or other
  misc_feature (380)..(380): n is a, c, g, or t
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagccaccctcggtgtcagtcggccccaggagagacggccaggataacctgtgggganacagcattgaagtgaagctgtccactggtaccagcagaggccaggccaggcccctgtactggtcctctatgatgatagtcgaccgccctgagggactccctggacgcgtattctcgtggcctccaactcgtcggaacacggcccaccctgacccanaccacgagggtcgaaggccggggatggacggccgacgtattagttgtcgtaggttgtggttatttacgtagttagttacttacggtacgggtttccgggggttttccggcggggtagggtacccgaaggtccgttaggacccgtaccggtacgggtccgaacggtccccggtaaacggcccgttacccggccccccgtccggttccctacccgttcccgttccgttccccccgtcccccg

SEQ ID NO: 136031 - DNA, 595 bp, Homo sapiens
  misc_feature: GYAE6OF01CLABQ.10.80.H03.1.454.CMB.1.raw
  modified_base (225)..(225): a, c, t, g, unknown or other
  misc_feature (225)..(225): n is a, c, g, or t
  modified_base (294)..(294): a, c, t, g, unknown or other
  misc_feature (294)..(294): n is a, c, g, or t
  modified_base (334)..(334): a, c, t, g, unknown or other
  misc_feature (334)..(334): n is a, c, g, or t
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagccaccctggtgtcagtcggccccaggagagacggccaggataaccgtgtggggganacagcattgaaagtgaagctgtccactggtaccagcagaggccaggccacggcccctgtactggtcctntatgatgataggtcgacccggccctcgacgggactcccgngacgcgattcgtctcggctcaacgtcgtagggaaccacggaccaccagtcgaccactaccaccgagggtacgaacggccgggatggacggccgatattagttgtcgtaggtgtggtactttcgagttagtattcgtagttccgggggtttcggcgggtacggtaccgaaggtccgtagacccgtccgtacgggtactacggcccgtaacgggcctcccggtcccccttacggtcctaccctccgtacccggttcccccccg

SEQ ID NO: 136032 - DNA, 724 bp, Homo sapiens
  misc_feature: GYAE6OF01DZZF8.10.80.H03.1.454.CMB.1.raw
  modified_base (227)..(227): a, c, t, g, unknown or other
  misc_feature (227)..(227): n is a, c, g, or t
  modified_base (297)..(297): a, c, t, g, unknown or other
  misc_feature (297)..(297): n is a, c, g, or t
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagccaccctcggtgtcagtcggccccaggagagacggccaggataaccgtggtggggganacagcattagaagtgaagctgtccactggtaccagcagaggccaggccacggcccctgtacctggtcctntagtgatgatagtcgaccggccctagacgggtactcccgtgacgcgtattcgtctcggtctacctaacgtcgtacgggaaccaccggacctacccgtcgaacccacgtacccgaaccggtaacggggtaccggaacgggaccccggggtagtacgggacgggtaccgtaaccgttagtttacgttcgtacgtagggttcgttaggtttactttcgtaaggttaacgtttacgtttacggtaacgggtttccgggggttttaccgggacggggtaacgggtaccgtaacggtccggtaccgggtacccgtaccggttaacggtaccgtaccggtacccggtaaacgggccccgttacccggtacccccccggttaccgggttacccctacccgtttcccggttccccgtttccccccggtaacccccc

SEQ ID NO: 136033 - DNA, 872 bp, Homo sapiens
  misc_feature: GYAE6OF01E30BT.10.80.H03.1.454.CMB.1.raw
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagccaccctcggtgtcagtggccccaggagagacggccaggataacctgtgggggagacagcattgaaagtgaagctgtccactggtaccagcagaggccaggccaggcccctgtactggtcctctatgatgatagtcgacccggccctcgacgggactccccgtggacgtcgtatttccgtcgtcggcctacccgaaacgttccgtacggggaaacccacccggggtaccccaacccccgttcggaacccctaacgttacccgaaacccccggtaaacggggggttacccggaaaacggggtccccgggggggtaaattacggggaaaccggggtccccggtaaacccgttaacccgttaacccggttacgggttaccgtaacgggggttacgggtttacgggggttaacttttttacccgaaaccgtttaaccgtttaacgggtaacgtttacccggtaaaggttttcgggggtttcggggggggtttacccgtttaccgggggggtaacccggggtaaacggggggtaaccccgtaaaacgggtccccggtttaaccgggtaacccccggtttaccccggttaaaaacgggttccccggaaacccgggtaccccccggtaaaaccgggggtccccgtttaccccgggaccccccccccggtttaccggggtttaccccgtaaaccccgtttttccccccggg

SEQ ID NO: 136034 - DNA, 672 bp, Homo sapiens
  misc_feature: GYAE6OF01B3N2J.10.80.H03.1.454.CMB.1.raw
  modified_base (232)..(232): a, c, t, g, unknown or other
  misc_feature (232)..(232): n is a, c, g, or t
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagcccaccctcggtgtcaggtcggccccagggagaggacggccaggactaaccgtggtggggganacagcattagaaagtgaagctgtccacgtggtaccagcagacggccaggccacggcccctgtacgtcggtcctgtatgatgagtaggcgacccggcctacggacgggactcccgtagacgcgtacttctcgtcggtcctaccgtaaggttccgggaccaacgacccggcccaccctcactcacgtccgaccgtaggggtcgacggggaccgggagtcggacggaccgtactaccgtacgtcgtacgagggttcggtagggttactttacgtaacgttacgtacgtattaccgtagttcggggttacgggggttccgttaccgggggacgggtaacgggtacccgtaacggtccggtaccgtaaccggttaccggtaacggtacccgaaccggtacccgaacgggtccctaccccggtccccccgttggtacccttacccg

SEQ ID NO: 136035 - DNA, 794 bp, Homo sapiens
  misc_feature: GYAE6OF01DLD9U.10.80.H03.1.454.CMB.1.raw
  modified_base (228)..(228): a, c, t, g, unknown or other
  misc_feature (228)..(228): n is a, c, g, or t
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagccaccctcggtgtcagtcggccccaggagagaccggccaggataaccgtggtggggganacagcattagaaagtgaagctgtccacgtggtaaccagcgagacggccaggccaggcccctgtactcggtcctctatgatagatacgtcggacccgcctacgagggtactccctgacgcgtacttcgtctggtcctacctaacgtccgttacggggaaaccgtacccgggacccctaaccccgttacggaaaccccctacttaacccggaaaccccggtaccgggggttaacccgggaaaccggggacccggggggtaacggtacggggtaaaccggggtacccggtaaaccgttttaaccgttaagttttacgggttaccggtaagggtttcggtttagggttttaacttttacgtaacggtttaacggtttaacgtttacggttaaccggggttttacccgggggggtttttccggggtaccggggtaacgggggtacccgaaaggtcccggttacggtacccggttaccgtacgggtacccgaaccggtacccggtaaacggcccgtccgtacccccccgttcggtacctacccgttcctccccgttcccccgtaaccccccg

SEQ ID NO: 136036 - DNA, 763 bp, Homo sapiens
  misc_feature: GYAE6OF01BCRDU.10.80.H03.1.454.CMB.1.raw
  modified_base (573)..(573): a, c, t, g, unknown or other
  misc_feature (573)..(573): n is a, c, g, or t
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgccgacctcctatgtgctgtctcacgcccacccgttcggtcgtcgacggtccggaccccgagggacggacggaccggccgaaggtactaaaccggtggggtaggggggaacgaacgagacgtaagttaacggaaaggtagaacgtccgtacggtacccgtaacgtacggtaaccacggacgaggaccggaccgacgggcctaccggtccccgttaggtaccgttcggtacccttatacggtagtacgttaggtacgttaggtaccggaccccggtacctacgggacggttacctccgtagacgtcgttacttccgtcgtacggctaccctaacgtcggtacggaaccaccggaccctaccgtacgacctactccgaacggtacgggcgaacgggtccggagtcggacgtaccgtaattgttattcggngttacgggttgttacggttattcgaaggtttacgttacgttacgggtacggggttttccgggggtacggtaccggggtacggaccgtagtccggtaccggttccgttaaccggtacggtcacccggtacccggagcccgttaccccggcccgttaccgtcaccgttcccgttacccgtcccctacccccg

SEQ ID NO: 136037 - DNA, 642 bp, Homo sapiens
  misc_feature: GYAE6OF01A9HAG.10.80.H03.1.454.CMB.1.raw
  modified_base (232)..(232): a, c, t, g, unknown or other
  misc_feature (232)..(232): n is a, c, g, or t
  modified_base (393)..(393): a, c, t, g, unknown or other
  misc_feature (393)..(393): n is a, c, g, or t
tcagcatagtagtgcacgaccggtgctcgatttagctgtgcgtcgaagggaaaggggctgggcctaaggaagcagcactggtggtgcctcagccatggcctggaccgttctcctcttcggcctcctctctcactgcacagcctctgcgacctcctatgtgctgtctcagcccaccctcggtgtcaggtcggccccgaggagaggacggccaggactaaccgtggtggggganacagcagttagaaagtgacgctgtccactcggtaccagcgaggacggccacggccgacggcccctgtacgtcggtcctctatgatgtagtcggtcgacccggtcctcgacgggtctccgtgacgtcgtcttctcgtcggctccaacgtcgtacgggaaccnccggccctacccgtacgaccctataccgaccgacggggtacgaacgggccggggatacggacggctatagttagtgtacgtaggtgttgtactttcggagttacgttacgttcgtacgggtttcccgggggttacgcggggtacggtaccgacgtcgtacggcccgtacggtggtacccgtacggacccggaccggtcctcccggtccccgtcggtacctacccgttccgtcccgttccccctaccccg

SEQ ID NO: 136038 - DNA, 621 bp, Homo sapiens
  misc_feature: GYAE6OF01AU8WJ.10.80.H03.1.454.CMB.1.raw
  modified_base (338)..(338): a, c, t, g, unknown or other
  misc_feature (338)..(338): n is a, c, g, or t
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagccaccctcggtgtcagtggccccaggacagacggccacgctgacctgtgggggatacacaattggaagtaatcgtgtgcactggtaccagcagaggccaggccaggcccctgtggttgtcgtctataatgataacggaccggccctcagggactccctgacgcgattcncgtggctccaattcgggacaacgacggcccaccctcactcactccaccgagggtacggagggccggggatggacggccgaactactacgtgtacgagggttcgtgggtatttccgaactacgttgatcgaagttcgggttagggggttcctttcggggaccgggtaacgggacccgtaagtcgtaccgtacccggttccgttaacggtccaacgggaccccgtaaacgggcccttacccgggcccccccgttacgggtaccctaccccgttcgtttacccccg

SEQ ID NO: 136039 - DNA, 795 bp, Homo sapiens
  misc_feature: GYAE6OF01EA6DY.10.80.H03.1.454.CMB.1.raw
  modified_base (163)..(163): a, c, t, g, unknown or other
  misc_feature (163)..(163): n is a, c, g, or t
tcagcatagtagtgcacgaccggtgctcgatttagctgtgcgtcgaagggaaaggggctgggcctaaggaagcagcactggtggtgcctcagccagtggcctggaccgttctcctcctcggcctcctctctcactgcacacgcctctgccgacctcctatgtncgtgtctacacgccctacccgtggtcgtcgacggtccggacccgagggagacgacggaccgaggactaacggtgggtaggggacacgagacgtagttaaggaaagtagaacgtcgtacgtccgtacgtacggtaccgagacggaaggaccggaccgtaccggaccgtaccggtaccccgttagtaccggttcggttcctacgtaagttcgagtaggtacgttacggaccgtacccggtccgtacggtacggacctccgtacggacgtcgtacttcgtcgtcgacctaccgacgtacggtacggaccgtcccggacccacctacgaccctacgccgaaccggggtgggtaaccgacggggtaccgggtatacgggaaccgttaccgttaattagtttagttaccggtgttacgggtttcggtaacttttacgttcggtaagttttaaccggttgttccggggtttaccgggggttttacccggggggttaggaaccggtaacggttaccgacgggttccctaaggtaccccggtacggttaacggtcccggaccggtacccggcgggttaccccgccccggttaccccgttgtaccccctcccggtttcctttccccccggcccctttccccg

SEQ ID NO: 136040 - DNA, 730 bp, Homo sapiens
  misc_feature: GYAE6OF01CD1XT.10.80.H03.1.454.CMB.1.raw
  modified_base (244)..(244): a, c, t, g, unknown or other
  misc_feature (244)..(244): n is a, c, g, or t
  modified_base (449)..(449): a, c, t, g, unknown or other
  misc_feature (449)..(449): n is a, c, g, or t
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctcgcgacctcctatgtgctgtcctcacgcccacccgtcggtgtcaggtccggccccagggagaggaccggaccgaaggaactaaccgtgggtaggggganacagacagttaggaaagtgaagctgtcccagtcggtaccagacgaaggacggccgacggacccgaccggccccttagtaaccgttcggtcctactagcgtatgaagttacggcggaccccgtcccgtacgacgggtacctcccgtggacggtcgtacttccgttacggcgtaccctaaccgtaaccgtacggtacggggaaaccncccgggaaccctacccgtacgaacccacgtacccgaacggacgggtacgggaacggaccgggagtacggacggaccgtacttagttacgtaggtacgtagggttgttacggtttatttacgtaaggttacgttagttccggttacggggtttccgggggtttacggacgggtaaccgggactacggtcgtacggaccgttacggttacggaccgacgacccggacgtcccgccccgttccccgtacgttacctcccgttccgttcccgttccccgtccccg

SEQ ID NO: 136041 - DNA, 726 bp, Homo sapiens
  misc_feature: GYAE6OF01EYTCF.10.80.H03.1.454.CMB.1.raw
  modified_base (235)..(235): a, c, t, g, unknown or other
  misc_feature (235)..(235): n is a, c, g, or t
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcacgcccacccgtggtgtcaggtcggccccagggagagaccggccaggactaaccgtgggtaggggganacgaggctagttagaagtgaacgtctcgtacctacgtcggtaccgagacgaaggacggccgacggccgaccggccctggtactcggtcctctagtgatgaagtcggtacgacccggtccctaggacggtacctcccgtagacgtccgtattcctcgtcggaccctactacgtcggtaacggacccgaccggaccaccagtaccacctacgtaccgtaccgggaggacgggacgggtacgggagtaccgggacgtacccgttaagttgtttaacgtggtaccgtagggtttcgttcgtttaagttacggttagttacgttaacggttccgggtttacggggtttccgggggttacggaacgggtacggaaccgtaggtacccgttccgggtaaccgttacggtccggtaacggacccggacccgttacggtccccttacccccgggtcccgttacggacccctccggtttccccgtcccgggttaccccccc

SEQ ID NO: 136042 - DNA, 790 bp, Homo sapiens
  misc_feature: GYAE6OF01BSDCD.10.80.H03.1.454.CMB.1.raw
  modified_base (345)..(345): a, c, t, g, unknown or other
  misc_feature (345)..(345): n is a, c, g, or t
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcacgcccacccgtcggtgtcagtcggcccgaggagacggacggccgaggactaaccgtgggtagggggagacgagactagttaggaaagtgaagtcgttagtacccgacgtcggtaaccgagacgaggaaccggccgacggaccgaccggtccccgtagtaccgtcggtcctacttagngaatcgtaaacgtaaccggacccgtcccgtacggacgggtactccgaggacgtcgtacgttcgtcgtcggtacctaccgtacggttaccggacctaaccggacccgtaccaacccgttacacttacccaacgtacccgaacgggtacggggtccgaccggggtcgggtaacgtcgggaaccgggccctacgtaaccttagggtcggttacggagggtttacgggtacggtttaacctttccgaactttacggtacgttacgttacgtacgggtttgggggtttccggggttacgtaccgggggacgggtaaaccgggtacctaaccgggttccgggtacggttaaccccggttaactaacgggtcccgaacccgggttaccccgaaagggttcccccgttcccgtacccccccgggttacgttaccctcccgggttttacccccg

SEQ ID NO: 136043 - DNA, 674 bp, Homo sapiens
  misc_feature: GYAE6OF01BBVLK.10.80.H03.1.454.CMB.1.raw
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagactctgtgacctcctatgcgctgactcagccacctcggtgtcagtcggccccaggacagacggccacgctgacctggtggggatacacaattggaagtaatcgtgtgcacgtcggtacagcgaggacggccgaggtcacggccccgtggtcggttagtcgtctataatgataaccgaccggcctgacggactcccgtgagcgtattccgtgtcggtcctaccgtaagttccgggacaaccgaaccggccctaccccttacaacgttccaacttcccgaaccgacggggtaccggaacggggcccggggtatacgggacgggacccgtaacttaccgtaaccgtggttaccggtagggttcggtacgggttactttacgaaccttaagtcgtaattccgtaggttgggttcgggggttccttcggggacgggacgggaccaacggtccgtacggtaccgtaccgtaaggtccgaaccgacccgtaaggcccgttcccggacccccgtttcggaccttacccgtccgttacccccg

SEQ ID NO: 136044 - DNA, 734 bp, Homo sapiens
  misc_feature: GYAE6OF01AT28T.10.80.H03.1.454.CMB.1.raw
  modified_base (231)..(231): a, c, t, g, unknown or other
  misc_feature (231)..(231): n is a, c, g, or t
  modified_base (310)..(310): a, c, t, g, unknown or other
  misc_feature (310)..(310): n is a, c, g, or t
  modified_base (425)..(425): a, c, t, g, unknown or other
  misc_feature (425)..(425): n is a, c, g, or t
tcagcatagtagtgcacgaccggtgctcgatttagctgtgcgtcgaagggaaaggggctgggcctaaggaagcagcacttgtggtgcctcagccatggcctggaccgttctcctcctcggcctcctctctcactgcacagcctctgccgacctcctatgtgctgtctcagcccacccgtcggtgtcagtcggccccaggagagacggccaggactaaccgtggtggggganacagacagttagaaagtgaagctgtccacgtcggtaccagcagacggccaggccgacggcccctgtaccgtcggtcctntacgtgagttgatacggtacggacccggtcccgtacgacgggtacctcccggtagaccggacgttacgttccgtcgtcggaccctaccctaaaccgtcggtaacggggaaacccncccgggtaccccaacccgttcgaaccctaacgtacccgaaccggtacggggttaccggaacgggtcccggggaatacgggaccggtaccgttaacttagttacggttcggtacgtagggttggttacgggtttactttacgaaggttcgtttaacgttcggtacgggttttccggggggtttacgaccgggttaacggggactaaccggtcgtaccggtaccggttccgtaacggtccgacggtacccgaacgggtcctcccggacccccgttcggtacctacccgttccgttcccgtccccgtacccc

SEQ ID NO: 136045 - DNA, 732 bp, Homo sapiens
  misc_feature: GYAE6OF01CB9B8.10.80.H03.1.454.CMB.1.raw
  modified_base (332)..(332): a, c, t, g, unknown or other
  misc_feature (332)..(332): n is a, c, g, or t
  modified_base (360)..(360): a, c, t, g, unknown or other
  misc_feature (360)..(360): n is a, c, g, or t
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgtcgacctcctatgtgctgtctcagccaccctggtgtcacggtcggccccgagggacgacggaccggccgaaggtactaaccgtgggtagggggacgacaggactagttagaaacgttgaagtctgtaccacgtggtacccagcaaggacgccgacggccgacggcccctgtacgtcggtcctctangactgatgtcgacccgcctagacggtcncccgtgacgcgtagtctacgtcggctaccacgtcgtacgggaaccaccggtcccaacccgtcgaaccctacgtaccggaacccggtaacgggtaccggaacggtccggggacgtacgggacggtaaccgtactttaaggttacgtttcggtacgtagggttagttcggttaagtttcgtaacgttagttacgttaccggttacggggtttcccgggggtttaggaccggtacggggtacccagggtccgtaccgggtacccgtaccggtagggtaccgtaacccgtacccgggtaacggtcccgttccccggtaccccccgttacgggtacccctacccgggttttaccctcccgttacccccgtaaccccg

SEQ ID NO: 136046 - DNA, 770 bp, Homo sapiens
  misc_feature: GYAE6OF01AZ7I5.10.80.H03.1.454.CMB.1.raw
  modified_base (231)..(231): a, c, t, g, unknown or other
  misc_feature (231)..(231): n is a, c, g, or t
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcacgccaccctcggtgtcaggtcggccccaggagaggacggccaggactaaccgtggtggggganacgagctatagaaagtgaagctgtccacgtcggtaccagcagacggccaggccacggtcccctgtaccgtcggtcctactagtcgatgatacggtcggacccgccctacgagggactcccgtaggacgcgtacttcctcgtcggacctaccctaacgtccggtacgggaacccgacccggaccctaccccgtacgaaccctacgtaccgacccggtacggggtaaccgaacgggcccgggggtatacggggaaccggtacccgtaacgttacgtttacggttcggtacggtagggttcggttacgggtttactttacgtaaggtttaacggttacgtttccggttacggggttttcccggggggttttacgggaaccggggtaacgggtaacccgtaacggtccggttacggtaccccggttaccgggtaacggtccgaacccggtaccccggtaaacgggtccccgtacccgggtaccccccgttaccggttacccgtaaccccgttcccgtttaccccgttccccccgtaacccccg

SEQ ID NO: 136047 - DNA, 721 bp, Homo sapiens
  misc_feature: GYAE6OF01BYPND.10.80.H03.1.454.CMB.1.raw
  modified_base (235)..(235): a, c, t, g, unknown or other
  misc_feature (235)..(235): n is a, c, g, or t
  modified_base (338)..(338): a, c, t, g, unknown or other
  misc_feature (338)..(338): n is a, c, g, or t
  modified_base (384)..(384): a, c, t, g, unknown or other
  misc_feature (384)..(384): n is a, c, g, or t
  modified_base (439)..(439): a, c, t, g, unknown or other
  misc_feature (439)..(439): n is a, c, g, or t
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcacgccacctggtgtcaggtcggaccccaggagacggacgccgaaggaactaaccgtgggtaggggganacgagactaagttagaaaggtgaacgtacgtcggtaccacgtacggaaccgagacgaggacgccgaacggccgacggtcccctggtactcggtcctacgtacngtatagtagtacggtacgacccgtcctagacgggacctcgtagacncgtattccgtcgcgactaccgtaacgtcggtaacggacaccggtacccaccgtanaccctacgtaccgaccgggtaacggacgaacgggccgggtatacgggaccggtactaagttacgttagttacggacgtaggttacggttaagtttacgtttacgaaggttaacttcggttacggtaccggggttttacgggggttcgaacggggttaacgaaccggtacgtccggtaacggttaccggtaaccgttacgtcggaaacgtaccccggtaggtcccctacccgggtaccccttcggacccttaccgttcccggttcccgtacccccgttacccc

SEQ ID NO: 136048 - DNA, 817 bp, Homo sapiens
  misc_feature: GYAE6OF01DRL8P.10.80.H03.1.454.CMB.1.raw
  modified_base (171)..(171): a, c, t, g, unknown or other
  misc_feature (171)..(171): n is a, c, g, or t
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgccacacgcctcgtcgccgaccttcctatgtgtcgtntacctcgacgccctacccgttggtcgtcgacggtccggaccccgaagggacggacggaccggaccgaaggtaaccgttaaccggttgggggtacggggggaacaacgacgtacgtaaggtttaaggaaaggttacggaacgtcgttcgtaccgtaacggtacggtaacccgagaccggaggaccggaccgaccgggacccgtaccggtccccgttggttaccgtccgggttccttaacgttacggtgagttgtaacggtcggtccggacccgtccggtaagccggtacctccgagtacgtcgttacgttccgttacggtcctacccgtaacctaccggttacggaaccgggaccctacccggtaccccaaccggtaccaacccgtcgacccggtaaccgggagggtaccgggtacgggacgggtacgtcgggaaccgttacttaacgtttagttacggttcggtacgtggtttcggtttattacgttagacgtttagttacgttccgggtttcgggggttcgggttacgggcgtaacgggtactacggtccttacgggaccttggaccggttaccgaccgtaccgaccggttccccgacctcccggttcgtaccccttacgtttccctccccggttccctaccccg

SEQ ID NO: 136049 - DNA, 505 bp, Homo sapiens
  misc_feature: GYAE6OF02JFJ0Y.10.80.H03.1.454.CMB.1.raw
  modified_base (354)..(354): a, c, t, g, unknown or other
  misc_feature (354)..(354): n is a, c, g, or t
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagccaccctcggtgtcagtggccccaggagagacggccacgctgacctgtggggatacacaattggaagtaatcgtgtgcactggtaccagcagaggccaggccaggcccctgtggttgtcgtctataatgataacgaccggccctcagggatccctgagcgattctctggctcaattcgggcaacncggccaccctcatcatcacaggtcgaggccggggatgacggccgactactactgtcaggtgtgggatttcactactgatctatggtggggtcttcggcggaggacagctgaccgtctaagcagccgaaggctcgcccctggtcactctccg

SEQ ID NO: 136050 - DNA, 674 bp, Homo sapiens
  misc_feature: GYAE6OF02JKWTI.10.80.H03.1.454.CMB.1.raw
tcagcatagtagtgcacgaccggtgctcgatttagctgtgcgtcgaagggaaaggggacgtgggcctaaggaagacagcactggtggtgcctcagccatggcctggaccgttctcctcctcggcctcctctctcactgcacagcctctgcgacctcctactgtgctgtctcagccaccctcggtgtcagtggccccaggagagacggccacgctgacctggtgggggatacacaattggaagtaatcgtgtgcacgtggtaccagacagaggccaggccaggcccctggtcggttgtcgtctataatgaataacgaccggcctcgacgggactcccgtgacgcgtattcctcgtggcctacctaagttccgggacaaccgaccggtcccaaccccgttacactacaactccgaacccgtacggggttaccggacgggacccgggggtagtacgggaacgggacccgtaacgtaaccgtacgtacgggttacgtacggggttcggtaggggttactttaccgacgttaggtcgtatacgtagttgggtacggggttcgttcgggcgggaacgggtaccgaacgcgttacggaccggttacccgttaaggtaccgtaacggacccgtaacggccgttcccggtacccccgtacgggtcctaccgttccgttacccg

SEQ ID NO: 136051 - DNA, 766 bp, Homo sapiens
  misc_feature: GYAE6OF02GXKDM.10.80.H03.1.454.CMB.1.raw
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagccaccctcggtgtcagtggccccaggagagacggccaggataaccgtggtggggagacagcattgaaagtgaagctgtccactggtaccagcagaggccaggccaggcccctgtactggtcctctatgatgatagtcgaccggccctcgacgggtactcccgtggacgccgtaattcctcgttcgggaccttacccgaacttccgtacggggaaaccgtaccgggacccctaaccccgttacggaacccctaacgttacccgaacccgtaacggggttaccggaaacgggtcccgggggtaataccgggaacgggtacccgtaaccgttaacgtttaacgtttacggttaccgtagggttacggttacgggtttaacgttttacgtaacgggtttaacgttacgttttaccgtaacgggtttcccgggggtttttaccgggaccgggttaacgggtaacccgtaaacggtccgttaccgtacccggttacccgttacgggttaccgaaccgggtacccctaaacgggttcccgttacccgggtcccccgttaccgggtaccttacccgttccgttacccggttcccccgtacccccg

SEQ ID NO: 136052 - DNA, 789 bp, Homo sapiens
  misc_feature: GYAE6OF02JGZ4D.10.80.H03.1.454.CMB.1.raw
  modified_base (225)..(225): a, c, t, g, unknown or other
  misc_feature (225)..(225): n is a, c, g, or t
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagccacctcggtgtcagtcggccccaggagagacggccaggataaccgtggtgggganacagcattagaaagtgaagctgtccactggtaccagcagaggccaggccaggcccctgtacctggtcctctagtgactgataggtcgaccggccctgacgggactccgtgacgcgtattccgtcgtcggtcctaccgaaacgttccgtacggggaaacctacccgggaccctaacccgttcggaaacccctacgttacccgaacccggtaaggggtacccggaaaaccggggccccgggggtaaattaccggggaaccggggacccgttaaacgttaacgttttacggttacggttaccgttaaggggttcggtttacgggttttaaattttaccggaagggtttaacggtttaacgtttaccgtaacggggtttttccccgggggggtttttaggaccggggttaacgggtaaacccgtaaagggttccgttacgggtaccccggttacggtacgggttacccgaaccggtacccggtaaaccgggttcccgtacccgggtccccccgttacgggttacccgaacccgttttcccggttaccggttcccccccgttaaccccg

SEQ ID NO: 136053 - DNA, 636 bp, Homo sapiens
  misc_feature: GYAE6OF02GBFTD.10.80.H03.1.454.CMB.1.raw
  modified_base (293)..(293): a, c, t, g, unknown or other
  misc_feature (293)..(293): n is a, c, g, or t
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagccaccctcggtgtcagtggcccaggagagacggccaggataacctggtgggggagacagcattgaaagtgaagctgtccactggtaccagcagaggccaggccaggcccctgtacctggtcctntatgatgatagtcgacccggcctacgagggactccctgagcgtattctctggctaccaacgttcgtacggggaaccaccggcccacccgtcgaccactccgaccgacgggtaccggaacggccgggggatacggacgggtacccgtaacgttaatttacgttagtacgtagggttgttaggttatttacgaggtttacgttagtttcgtacgggtttccgggggttttacgggcgggtaacggaccgaagtcgtacgtaccggttccgtacggtcgaacggtacccgaacggtccgtccggtaccccgtcggtacctacgttcccgttcccgtccctaccccg

SEQ ID NO: 136054 - DNA, 786 bp, Homo sapiens
  misc_feature: GYAE6OF02JFSWX.10.80.H03.1.454.CMB.1.raw
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagccaccctcggtgtcagtggccccaggagagacggccaggataacctggtgggggagacagcattgaaagtgaagctgtccactggtaccagcagaggccaggccaggcccctgtactggtcctctatgatgatagtgaccggcctcgagggtactcccgtgacgcgtattctctggcctaccaacgttcgtacggggaaacctacccgggcccaacccgtcggaaccctacgtacccgaacccggtaacggggtaccggaaacgggcccggggggtaatacggggaaccgggtacccgtaaacgttaacgttttaacgtttacggttaccgtaaggggtttggttaacgggtttaactttttaccggtaaggtttaacggttaacgttttaccgggttaacggggtttttaccccgggggggggttttttaccgggaccggggtaacgggggtaaacccgtaaagggtcccgttaacgggtaccccggtttaccggttaacggggttaccgtaaccggaccccggtaaacgggtcccgttaccccggtacccccccgggtttcgggttaccccgtaccgtttccccggtttacccggtttacccccctaaccccccg

SEQ ID NO: 136055 - DNA, 753 bp, Homo sapiens
  misc_feature: GYAE6OF02H4EHS.10.80.H03.1.454.CMB.1.raw
  modified_base (290)..(290): a, c, t, g, unknown or other
  misc_feature (290)..(290): n is a, c, g, or t
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagccaccctcggtgtcagtcggccccaggagagacggccaggataaccgtggtgggggagacagcagttagaagtgaagctgtccactggtaccagcagacggccaggccaggcccctgtacncggtcctctatgatgataggtcgacccggcctcgagggactcccgtgacgcgtacttctcgtggtcctaccgaacgtcgtacggggtaaccaccgggacccctaacccgtacgaacccactaccgaacccggtacggggtacccgggaaacgggcccgggggtaagtacgggacgggtacccggtaaacgttagttttaacgttggttacggtaagggtttcggttagggtttagtttaccggtaaggtttaacgttacgtttaccggttacgggttttacccgggggggtttttccgggaccgggggtacggggtaaccgtaacggtccggttacggtacccgggttaccgttacgggtacccggaaccggtacccgtaaacgggtcccgttacccggtccccccgtttccgggtacccttaacccgtttcccggttccccgttacccccgttaaccccccg

SEQ ID NO: 136056 - DNA, 708 bp, Homo sapiens
  misc_feature: GYAE6OF02IOQJB.10.80.H03.1.454.CMB.1.raw
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagccaccctcggtgtcagtcggccccaggagaggacggccaggataacctggtggggagacagcagttagaaagtgaagctgtccactggtaccagcagaggccaggccaggcccctgtactggtcctctatgatgtataggtcgacccggccctagacgggtactcccgtaggacgaccgtattcgtcgtcggtcctacccgaaactcgtacgggaacctaccggcccaccccgtaggacccagtcccaaccggtagggtaaccggaacggcccggggtatacgggaacgggtccctaattagttaacttggtaccgaaggttggtaggtttactaccggtaaggttaacgttacgtttaccgtaacggggtttcccggggggttttacggacggggtaaccgggtaaccgtaaaggtccggttaccggacccggtttccgttaggggtaaccctaccggaacccggtaaggtcccgtaccggtaccccccggttcggtacccgacccgtttacggtcccccgtttaccccgtacccccg

SEQ ID NO: 136057 - DNA, 721 bp, Homo sapiens
  misc_feature: GYAE6OF02HGZGR.10.80.H03.1.454.CMB.1.raw
  modified_base (223)..(223): a, c, t, g, unknown or other
  misc_feature (223)..(223): n is a, c, g, or t
tcagcatagtagtgcacgaccggtgctcgatttagctgtgcgtcgaagggaaagggctgggcctaaggaagcagcactggtggtgcctcagccatggcctggaccgttctcctcctcggcctcctctctcactgcacagcctctgcgacctcctatgtgctgtctcagccaccctcggtgtcagtggccccaggagagacggccaggataacctgtggggganacagcattgaagtgaagctgtccactggtaccagcagaggccaggccaggcccctgtactggtcctctatgatgatagtcgaccggccctcgagggactcccgtgacgcgtattctactcggcctaccaacgttccgttaggggaacctaccgggcccacccgttgaacccagtttccaacccggagggttccgaaacggcccggggaattcgggaacgggcccgtaacgttaacgtttagttcgtacgtacgggttgttacgggttactttccgaggtttaagttacgtttcgtaacgtttcccgggggggtttttacgaccggggttaacgggacccttaaagggtccctttaacgggtaccccggtttaccgttacggggttaccgaacccgggttaccccggtaaacgggtccgttacccggttcccccccggtttacgggtacccgttaacccggtttacccggtttaccgggttacccccccgttcccccgg

SEQ ID NO: 136058 - DNA, 749 bp, Homo sapiens
  misc_feature: GYAE6OF02F43ZF.10.80.H03.1.454.CMB.1.raw
  modified_base (229)..(229): a, c, t, g, unknown or other
  misc_feature (229)..(229): n is a, c, g, or t
  modified_base (398)..(398): a, c, t, g, unknown or other
  misc_feature (398)..(398): n is a, c, g, or t
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgtacagcctctgcgacctcctatgtgctgtctcacgccaccctcggtgtcagtcggccccaggagagacggccaggactaaccgtggtggggganacagcgagttagaaagtgaagctgtaccacgtggtaccaggcaaggaggccgaggccacggcccctgtactcggtcctctagtgatgagtagtcggaccggccctgagggtaccttcccgtgacgcgtactttcgtactcggacctcctaaacgttcgtacgggaaccnccgggaccctacccgtacgacccactaccgaaccggtaaggggtaacccgaacgggtacccgggggtaagtacggggtacgggaacccgtaaaccgtttaagtttaaacgttcgggttacgaacgggtttagggttaggttaacgttttaccgtaaggtttaacgtttacgttccggttagggggttttccccgggggggtttttacggaccggggtacgggtaaacccaacgggtcttaacccgggtacccgttaccggtacggtacgaacgggacccgtagggtaccctaccggtcccccggttcgtacccgtacccttccgttaccccggttacccctcccttccccg

SEQ ID NO: 136059 - DNA, 733 bp, Homo sapiens
  misc_feature: GYAE6OF02JZP1N.10.80.H03.1.454.CMB.1.raw
  modified_base (236)..(236): a, c, t, g, unknown or other
  misc_feature (236)..(236): n is a, c, g, or t
  modified_base (378)..(378): a, c, t, g, unknown or other
  misc_feature (378)..(378): n is a, c, g, or t
tcagcatagtagtgcacgaccggtgctcgatttagctgtgcgtcgaagggaaaggggcgtgggcctaaggaagcagcactggtggtgcctcagccatggcctggaccgttctcctcctcggcctcctctctcactgcacagcctctgccgacctcctatgtgctgtctcagcccaccctcggtgtcagtcgccccgaggacgaggaccggccaagggactaacctgggtggggganacgagcagttaggaaagtgaagctggtaccagtacggtaccagcgaacggacggaccgaggccgacggcccctagtaccgtcgggtaccctcgtagtagacgttaggagttacggtcgtacccggcctaccggacgggtacncccggttaggacgtccgtattccgtacgtcggtcctaccgaacgttcggtaacgggaaccaccggtacccctacccgtacgaccctacgtaccgaaccgtcgggtaaccgaaacgggtccgggaggtacgacggaccgtacttaagttcgtcggtacgtagggtacgttgttacgtttacagggttaaacttacgttacgtaacgggtttcccggggggttttagacggggttacggacctaaggtccgtaggtacccgttaccggtaaggtccgtaacggtccccgtaaggtcccgtacccgtccccgtaacggttccgttacccttttacccggttccccaacccggttcccc

SEQ ID NO: 136060 - DNA, 618 bp, Homo sapiens
  misc_feature: GYAE6OF02F5QEP.10.80.H03.1.454.CMB.1.raw
  modified_base (333)..(333): a, c, t, g, unknown or other
  misc_feature (333)..(333): n is a, c, g, or t
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgcgctgactcagcccaccctcggtgtcagtcggccccaggacagacggccacgctgacctggtgggggatacacaattggaagtaatcgtgtgcacgtggtaccagcagaggccaggccaggcccctgtggttgtcgtctataatgagtaaccgaccggccctcagggactcccgngagcgtattctctggctaccagttcgggacaacgcggcccaccctcatcactccaccgagggtccgacgggaccgggtagtcggacggccgacctactacgtgtacgagggtggtgggtactttccacgttacgtgactcgtagttcgggttcgggggttccttcgggacgggtagggaaccgtaaggtccgtaccggtaccgttaaccgtaacggttaccgaccggaacccgtacgggtcccgtaccggtcccccgttaccggtcctacccgttccgttccccg

SEQ ID NO: 136061 - DNA, 831 bp, Homo sapiens
  misc_feature: GYAE6OF02G9GUA.10.80.H03.1.454.CMB.1.raw
  modified_base (183)..(183): a, c, t, g, unknown or other
  misc_feature (183)..(183): n is a, c, g, or t
  modified_base (234)..(234): a, c, t, g, unknown or other
  misc_feature (234)..(234): n is a, c, g, or t
tcagcatagtagtgcacgaccggtgctcgatttagctgtgcgtcgaaggggaaaggggctgggcctaaggaagcagcactggtggtgcctcagccatggcctggaccgttctcctcctcggcctcctctctcactgcacagcctctgcgacctcctagtgtgctgtctcacgcccacctggtntctagtccggcccaggagagccggaccaggactaaccgtgggtaggggganacgaggacagttaggaaagtgaacgtctagtacccacgttacggaaccagcgaggacggccgtaggccgtacggccccttgtacggtcggttcctacgtagtcgatagtaagtcggtccgaaccccggccgtaggaacgggtacctacccggtaggacggtaccttactttcccgtcgtcggttaccctaacccgtaacgttacggggtaaaccgggaaaccgtaccccgggtaaccccctaccccgggttacgaaccccgttaaacggttaccccggaaaccggggttaaccggggaaaccgggaaaccggggtacccggggtagttaacggggaacccggtaaccgtaaccgtttaagtttaacggttacggttaccgggtaagtttcgggttaggttttaacgtacgtaggttaacgtttcgttaccgtttacgggggtttacccggggtttcgggaaccgggtaacgggtaaactaccggtaccgttacccgggtaccgttaccgtacgggtaccgacccgtaaccggacggtcccgtacccgggtccccttcggttacccgtaccgtcccgttcccgtcccccgttaccccg

SEQ ID NO: 136062 - DNA, 650 bp, Homo sapiens
  misc_feature: GYAE6OF02JFQA5.10.80.H03.1.454.CMB.1.raw
  modified_base (511)..(511): a, c, t, g, unknown or other
  misc_feature (511)..(511): n is a, c, g, or t
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagccacccgtcggtgtcagtcggccccaggagacgacggccaggactaaccgtggtgggggagacagcagttagaaagtgaagctgtccacgtggtaccagcagacggccaggccacggcccctgtactcggtcctctatggactgataggtcgacccggtccctcgagggactcccgtgacgtcgtattcgtcgtcggtcctccaacgttcgtacgggaaccgcccggaccctaccccgtcgaacccacgtccaacccgggacgggtacggacgggccggggatcgggacgccgtactacgtttattcggtacgtgggtcgttggttactttggagttagttnttccggtacgggtttccgggggtttcgggcgggtacgggtaacctaggtccgtccggtaccgttcgtacggtacgacggacccgtaacgccgtcccgtcccgttcggtcctacccgtcgttaccccgtacccctacccg

SEQ ID NO: 136063 - DNA, 730 bp, Homo sapiens
  misc_feature: GYAE6OF02G3IPH.10.80.H03.1.454.CMB.1.raw
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcacgccaccctcggtgtcaggtcggccccaggagaggacggccaggactaaccgtggtgggggagacagcagttagaaagtgaagctgtccactggtaccagcagacggccaggccacggcccctgtactcggtcctctatgagtcgataggtcggacccggccctgacgggctcccgtggacgcgtacttcctcgtcggacccttacaacgttccggtagggaacccaccgggaccccaacccgttcaaccctactacccgaacccgaggggtaccggaaacgggccggggtaatacggacgtccggaacccgtacgtttaagtttacgttcggttacgtaggggttacgttacggtttaactttacggtaagtttacgtttacgtttacggttacggggttttcccggggggtttacgggacgggggtaaccggtaacccggtaggtccgttacgggtacccggtttaccgtacggggtacccaaccgggtacccgtaacggtcccgtacccggtcccccggttccgtaccgtacccgtttccgtaccccggtttccccccg

SEQ ID NO: 136064 - DNA, 589 bp, Homo sapiens
  misc_feature: GYAE6OF02HXVAE.10.80.H03.1.454.CMB.1.raw
  modified_base (240)..(240): a, c, t, g, unknown or other
  misc_feature (240)..(240): n is a, c, g, or t
  modified_base (330)..(330): a, c, t, g, unknown or other
  misc_feature (330)..(330): n is a, c, g, or t
  modified_base (367)..(367): a, c, t, g, unknown or other
  misc_feature (367)..(367): n is a, c, g, or t
  modified_base (378)..(378): a, c, t, g, unknown or other
  misc_feature (378)..(378): n is a, c, g, or t
  modified_base (390)..(390): a, c, t, g, unknown or other
  misc_feature (390)..(390): n is a, c, g, or t
  modified_base (468)..(468): a, c, t, g, unknown or other
  misc_feature (468)..(468): n is a, c, g, or t
  modified_base (478)..(478): a, c, t, g, unknown or other
  misc_feature (478)..(478): n is a, c, g, or t
  modified_base (586)..(586): a, c, t, g, unknown or other
  misc_feature (586)..(586): n is a, c, g, or t
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtcctcacgcccaccctcggtgtcaggccggccccgaggacgaggaccggccgaggtaactaaccgtgggtggggganacaggcagttagaaggtagaagcgtcgtccacgttcggaccagcgagacgtcgacggccgtacggccctgtacgtccggtcctacgtagngtagtctaagtggcgaccggcctcggaggctccgaancgcgtctcgtntcgctaccgtancggtcgaacgtaccgcccacacggaccacgacaccggacggaggaaccggcggtagcgaacggccattagtcgagtcnggtagttagntaggattcctagtctcggtacggttcgacggcggtacaagctaccgacgtacgtcgtccagggtccaaggcccgtagttccgcggttacctccgttactcccgtaccnccg

SEQ ID NO: 136065 - DNA, 704 bp, Homo sapiens
  misc_feature: GYAE6OF02F6SCM.10.80.H03.1.454.CMB.1.raw
  modified_base (228)..(228): a, c, t, g, unknown or other
  misc_feature (228)..(228): n is a, c, g, or t
  modified_base (409)..(409): a, c, t, g, unknown or other
  misc_feature (409)..(409): n is a, c, g, or t
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagccacccgtcggtgtcagtcggccccaggagagacggccaggataacctggtaggggganacagcattagaaagtgaagctgtccacgtggtaccagcagaggccaggccacggcccctgtacgtcggtcctcgtatgatgagtagtcgacccggccctcggacgggtctcccgtgacgcgtattccgtcgtcggtcctaccaacgtcgtacgggaaccgaccggccctacccgcgaaccnctaccgaccgacggggtaccggaacgggccggggtagtcgggaccggaccgtaacttacgttagttcggtacgtacggggttggttaggtttacgttttcgtaaggtttagttacgtttacggttacggggttttcccggggggttttcgggaccgggtaacggggtaaccgtaacggtccgttaccgggtaccgttaccgtacgggtaccaccggtacccgtaacgggtcccgtaccccggtcccccgtcggttacccgacccgtttcccgttccccgttccccttaccccccg

SEQ ID NO: 136066 - DNA, 811 bp, Homo sapiens
  misc_feature: GYAE6OF02FHQVI.10.80.H03.1.454.CMB.1.raw
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagcccacccgtcggtgtcacgtcggccccgaggagaggacggccaggactaaccgtggtgggggagacgagcgtattagaaagtagaagctcgtaccacgtcggtaccagcgagacggccgacggaccgacggccccgtagtacctcgggtcctactatcgatgagtaggtcggacccggtccctacggacgggtaccgtcccgtaggacgtcggtaacttccgtcgtcggtacctacccgtaacgttccggtaacgggtaacccgacccgggaccctaccccgtaccgaaccctacgttacccgaaccgggtaacgggggttacccggaaacgggtcccgggggaattcggggaccgggacccgttaacttagttttacgtttcggaacggttacggggtttggtacggttttactttacggttaagtttaacggttaacgtttccggttacgggtttttcccgggggggttttacgaccggggggtaaccggtaaaccgtaacgggttcccgtaaccgggttacccgttaccggttaagggtaccccggaacggtaaccccggtaacgggccccgttaccggccccccggttacggtcccgtaacccggtttccctttaccccggtaccccttaccccccgg

SEQ ID NO: 136067 - DNA, 806 bp, Homo sapiens
  misc_feature: GYAE6OF02F120H.10.80.H03.1.454.CMB.1.raw
tcagcatagtagtgcacgaccggtgctcgatttagctgtgcgtcgaagggaaaggggctgggcctaaggaagcagcactggtggtgcctcagccatggcctggacagttctcctcctcggcctcctctctcactgcacagcctctgcgacctcctatgtgctgtctcagccaccctcggtgtcagtggccccaggagagacggccaggataacctggtgggggagacagcattgaaagtgaagctgtccactggtaccagcagaggccaggccacggcccctgtactggtcctctatgatgatagtgaccggccctcgagggactccctgacgcgtattctcgtggtcctaccgaacctcgtacggggaaccaccggtacccaaccccgtcggacccactaccgaaccgtacggggtaccggaacgggcccggggggtaagtcgggaacgggtacccggtaacgttaacgtttaacgtttacggttaccgtaggggtttacggtttacggggtttaatttttccggtaaagggtttaacggtttaacgttttaccggttaacggggtttttccccggggggggggtttttttaccgggacccggggggtaaacgggggtaaacccggtaacgggtacccggttacgggtaaccccgggtttacccggttaacggggttacccggtaaccgggaaccccccgggttaaacgggtcccccggttacccgggttaccccccccggtttacccggggttaccccttaaccccggtttcccggttttaccccgggtttacccccccccggg

SEQ ID NO: 136068 - DNA, 657 bp, Homo sapiens
  misc_feature: GYAE6OF02JNPQZ.10.80.H03.1.454.CMB.1.raw
  modified_base (352)..(352): a, c, t, g, unknown or other
  misc_feature (352)..(352): n is a, c, g, or t
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagactctgtgacctcctatgcgctgactcagccaccctcggtgtcagtcggccccgaggacaggaccggccacgctgaccgtgggtaggggactacaacaagttaggaagtaatcggtgtgcctacgtcggtaccagacagacggccacggccacggccccgtggtcggttcgtcgtctaatatcgaactaacgaccgcctgacggtatcccgngaacgcgtattccgtcgtcgtctaccgtaagttcggaccaacgcccggaccctaccctacactacactaccgaccggacgggtcggacggggccgggtagtacggacgggacctaaccgtacgttaaccgtcgtacgtacgggttgggtacgttactttaccacgttaacgtgttacgtacgttcggttcggggttcgggttccggttacgggcgggaacgggaaccgtacggtccgtacggtacccgtacgtaactcgacgtacccgacgccgcccgtcccgtcggtccgtacttccgtccccg

SEQ ID NO: 136069 - DNA, 831 bp, Homo sapiens
  misc_feature: GYAE6OF02I2AEI.10.80.H03.1.454.CMB.1.raw
  modified_base (232)..(232): a, c, t, g, unknown or other
  misc_feature (232)..(232): n is a, c, g, or t
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcacgccacccgtcggtgtcgagtcggcccgaggagacgacggccgaggactaccgtggtagggganacgagctagttagaaaggtgaaacgtcgtacgtacctacgtacggtaacccgagaccgaaggacggaccgacggccgaccgggtccccctggtaccgtaccggtccttacgtacgtgaagtcgaagttcggtaccggaccccggtacccgtacggaacgggtacctcccgtaggtaacgtccgttacgttccgtccgtcggtaccctaacccgtaaccgttacggtaaccggggtaaccgacccgggtaccccaaacccggttaccgaaccgtaccgtacccggtaaaccggtacggggtaacgggtaaacccgggacggggtactaacggggacccggaaccggttaacctaacggttacgttacggtccggttaaggggttcgggttaacgtagtttaacccgtacgttaacgtacgtacgtttaccgtagggtttccgggggttacggggtttcgggtaaccgggacggggttaaccgggaaccgtacgttaccggttaccgggtaacccggtttaccgtaaacgggtcccaaccgggacccggttaacgtcccggtccccggttacccccgttcgttaccccttcccgtaccccg

SEQ ID NO: 136070 - DNA, 771 bp, Homo sapiens
  misc_feature: GYAE6OF02J2SXD.10.80.H03.1.454.CMB.1.raw
  modified_base (350)..(350): a, c, t, g, unknown or other
  misc_feature (350)..(350): n is a, c, g, or t
  modified_base (665)..(665): a, c, t, g, unknown or other
  misc_feature (665)..(665): n is a, c, g, or t
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagcccaccgtcggtgtctaggtccggccccgaagggacgacggaccggaccgaggacttaaccgtgggtacgggggacaccgagtacctagttaagaaaggtgaacgtcttcgtcccgtaacgtcggtaccaaggcgacggacggaccgaggcccgaccggcccgttgtaccgtccggtcctntacgtagacgtcgtaacgtacggcggtaccccggcccgtaggaccgggttaccgtcccgaggtaccggtcgtacgttccgtcggtccgtaccgtacccgtaaccggttacggaaccggtaacccgacccggtaccccgacccgtaccgaacccgtacctacccggtacggtaacccggggtaccgaaccgggggtacccgggttagaccgggtacggtaccgtagttaacgtcgttcggtacgtgggttacgtagtttactaggtacttaggttacttcgggttacgggtttccggggtcgacggtacggtaccnggtactccgggtaccgtggttaccggaacgtcccggaacgtccggtaccgtcccggtacccgttcgtaacccttccggttaccgttaccccgggtccccttacccg

SEQ ID NO: 136071 - DNA, 743 bp, Homo sapiens
  misc_feature: GYAE6OF02HQUBI.10.80.H03.1.454.CMB.1.raw
  modified_base (179)..(179): a, c, t, g, unknown or other
  misc_feature (179)..(179): n is a, c, g, or t
  modified_base (188)..(188): a, c, t, g, unknown or other
  misc_feature (188)..(188): n is a, c, g, or t
  modified_base (253)..(253): a, c, t, g, unknown or other
  misc_feature (253)..(253): n is a, c, g, or t
  modified_base (315)..(315): a, c, t, g, unknown or other
  misc_feature (315)..(315): n is a, c, g, or t
  modified_base (398)..(398): a, c, t, g, unknown or other
  misc_feature (398)..(398): n is a, c, g, or t
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacacgcctctgccgtaccctcctatgtgctgtcctcacgcccncccgttggngtcgagtccggaccccgagggagaggaccggaccgaagggaactaaccggtggggtacggggganacgaggactagtaagaaaggtgaacgctcgtacacgtacggaccagcgaaggcggcaggccncggtaccctgtacgtcggtcctcattgatgaacgttgtcggaccgccctacggagggtacctccggagagccgttattcgtcncggtactaccgtaagtccgtacggacctacccgttacgaccgttcccccggtaccgttaccgggacctaacgtaccgggacggggttccgggtcccggttcccgggtacccgggtaagggtaccggttacgggtaacccgtacgtttaagggtttaaactttaattttaccgtaggtttaccggtaaggacggttaaggtacgggtttacggaaggtaacctaacggccggtacgttaggttccttcgttaacgtcgtttaccggtacgggtaacgggtacggaaccgttaaccggaccgttacccgttcgttaccgacggtacacccgacccgaccctaacccg

SEQ ID NO: 136072 - DNA, 735 bp, Homo sapiens
  misc_feature: GYAE6OF02JNH77.10.80.H03.1.454.CMB.1.raw
  modified_base (140)..(140): a, c, t, g, unknown or other
  misc_feature (140)..(140): n is a, c, g, or t
  modified_base (255)..(255): a, c, t, g, unknown or other
  misc_feature (255)..(255): n is a, c, g, or t
tcagcatagtagtgcacgaccggtgctcgatttagctgtgcgtcgaagggaaaggggctgggcctaaggaagcagcactggtggtgcctcagccagtggcctggaccgttctcctcctcggcctcctctctcactgcacncgcctctgccaccttctagtgtcgtcttgtcctcacgccctacccgtcggtcgtacacggtccgaccccggaaggacgaaggaccggccgtaaggactaaccggtggtagggganacagctagttagaaagtcgatcgtcgacacgtcgacacgtacaggagccgacggtccgacgtccccgtagtaccgttcgtaccgtacgttagacgtaagtaacgacgttacgccggacccgttcccgaggtacggacctccgtgaacgtcgtacttcgcgacgttacccgactacgttccggaacgaaccgtccgtacccgacctcggtaacaccgttacgaaccggtacggtaacgggaccggaccgggacgtacgggaaccggtaccgtaacttaacgttacgttcgtacggtacgttcggttacgttacgttacgtaagttaacgttacgttacggtaccggtttaccgggttcggtacggtaacgggtacgtaaccgggtcgtaacgggttccgtacggtaaccggtccgtaacgaccggtacgtccggtaccgtacccggtacgaccttaccggttcctaccggttccctacccg

SEQ ID NO: 136073 - DNA, 813 bp, Homo sapiens
  misc_feature: GYAE6OF02GDOFX.10.80.H03.1.454.CMB.1.raw
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctcgtctcacgccaccctcggtgtcaggtcggaccccagggagacggacggaccgaggtaactaaccgtgggtacgggggagacgagacgtagttaggaaaggtagaagcctggttaccaacgtacggtaccaaggacgaaggacggaccaacgggtaccgaccggggtccccttaagggtaccgttacggtcccgttacgtagtaccggtataggtaacgttacgtacgggtaaccccggtcccccgttagggaacgggggttacccttaacccggtcggaaaccggttcgttaagtttcccgttcggtaccggttaccgttacccaaccgtttacggtacgggtaaacccgtaacggggtacccccacccgttcgaaacccgtacgcccgtaaaccgagggttaaccggaaccgggaaccggggtgtacgggaacggtacccgtagttaacttacggttacgacgttaagggtcggttagtttactttacgagttagttaccgttggttaaccgggtttcgggggtttaccgaggggttaccggactaccggtacgttcgggtaccgtaccgtaggttaccgaccgtaaccggacggttccacccggttccccgtcgtaacccgtcgttaccttccccgtaccctaccccg

SEQ ID NO: 136074 - DNA, 948 bp, Homo sapiens
  misc_feature: GYAE6OF02GZLLN.10.80.H03.1.454.CMB.1.raw
  modified_base (180)..(180): a, c, t, g, unknown or other
  misc_feature (180)..(180): n is a, c, g, or t
tcagcatagtagtgcacgaccggtgctcgatttagctgtgcgtcgaagggaaagggctgggcctaaggaagcagcactggtggtgcctcagccatggcctggaccgttctcctcctcggcctcctctctcactgcacagcctctgcgacctcctatgtgctgtctcagccaccgtcggtntcagtcggaccccgaggagacgacggccgaggtactaaccgtgggtgggggaactacgaggctagttacgaaagtgaagtccttcggtaccctagttcggtaaccacggcgaaggacggacccgaacggacccgaccggtacccccgttaggtaccgttcgggttaccccttacgttaacgtacggtagttacggtaacgttaacgggtaccggtaaccccgggtcccgttacgggaaaccggggttaccttacccccggtaggtacggttaccggttaaccttccggttcgggttacggttacccttaacccgtaacggttccggtaacgggtaacccgtaacccgggtacccccgttaacccgtaaccggtaccctaacggttaccccgaaacccggggtacggggtaacccggtaaccggggtaccgggggtaagttaccggggaaccgggtaacccgttaccgttttaaaggttttacgttaccgggttaacggttacggggttcggtttaaacgttttaccgtttaaccggtaacggtttaacggttttaaccgtttccggggttaaaccggggggttttttcccgggggtttacgggaaccggggtaacccggtacggaaacccgttcggttaccggtacccgtttacccgggaacggttccgtaacccgggacccggtaacggttccccggtacccgtttcccccgggtaccggttaccttacccccggtttctttccccggggtaccccctttaccccgg

SEQ ID NO: 136075 - DNA, 834 bp, Homo sapiens
  misc_feature: GYAE6OF02FOXOP.10.80.H03.1.454.CMB.1.raw
tcagcatagtagtgcacgaccggtgctcgatttagctgtgcgtcgaagggaaagggctgggcctaaggaagcaagcactggtggtgcctcagccatggcctggaccgttctcctcctcggcctcctctctcacgtcgcacacgcctctgcgtacctctacttgtacgcttgtcctacacgccccacccgttcggtgtccaggttcggaccccgaagggacgacggaccggccgaaggactaaaccgtggggtacgggggactacaggtctaattaggaaaagtgaacgtcgtcgtaccgtacgtacggtaaccacgacgaacggaccggacccgtaacggccccggttaccgggtacccccttaggttacccgttacggggtaccccttagtacgttgtaagtacgtacgtacggtaccgggccccgtacgtaggaccggtacctcccgtagtacgtcgtacttcgtcgtccgacctacggtactccggtaacgggtaccaccggacccgtccccgtaactacccgtaacgtcccggaaaccggtacggggtaacccgaaaccgggggttaccggggagttacccggggaacgtaccggttaaacgtacgttaggtttcggaacggtttagggtcgttaagtttacgtcgtttaaggttacgttccgtttacggtccgggtttccgggtttagggtttccggggtaacgggaccgttaaccgtaagtccggtacccgggtccgtaccggttccggtacggacccgtaccgggaccgttcccgtacccggtccccgttaccgttaccctaaccggtttccctacccggtaccccc

SEQ ID NO: 136076 - DNA, 898 bp, Homo sapiens
  misc_feature: GYAE6OF02JW9DB.10.80.H03.1.454.CMB.1.raw
  modified_base (188)..(188): a, c, t, g, unknown or other
  misc_feature (188)..(188): n is a, c, g, or t
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacacgcctctgccgacctcctatgtgtctgtctacacgccctacccgtggtntacgaggtcccggacccagggacgacggaccggtaccgaggtaactaaccgttgggacggggaacacgacggactagttaagaaggtgaagtcgtcgtacctacgtacggtaaccacggagacggacgaccgtaccggcccgaacggtaccccttaggtaccgttccggtcctcgtacgtcggtaactggtaactcgggtccgaaccccggttccgtaggtacgggtacctccggtacgcgtcgttaccgtaccgtcgtaccgtaccgaccccgtagccgggtacggtaaccgtacccgacccggttaacccgtaccggaaccttaaccgcccgggaaccgtaaccgggggttaacccggaacgggggttacgggaacgggttccggggaaccgtacccggtttaaaccgttagtttaacggttcggttacgggttaacggtttacgggttacggtttacgtttacggtttaacgggttacgtttaaccggttaccgggttttaccggggtttccgggggggttttaccggtacgggggtaacccgggtttaaccgtaaggggttcccggtaacccggttacccggtacggtttaaccggtcccggtaaaacccgggtcgttaaccccgggtcccggtttccccgtaacccccggggtttcgtaaccccgttccccggttaccgttccccgtttaaccccccggtacccc

SEQ ID NO: 136077 - DNA, 686 bp, Homo sapiens
  misc_feature: GYAE6OF02GCON0.10.80.H03.1.454.CMB.1.raw
  modified_base (305)..(305): a, c, t, g, unknown or other
  misc_feature (305)..(305): n is a, c, g, or t
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagccaccctcggtgtcagtcggccccagggagagacggccaaggactaaccgtggtggggagacagacattaggaaagtgaagtctgtccactggtaccagcagagccacggccacggcccctgtacctcggtccttntatcgatgatagtcgaccggccctcgacgggtactccgtgacggcgtacttcctcgtcggccttaccgaaccgttcgtacgggaaccgaccggcccaacccgtcgaaccacgtccgaaccgagggttaccgaacgggccggggtatcgggaacggtacccgaagttagtttacgttgtaccggtaggttcgttaggtttactttcgaacgtttatacgtttcgtaacgggttttcccgggggtttcgggtaacgggtacgggtaaccgaacgtcggtaccgtacccgtcgtacggtccgaacgaccccggtaaggtaccgtacccgtcccccggttacggtacccgtaccttcccggtttcccgtacccccttaacccccg

SEQ ID NO: 136078 - DNA, 497 bp, Homo sapiens
  misc_feature: GYAE6OF01AU2Q2.38.1.A01.1.454.CMB.1.raw
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccaccctgtctgtgtctccaggggagagagccaccctctcctgcagggccagtcagagtgttagtaacaacctagcctggtaccatcagaaacctggccaggctcccagactcctcatctatgatgcatcccaccagggcccacgtggtcgtccccagccaggtttcagtggcagtgggtctggggacagagttcactctcaccatcagcagcctgcagtctgaagtattttgctagttttattattgtcagtcagtatgatcagtcggcctcgatcaccgttcgccgaggggacacgactggacaagtaacgacgtgtagctgcacta

SEQ ID NO: 136079 - DNA, 511 bp, Homo sapiens
  misc_feature: GYAE6OF01EZOCZ.38.1.A01.1.454.CMB.1.raw
  modified_base (194)..(194): a, c, t, g, unknown or other
  misc_feature (194)..(194): n is a, c, g, or t
  modified_base (312)..(312): a, c, t, g, unknown or other
  misc_feature (312)..(312): n is a, c, g, or t
  modified_base (358)..(358): a, c, t, g, unknown or other
  misc_feature (358)..(358): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccaccctgtctgtgtctccagggganagagccaccctctcctgcagggccagtcagagtgttagtaacaacctagcctggtaccatcagaaacctggccaggctccagactcctcatctatgatgcatccacagggccatggtntcccagccaggttcagtggcaggtggtctgggacagagttcactcncaccatcagcagcctgcagtctagaagtatttgctagtttattattgtctagctagtatgatcgtagtgcctcgatccaccgttccggccgaggggaccacggactacgggaacctaaagtaaacgaactggtacggactcgccaaccgtacg

SEQ ID NO: 136080 - DNA, 533 bp, Homo sapiens
  misc_feature: GYAE6OF01CSQ1T.38.1.A01.1.454.CMB.1.raw
  modified_base (195)..(195): a, c, t, g, unknown or other
  misc_feature (195)..(195): n is a, c, g, or t
  modified_base (408)..(408): a, c, t, g, unknown or other
  misc_feature (408)..(408): n is a, c, g, or t
  modified_base (522)..(522): a, c, t, g, unknown or other
  misc_feature (522)..(522): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccaccctgtctgtgtctccgagggganagagcccaccctctcctgcagggccagtcagagtgttagtaacaacctagcctggtaccatcaagaaacctggccaggcctcccagacctcctcatctatgatgcactccaccgagggccacgtggtctcccagccgaggttcaggtcggcaggtcgggtctgggacagtagttcacttctacacctatcagcagtcctgcagtctagaagtntttgacttagtttattagttgtcatactagtatgtattcgagtcggtcctccgatccgtaccgttccggaccgacgggacaccgtacgtaggaacaagtaaacgacgtgtacgntcgccacgtac

SEQ ID NO: 136081 - DNA, 854 bp, Homo sapiens
  misc_feature: GYAE6OF01D016O.38.1.A01.1.454.CMB.1.raw
  modified_base (197)..(197): a, c, t, g, unknown or other
  misc_feature (197)..(197): n is a, c, g, or t
tcagtcgatcacgtcacgaccggtgctcgatttagacgtctcatcagggggaggtaacgtgctcagttaggacccagacggaaccatggaagccccagcgcagcgttcctcttcctcctgatacgtctggctcccagaatcactggagaatcgtgatgacgcacgtctcagcccacctgtctgtctctccgaggganagacgccctaccctctccgtagccgacggggccctagttcaacggtagtttacgttaacggtaaacccaacccggtagtaccccgttacgggttaaaccctacgttacgtaaacggtaaaaaccctttcggggaacccgtaacgggtcccttaccccgaaaggttaccccttacccgtaccgtaacttcccttaaagtcggaccttacggacctacgtaccccgaacggaccggggtacccttaacgttcgggttaaccgttacccccgtaaggtacccggtacggttttaccgaaggtaccgggttacgtagggttcggggttacgtacggggtaactagggtaccgtttaccgacgttaccgtaccctaaccgttacgttcgaaccgtaccgtaccgtccgtacgtaccgttacgggttactaacggttaaagttacttttgttaaccgtttttaagtttacgtttacgtttaacgtacgtacgttaaccgtagttaacgttacgtaactacgggttaaccttccgggtacccttacggtaccgttaacccggttaccggttaccgggacccgaaggggtacccgtaagtaaccggtacgtaaaaccgaaagtaaaccggtcctaggggtacccagtactacccgtaccttacgg

SEQ ID NO: 136082 - DNA, 760 bp, Homo sapiens
  misc_feature: GYAE6OF01CCT7W.38.1.A01.1.454.CMB.1.raw
  modified_base (195)..(195): a, c, t, g, unknown or other
  misc_feature (195)..(195): n is a, c, g, or t
  modified_base (589)..(589): a, c, t, g, unknown or other
  misc_feature (589)..(589): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctccagaaatcactggagaaatcgtgatgacgcagtctccagcccaccctgtctgtgtcctcgagggganagacgcccaccctctcctgacgagggccagtcagtagtgttaacgaaccaccgtagccgtggtaaccatacgaacgaaaccgtggaccgacggcctacccgacgtaccttccctactattcctaagtgaacttcgacctaccgtacccgaaccggacggaccctacgttcgggtaccgtccccgaacggtacccgtacgggttaccgacgggttcggacggtacgggttcgggttaccggtacgggaactacggtacggttaccacgttacctacccgaactacgtaccgacgtacgaccgtccgtcgtactacgttaccgtaaggttaaacgttttcgtttacgtacgttttaagttttactttagttacgttacgacgttataacggtttanaggttacgtaccgtaaggttcccgtacccttacggttacctacccggttacccggttaccgggacccgggtaacgggtaccccgtaacgtaaccgtaaccgggtaaactaaaacggttaaaccgtacggttacgggtacggtaccgttaaccgacccgttaacgttcccgg

SEQ ID NO: 136083 - DNA, 693 bp, Homo sapiens
  misc_feature: GYAE6OF01BWBQ6.38.1.A01.1.454.CMB.1.raw
  modified_base (194)..(194): a, c, t, g, unknown or other
  misc_feature (194)..(194): n is a, c, g, or t
  modified_base (620)..(620): a, c, t, g, unknown or other
  misc_feature (620)..(620): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccaccctgtctgtgtctcgagggganagacgcccaccctctcctgcgagggccagtcgagtagtgttaacgtaacaaccgtagcctaggtaccatcaagaaacctggaccctaggcctacccgagtacctcctacatcctatgactgaccactccaccgacgggaccctacgttcgggtccgtaccccgacgtccgtacggttccaggtgggaccgtagggttcggggtactacggggaactaggtaacggttccaaccgttctacccgtaacattaccgacggtcgacgtccttacggacttagtacgttaggtaacgtttgttttacggtactttaggttttaactttagttagtacctaggtacctaagttacgtagtacttcggtacgtaccggtcccgttacccgtatacccgttacccgttaccgggaccggtaccggggtaaccncggtaaccgtacggaaaccctaaagttaaaccgggaactcgggtacggttacctaccggaccgtaccgttacg

SEQ ID NO: 136084 - DNA, 667 bp, Homo sapiens
  misc_feature: GYAE6OF01AIFRV.38.1.A01.1.454.CMB.1.raw
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccaccctgtctgtgtctccgaggggagagagccaccctctcctgcagggccagtcagagtgttagtaacaacctagcctggtaccatcagaacctggccaggcctccagactcctcatctatgatgccatcccaccgacgggcccacgttcgggtctccccgaggccctagggttccgaggtcgggctagggttgggtcgtgggactaggtacgttccaacctcctacaccctataccgacgccgacgcccgtgacctagtcgtaggaaagttagttttacgacgtttagttttaattagtttgtacgtagtaccgtaagttagtacgtacgttcgtaacggtcggtccctaccggtacgttacccgtacccgttacccgggtacccggtaaccgggggtaacctaacccgggtaaccgttacgggaaacccggttaaaacgtaaaacccggtaaccgttacgggtacggttaccgtacggtaccgtaacccgttaacg

SEQ ID NO: 136085 - DNA, 656 bp, Homo sapiens
  misc_feature: GYAE6OF01ET027.38.1.A01.1.454.CMB.1.raw
  modified_base (195)..(195): a, c, t, g, unknown or other
  misc_feature (195)..(195): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagtcaccctgtctgtgtctccgagggganagcgccacctctcctgcgagggccagtcgagtagttagttaagaacaactagtccgtggtaaccatacaacgaaaccgtggaccaagggcctacccgagtacctcctacagttcctagtagactggaccactacccaacgtacgggccctaacgtcggtacgtaccccagccgtagggttcaggtcgacgtagggtcgggtaccgtaggggtacacggtaacgtccacttcctacaccaactcgaacgcgtaactccagtctagtacgtaagtaacgttatttacggtacttaagttttacgtttacgttgtacaggaccttaaggttactaggtacgtcgtaacggttcggtaccctacgtacgtcctaccggttcgggaccggaaacgggtaccaacggtactaacggaaaccttaaaacgaacgtacgtcggtacggaccttaggccctaaccgtacg

SEQ ID NO: 136086 - DNA, 648 bp, Homo sapiens
  misc_feature: GYAE6OF01C234I.38.1.A01.1.454.CMB.1.raw
  modified_base (203)..(203): a, c, t, g, unknown or other
  misc_feature (203)..(203): n is a, c, g, or t
  modified_base (389)..(389): a, c, t, g, unknown or other
  misc_feature (389)..(389): n is a, c, g, or t
  modified_base (435)..(435): a, c, t, g, unknown or other
  misc_feature (435)..(435): n is a, c, g, or t
tcagtcgatcacgtcacgaccggtgctcgatttagacgtctcatcaggggggaggaactgctcagttaggacccagacggaaccatggaagcccccagcgcagcttctcttcctcctgatactctggcctcccagaaatcactggaagaaatcgtgatggacgcagtcctccagcccaccctgtctgtgtcctccgagggganagacgcccaccctctcctggcgacgggccagtaccagtagttgtaacgtaaccaccgtagcctaggaaccataccgaacgaaaccgtggcccaaggtccctacccgagtaccctacctcaacttctaatgatcgacctactcccaccggaggccctacgtggccgtacccgagtcccgtaggtacnggtggcgtaggtcgggtcagggacaggtacgtcactccgtacactntaccgagccgacgtccgtgactacgtcgtaggtaatgttttacgtacgtttaagttttattacgttacgtactacggtacgttattagtagtacgtacgtacgcggtcccctaacggtcttaccgtcccggttacggaccggtacgggaactacgggtaactaggaaaacctaacggtaaaccgtcggtacgaggtactaccgcctacgtaac

SEQ ID NO: 136087 - DNA, 789 bp, Homo sapiens
  misc_feature: GYAE6OF01CQDY2.38.1.A01.1.454.CMB.1.raw
  modified_base (643)..(643): a, c, t, g, unknown or other
  misc_feature (643)..(643): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggcctccagaaatcactggaagtaaactcgtgatgaccgctacgtcctccacgccctacccgtgtctggtcgtcgtccggaggggagacggacgcccctacccgtcctcgtacgccggaacggcctagtacaaggtagttaacgttaaccggtaaaaccaccgttacgtccgtaaccggtaaccactaccgaaacggtaacccgtcggaaccgtaccggtacccacccgtacgtacccctcctacgtaacctgttaacgtcgtatccgtacctacccgaccccgaacccgggtacggtccccggtaacgttcccgggtaccgtaccccgacggtaccggtacggtttaccggaggtccggagggttacggggtccggggtacgtacgggtaacgaacggtttccctaccctattacccgtaccgaacttacgccggacgactcccgacgtgaccgtacgtagtaacggttagtttaccgttttaggtacgtttttaagtttaagtttacgtcggttaacncgggttaagttacgtaccgtagtacggtaccgtacggtccgttacccgtcgtacggttaacccgtaccggtcccgggaacgacggaacgtaccgaagtaacggtacgtaaacgaatcggttcgacgtgaacccgtaccgttctacg

SEQ ID NO: 136088 - DNA, 767 bp, Homo sapiens
  misc_feature: GYAE6OF01C155T.38.1.A01.1.454.CMB.1.raw
  modified_base (201)..(201): a, c, t, g, unknown or other
  misc_feature (201)..(201): n is a, c, g, or t
  modified_base (639)..(639): a, c, t, g, unknown or other
  misc_feature (639)..(639): n is a, c, g, or t
tcagtcgatcacgtcacgaccggtgctcgatttagacgtctcatcagggggaggaactgctcagttaggaccagacggaaccatggaagccccagcgcagcttctcttcctcctgatactctggctcccagaaatcacgtggagaaatcgtgatgacgcacgtctccagcctacccgtgtctgtcgttctaccgagggganacgcgcccacctcctcctgcgacggccaggtcgagtacgtagttaacgtaacaccgtagtccgtcggtaccatccgaaacgtaaccgtggacccgaaggtccctaccgaacgtaccttccactaacttactacgtagtaacgccgtacacctaacccgtaaccggaacgggtccccttaaaggtcgggttcctaacccgacggtacccgaaggttttccaaggtcggtacgtaccggggtttggggtaaccttcgggggaacttaagggttaccgttaccgtactttaccccgtaacgtaccgtacggttacgaaccggtacccggtacgtacccgtttggaacccgtaggttccgttaaaaggttaacggttactttttcgggtaacgtttaaaggtttttactaggtttaccgtaagccgttaagtaacggtttancgtacgtagtcggttccgaccgtacctcgtaccgtacccggttacggaccggagggtacacccggtaacgttacggaaaacttaaccgtaaggtaccgtagggtacctaggtccaccggtacttacgg

SEQ ID NO: 136089 - DNA, 754 bp, Homo sapiens
  misc_feature: GYAE6OF01E2KZG.38.1.A01.1.454.CMB.1.raw
  modified_base (714)..(714): a, c, t, g, unknown or other
  misc_feature (714)..(714): n is a, c, g, or t
  modified_base (749)..(749): a, c, t, g, unknown or other
  misc_feature (749)..(749): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctcggcctcccaagaatccacgtggaagtaaatcgtgtactggacgctagtcctaccacgccctacccgttgtcttgttacgtccgtccggaaggggagacgaccgcccctacccgttcctaccgtgacggacgggaccctaggtacgaggtagttacgtttaacgaacctaaccgtaggtcccgttacggtaccagtaccaacggaaccgtcggaccgtacggcctaccgacgtacccttaccactaacttcgtaagtcgtaactaggtacctaccgtaacccgaaccggtaccgggtaccctacggttaccgggttacgtacccccgtacggaccccggttacgggtttaccgagggtccggtaacgtacgggggtttccggggtacggtacgggtaaccttaggtaccgtttaccctaccgtacccgtacaacgttacgtaccgtcggaccgtaacgtccgtacggtactacggttcgtaaaggttacgtttacgttacgttaacgtttagttttattaacgtcgtatcggtataggtacttgacgtcggtagtcccgtcctacgcgtacgtcggaccgtcgaaggaccngtacgagactaacgatacgtgtacgagctaaccgnttacg

SEQ ID NO: 136090 - DNA, 828 bp, Homo sapiens
  misc_feature: GYAE6OF01AO58O.38.1.A01.1.454.CMB.1.raw
  modified_base (322)..(322): a, c, t, g, unknown or other
  misc_feature (322)..(322): n is a, c, g, or t
  modified_base (808)..(808): a, c, t, g, unknown or other
  misc_feature (808)..(808): n is a, c, g, or t
tcagtcgatcacgtcacgaccggtgctcgatttagacgtctcatcaagggggaggaactgctcagttaggacccagacggaaccatggaagccccagcgcagcttctcttcctcctgatactctggctcccagaaatcactggaagaaatcgtgatgacgcacgtcctccacgccacctgtctgtcgtctccgaggggagagacgccaccctctcctgcgacgggccagtcagagttacgttaacgtaaaccaaccgtacgtccgtacggtaaccatacgaacgtaaccgtcggaccacggtccctaccacgtaccttcccnctaatctagtgtactcgtaccacgtacccgaccggcgggtaccctacggttcgggtaccgtaccccgaacggtaccgttacggttaccgaagggttccgggacggttaggggttccggggtaccgttaggggaaaccgtaggtttaccggttacccaacccgttaccctaacccgaaccgttaacgtccggtaaccgcccggtaacgttcccgaacgggtaccgttaacggtttaaccgttaagtaaacggttttacgtttttacgggaactttttaaggttttactttacgttacgggtaacctcgtaacgtttaagggttacttcggaactttcggggtaaccggttccgttaaccccgtacccggttaccgttccccgtacccgggttaccgggaacccgggttaaccgggtaacgtaccccgggaagttaaccgggaaaaacctaaacccgggttaagtacgttccggtacgggttaacccncgtaacccctaggttacccg

SEQ ID NO: 136091 - DNA, 532 bp, Homo sapiens
  misc_feature: GYAE6OF02IRNB8.38.1.A01.1.454.CMB.1.raw
  modified_base (356)..(356): a, c, t, g, unknown or other
  misc_feature (356)..(356): n is a, c, g, or t
  modified_base (380)..(380): a, c, t, g, unknown or other
  misc_feature (380)..(380): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagcccaccctgtctgtgtctccgaggggagagagcccaccctctcctgcagggccagtcagagtgttagtaacaacctagcctggtaccatcaagaaacctggccaggcctcccagacctcctcatctatgatgcatcccaccgacgggccacgtggtctcccgagccaggttcagtggcaggtgggtcngggacaggtagttcactctcaccntcagcagcctgcagtctagaagtatttgcttagttttattagttgtcagctagtatgatcgagtcgcctcgatccaccgttcggaccgtaggggaccaacggtacgtaggaactaaagtaaaccgagtacggtcggactacgcctacctacg

SEQ ID NO: 136092 - DNA, 526 bp, Homo sapiens
  misc_feature: GYAE6OF02GZCUB.38.1.A01.1.454.CMB.1.raw
  modified_base (194)..(194): a, c, t, g, unknown or other
  misc_feature (194)..(194): n is a, c, g, or t
  modified_base (397)..(397): a, c, t, g, unknown or other
  misc_feature (397)..(397): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccaccctgtctgtgtctccagggganagagccaccctctcctgcagggccagtcagagtgttagtaacaacctagcctggtaccatcagaaacctggccaggctcccagactcctcatctatgatgcatccaccgagggcccacgtggtcgtcccagcccaggttcagtggcaggtgggtctgggacaggagttcactctcaccatcagcagcctgcagtctagaagtntttgcttagttttattattgtcagctagttatgatcgagtcggccttccgactccgtacccgttccggccgaggggaccaacggacgtacggaactaacgtaacgacgtggtcggctcgacctacgtac

SEQ ID NO: 136093 - DNA, 581 bp, Homo sapiens
  misc_feature: GYAE6OF02JZKVN.38.1.A01.1.454.CMB.1.raw
  modified_base (107)..(107): a, c, t, g, unknown or other
  misc_feature (107)..(107): n is a, c, g, or t
  modified_base (313)..(313): a, c, t, g, unknown or other
  misc_feature (313)..(313): n is a, c, g, or t
  modified_base (344)..(344): a, c, t, g, unknown or other
  misc_feature (344)..(344): n is a, c, g, or t
  modified_base (377)..(377): a, c, t, g, unknown or other
  misc_feature (377)..(377): n is a, c, g, or t
  modified_base (456)..(456): a, c, t, g, unknown or other
  misc_feature (456)..(456): n is a, c, g, or t
tcagtcgatcacgtcacgaccggtgctcgatttagacgtctcatcagggggagggaacgtgctcagttaggacccagacggaaccatggaagcccagcgcagcttcncttcctcctgatactctggctcccagaaatcactggagaaatcgtgatgacgcagtctccagccaccctgtctgtgtctaccagggggacagagcccaacccttctaccctggccaaggggccaaggtccaaggacgtgttacgtaaaacaccctagccttacgggtaccatccaagaaacctgggccaggctcccgagactccanactctatcgatgcatccaccagggccatggntcccagccagttcaggtcgctaggtcgggtacnggggacaggagtttcacttccgacactactcagcacggctgctagtcaggactagtttgacgtagtttagttattcgtntacgtcgtagttactgtaactcgtaagtggtcctcgtattccgacgtttccgcgtagggaccaggtaccttggaaaccaacggtaaccgtaacgttacggccggttaacgcgttaccgaacctag

SEQ ID NO: 136094 - DNA, 544 bp, Homo sapiens
  misc_feature: GYAE6OF02HOZBD.38.1.A01.1.454.CMB.1.raw
  modified_base (194)..(194): a, c, t, g, unknown or other
  misc_feature (194)..(194): n is a, c, g, or t
  modified_base (431)..(431): a, c, t, g, unknown or other
  misc_feature (431)..(431): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggataaatcgtgatgacgcagtctccagccaccctgtctgtgtctccagggganagagccaccctctcctgcagggccagtcagagtgttagtaacaacctagcctggtaccatcagaaacctggccaggctcccagactcctcatctatgatgcatcccaccagggccactggtctcccagccaggttcagtggcaggtgggtctgggacagtagttcactctcaccatcagcagcctgcagtctagaagtattttgactagttttattattgtcagctagtatgatcgngtgtccctcgactccgtaccgttcgggaccgaggggaccacggtaaccgtagggaaacctaaacgttaaaccggaacgtttcggtacgggtacctacggacctaacccgtacg

SEQ ID NO: 136095 - DNA, 556 bp, Homo sapiens
  misc_feature: GYAE6OF02GLCBD.38.1.A01.1.454.CMB.1.raw
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccaccctgtctgtgtctccaggggagagagccaccctctcctgcagggccagtcagagtgttagtaacaacctagcctggtaccatcagaaacctggccaggctcccagactcctcatctatgatgcatccacgagggccagtggtctcccagcccaggttcaggtgcaggtgggtctgggacagagttccactctacacctatcagcacgcctgcagtcctagtaagtgttttgcttaagttttattatttgtctagtctagttatgtatcgtagtcgtcccttcgactaccgtaccgttccgggaccgtacggggacctacgggtaacgtacggaaacctaaacgtaaacgaacgttcggtacggtcgtacggacctaccgtaacg

SEQ ID NO: 136096 - DNA, 555 bp, Homo sapiens
  misc_feature: GYAE6OF02GH8Z2.38.1.A01.1.454.CMB.1.raw
  modified_base (194)..(194): a, c, t, g, unknown or other
  misc_feature (194)..(194): n is a, c, g, or t
  modified_base (299)..(299): a, c, t, g, unknown or other
  misc_feature (299)..(299): n is a, c, g, or t
  modified_base (355)..(355): a, c, t, g, unknown or other
  misc_feature (355)..(355): n is a, c, g, or t
  modified_base (388)..(388): a, c, t, g, unknown or other
  misc_feature (388)..(388): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccaccctgtctgtgtctccagggganagagccaccctctcctgcagggccagtcagagtgttaagtaacactagcctggtaccatcagaacctggccaggctccagactcctcatctatgatgcatccacnggccagtgtctccagccaggttcagtgcaggtggtctgggacagacgttcacttcncaccatccagcacgcctgcagtctaggtaattnttttgacttagtttatttattcgtctacgtactagttactagtacttacgtaggttcgtaccttaccgacttccgtaccgttccggaccgtacggggacctaacggtaacgtacggaaacctaaacgttaaacggacgttcggtacggcgttacgaccgtacctacg

SEQ ID NO: 136097 - DNA, 659 bp, Homo sapiens
  misc_feature: GYAE6OF02J1O0I.38.1.A01.1.454.CMB.1.raw
  modified_base (197)..(197): a, c, t, g, unknown or other
  misc_feature (197)..(197): n is a, c, g, or t
  modified_base (311)..(311): a, c, t, g, unknown or other
  misc_feature (311)..(311): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccaccctgtctgtgtctaccgaggggagngacgcctacccgtctcctgcacgggccagtcagacgtgtaagtaacacctagcctaggtaccatccaagtaaaccctggcccaaggtcctaccccagtacctccctcatcgtangatcgcatcccaccgacggggccctacgtgggtaccgtccccagtacccgagggtttccaacggtttgggacctacgggttggggtccgtaggggaaccaggtaccgtttcgaccttccgttaccaaccttagttacgacgacgacgtcctaggcctaggttcgtacggtaacggttattttacgacgtttaaggttttacttaggtttaccgtagtacggtacttagttatacgtacgtacgtaggtccgttccgtaccgtactccgtaccgttccggacgtacgggtacacggtactaggaacctaaagtaaccgtacgtaggtccgtacggtcgtaccacgtacg

SEQ ID NO: 136098 - DNA, 507 bp, Homo sapiens
  misc_feature: GYAE6OF02F6V7W.38.1.A01.1.454.CMB.1.raw
  modified_base (194)..(194): a, c, t, g, unknown or other
  misc_feature (194)..(194): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccaccctgtctgtgtctccagggganagagccaccctctcctgcagggccagtcagagtgttagtaacacctagcctggtaccatcagaaacctggccaggctcccagactcctcatctatgatgcatccaccagggccactggtcgtcccagccaggttcagtggcagtgggtctgggacaggagttcactctcaccatcagcagcctgcagtctgaagtattttgctagttttattattgtcagtctagttatgatcagtcggcctcgactcaccgttcggccgaggggaccacgactacggaactaacgtaacgacgtggtagctcgaccacctac

SEQ ID NO: 136099 - DNA, 542 bp, Homo sapiens
  misc_feature: GYAE6OF02F2SVY.38.1.A01.1.454.CMB.1.raw
  modified_base (195)..(195): a, c, t, g, unknown or other
  misc_feature (195)..(195): n is a, c, g, or t
  modified_base (303)..(303): a, c, t, g, unknown or other
  misc_feature (303)..(303): n is a, c, g, or t
  modified_base (399)..(399): a, c, t, g, unknown or other
  misc_feature (399)..(399): n is a, c, g, or t
  modified_base (431)..(431): a, c, t, g, unknown or other
  misc_feature (431)..(431): n is a, c, g, or t
tcagtcgatcacgtcacgaccggtgctcgatttagacgtctcatcagggggaggaactgctcagttaggacccagacggaaccatggaagccccagcgccagcttctcttcctcctgatactctggctcccagaaatcactggagaaatcgtgatgacgcagtctccagccaccctgtctgtgtctccagggganagagccaccctctcctgcagggccagtcagagtgttagaacaacctagcctggtaccatcagaaacctggccaggcctcccagactcctcatctatgatgcatccacngggccatggtctcccagtccaggttcagtcggcagtgggtctggggacagtacgttcacttcctcgacctatccagcagcctgcagtcagtaagtnttttgcttagtttatttatgtcatctaagttntgtatacgtagtcgtccgttccatcctaccgttccggacgacggggactaccggtaacgtacggaacctaaagtaaaccgacgttacggtaggactcggaccaccgttacg

SEQ ID NO: 136100 - DNA, 691 bp, Homo sapiens
  misc_feature: GYAE6OF02H9ZXC.38.1.A01.1.454.CMB.1.raw
  modified_base (196)..(196): a, c, t, g, unknown or other
  misc_feature (196)..(196): n is a, c, g, or t
  modified_base (209)..(209): a, c, t, g, unknown or other
  misc_feature (209)..(209): n is a, c, g, or t
  modified_base (250)..(250): a, c, t, g, unknown or other
  misc_feature (250)..(250): n is a, c, g, or t
  modified_base (277)..(277): a, c, t, g, unknown or other
  misc_feature (277)..(277): n is a, c, g, or t
  modified_base (295)..(295): a, c, t, g, unknown or other
  misc_feature (295)..(295): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagcccaccctgtctgtgtctccgagggganagacgccaccctntcctgcagggccagtcagagtgtagaacactgcctgtaccntcagaacctggcagcctccagcctctnatctatgatgcatccacnggccagtggctccagcctaggttcaggtcggacaggttcggtactgggacaggtcgttacacttctaccactagtcagccgacgtccgtgaccgtagttccgtaggtaaacgttcgtttttacggacgttttaacgtttttaagtttactttacggttacgtaacggtaaccgttaaggtttacgttaacgggtacttaaccggttacgggttacccggttaccccgttacccgggtaaactttccccggttaaccccgggttttcccgggaaccccggggttaaccgggggtaaaccctaacccgggttaaccggttacggaaacccgttaaaacggttaaacccggttacggtacgggttaccggaccgtttacggaccccgtaacgttaccgg

SEQ ID NO: 136101 - DNA, 641 bp, Homo sapiens
  misc_feature: GYAE6OF02GMNB9.38.1.A01.1.454.CMB.1.raw
  modified_base (196)..(196): a, c, t, g, unknown or other
  misc_feature (196)..(196): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagcccaccctgtctgtgtctccgagggganagacgccaccctctcctgcgagggccagtcagagtgttacgtaacaacctagcctggtaccatcaacgaaccgtggaccaggcctacccagacctcctcatctatgatcgacactccaccgacgggccacgtcggtccgtacccgagtcccgtaaggttccgaggtcggacgtagggttcggggtacgtggggaactaggtacgttcaccgtctaccacctatcacgcacgccgtgccgtagtcgtaggtaaacttcgttttgactttagtttttaattagttcgtacgtagtaccgttaagttagtagtacgttcgtacggttccggtacccttacgacgtttccgtaacccgttccgggacggaccgggtaaccacgggtaacgttacgggaaacctaaacgttaaccggtacgtacggtcggtacctacggacctactaccg

SEQ ID NO: 136102 - DNA, 602 bp, Homo sapiens
  misc_feature: GYAE6OF02I6DXA.38.1.A01.1.454.CMB.1.raw
  modified_base (198)..(198): a, c, t, g, unknown or other
  misc_feature (198)..(198): n is a, c, g, or t
  modified_base (346)..(346): a, c, t, g, unknown or other
  misc_feature (346)..(346): n is a, c, g, or t
  modified_base (388)..(388): a, c, t, g, unknown or other
  misc_feature (388)..(388): n is a, c, g, or t
  modified_base (409)..(409): a, c, t, g, unknown or other
  misc_feature (409)..(409): n is a, c, g, or t
  modified_base (438)..(438): a, c, t, g, unknown or other
  misc_feature (438)..(438): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggcctcccagaaatcactggagaaatcgtgatgacgcagtctccagcccaccctgtctgtcgtctccgagggganagacgcccaccctctcctgcacgggccagtcaggagtgttaacgaacaacctgcctaggtaccatcgaacgaaccgtggaccaggcctacccgagtaccttcctacattcctagtgatcgcactcccgacgagggccctagtcggtcnccccagcccgtaggttcaggtggctagggtggtctagggacnggtacgttccacgtcacactncgagcagcctgactgtacgtagtaagttntttacgtcgttaattttattgtgtacagtcgtaagttatcgtatcgtaggtcgtccgtactacttaccgtaccggttccggacgtacgggtacctaaccggtacgtaccggtaaactaaaccgtaacgtacgttcggtacggtactacggtacctaccgttacg

SEQ ID NO: 136103 - DNA, 554 bp, Homo sapiens
  misc_feature: GYAE6OF02FO7ZK.38.1.A01.1.454.CMB.1.raw
  modified_base (194)..(194): a, c, t, g, unknown or other
  misc_feature (194)..(194): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccaccctgtctgtgtctccagggganagagcccaccctctcctgcagggccagtcagagtgttagtaacaacctagcctggtaccatcagaacctggccaggcctccagactcctcatctatgatgcatcccaaccgagggcccacgtggtcgtcccaggccctaggttcagtggcagggttcgggtctggggactaggtacgttccacttcgtacaccctatccgagcacgcctgactagttctaggaagtgttttgacgttagtttatttagttgtcagtctagtatgtatcgtagtcgtcctcgtactccgtaccgttcggaccgagggaccacggacgtacggaactaacgtaaacgacgtgtacgtctcggtaccactacg

SEQ ID NO: 136104 - DNA, 650 bp, Homo sapiens
  misc_feature: GYAE6OF02JM5L2.38.1.A01.1.454.CMB.1.raw
  modified_base (193)..(193): a, c, t, g, unknown or other
  misc_feature (193)..(193): n is a, c, g, or t
  modified_base (224)..(224): a, c, t, g, unknown or other
  misc_feature (224)..(224): n is a, c, g, or t
  modified_base (281)..(281): a, c, t, g, unknown or other
  misc_feature (281)..(281): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaatcgtgatgacgcagtctccagccaccctgtctgtgtctccagggganagagccaccctctcctgcagggccagtcagngtgttagtaacacctagcctggtaccatcagaacctggccaggcctccagactcctnacttcctagtgatcgacatccaccagggcccagtggtctcccgagtccctaggttcaggtcggacgtaggtcggggtctggggacctaggtacgttccacgtctaccgacgtactcgaacgtcgaacgtcccgtggtaccctaggttcctaggtaaagttcgttttacggcgttaacggtttttagttacgttaggttacctaaggtccgttaagtacgttgtaacttcgtaacggttccggtacccgttaccggtacgttacccgtacccgtttaccgggcccggtaaacggggcctaaaccgggcgtacgggaaacgtaactaaaccggtaacgttggtaccggacttacggacccgtacttaaccg

SEQ ID NO: 136105 - DNA, 756 bp, Homo sapiens
  misc_feature: GYAE6OF02IK84Q.38.1.A01.1.454.CMB.1.raw
  modified_base (195)..(195): a, c, t, g, unknown or other
  misc_feature (195)..(195): n is a, c, g, or t
  modified_base (319)..(319): a, c, t, g, unknown or other
  misc_feature (319)..(319): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccaccctgtctgtgtctccgagggganagacgccaccctctcctgcgagggccagtcagtagttgttaacgtaacaacctagcctaggtaaccatcaagaaacctggccaggcctaccccagcctcctcatctatgatgcactccaaccgnggacctacgtggtctacccagccgtaggttcaggtggctagggttcgggtctaggggactaaggtacgtttccaccgttctaccgacctaattcccgaacgtccgaacggtcccgttacggacgtaacggttccgttaaggtaaacgtttagtttttacggaaccgtttaaggttttttaacgtttaagttttcggtacgtaacggttacgttaacggttaagtaggttaacgttacggtaacggtttccgggaccccgtttaccgggtaaccgttccccggttaacccggtttcccggggaacccgggtaaacgggggtacccgtaaaccggggttaacccgtaacggggttaaaaccctaaaacggtttaaaacccgggaaccggtttacgggttaaccggtaccgtttaaccggaccccggttaaaccttacgg

SEQ ID NO: 136106 - DNA, 595 bp, Homo sapiens
  misc_feature: GYAE6OF02HDC76.38.1.A01.1.454.CMB.1.raw
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagcccaccctgtctgtgtcctccgaggggagagagcccaccctctcctgccgagggccagtcaggagtgttaagtaacaacctagcctggtaccatcaagaaacctggaccaggcctacccgagacctcctacatctatgatcgaccactcccacgaggccacgtcggtctacccaggtcctaggttcaggtcggacgtaggtcgggtcgtagggactaggtacgttccacgtctaccaaccactacgacgcacgtccgtgacgtagtctagtaacgttgtttagtacttagttttattagttcgtctagtactagttactagtactcgtacggtcgtaccctcgtactccgaccgttcggaccgtacgggaccaacggacgtacggaaactaacgtaacggacgttcggtacggactacgactacctg

SEQ ID NO: 136107 - DNA, 709 bp, Homo sapiens
  misc_feature: GYAE6OF02JH6Y2.38.1.A01.1.454.CMB.1.raw
  modified_base (194)..(194): a, c, t, g, unknown or other
  misc_feature (194)..(194): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccacctgtctgtgtctccgagggganagacgcccaccctctcctgcgacgggccgtacaggacgtagttaagtaaccgaaaccgtacgacgtacggtaccatactacggaaaaccgtcggtaccgacggtccgtacccgacgacgtaccctcactactacgtgagtcgcgactaccgacccgaacgggcctacgtaggttcgtcccgaacgtccggacggttacgtacggtacggtacgtaggggttccggggttaccggtagggggtaacgtacgggtaacgtttaccgaccgtttaccctccgaacccgtaactacgtacggacctacgtcccgttagacgtactaccggtagtaacgttagtttctacgttaacgttttattatttcggtagtacgtactaaggttaactggtaacgttagtggtaccggtcctaccgtacttaccgaccggttccgaccggtagggaccgaccggtaaggtaccgaacgtaaccgtaagtaaccgtcgtacgggtactcggtaccctacgagttacc

SEQ ID NO: 136108 - DNA, 924 bp, Homo sapiens
  misc_feature: GYAE6OF02JYUJ5.38.1.A01.1.454.CMB.1.raw
  modified_base (196)..(196): a, c, t, g, unknown or other
  misc_feature (196)..(196): n is a, c, g, or t
tcagtcgatcacgtcacgaccggtgctcgatttagacgtctcatcagggggaggaactgctcagttaggacccagacggaaccatggaagccccagcgcagcttctcttcctcctgactactctggctcccagaaatcactggagaactcgtgatgacgcagtctcagccacctgtctagtcgtctccgagggganagacgcccaccttctcctggaccgagggccctagttacaaggtacgtgttaaacgtaacccaacttaggcccttagggtaaccctagtacgaaacggtaaaacccgtcggaccctaacgggtcccgtaccccgaaggtaaccctcccttacgtaaattcccttaaagccggttattccggaaccacgttcccaaaaccccggcgggggtaccctaacgttcggggggtaaaccttcccccgaacggttaccgaacgggtttttaccacggggtttaagccccggggtaagggttcccggggttttaagacgggggaacctaacgggggttaccttttaacgaccccgttcggttaaaacccgcccgttttaaaaggcccggttaaacggcccgtttaacggaccccggttacggtacgttaaaccggtccgtaaggtaaacggttacgtttaacgtcgtttaaacggttttatttaacgttccggttaaacgtcggtaaccctttaaaagggtcttttaccggaaagttcccggtaaaggttacccgggtcccgtttaaccgggttaaacttacccgggtttaaccggtttacccggaccgggttacgggggttaacccgaaaacccgggtttcgttaacccgggggaaaactttaaccggttaaaacccgggtaagtttccggggtaaaccgtccgttttaacgggtaaccccaaggttttaacccg

SEQ ID NO: 136109 - DNA, 702 bp, Homo sapiens
  misc_feature: GYAE6OF02JUROC.38.1.A01.1.454.CMB.1.raw
  modified_base (200)..(200): a, c, t, g, unknown or other
  misc_feature (200)..(200): n is a, c, g, or t
  modified_base (586)..(586): a, c, t, g, unknown or other
  misc_feature (586)..(586): n is a, c, g, or t
  modified_base (595)..(595): a, c, t, g, unknown or other
  misc_feature (595)..(595): n is a, c, g, or t
  modified_base (602)..(602): a, c, t, g, unknown or other
  misc_feature (602)..(602): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaatcgtgatgacgcagtcctccagccaccctgtcctgtacgtctccgagggggtanagacgcccacccttcctcctgcgacgggccaagtccaggtagtgttaacgaaaccaacctaggtcctaggtacccattaccgaacgtaaacctgggaccacgggtccctccccgaacgtaacccctcctattacctacgtgatacgtcgactaccgacccgacggtccgacgtccggtcgacccgtacggaccgtacggttaccggtggtacggtcggtaacggtcgggttacggtcgggtaacggtacggtaccggttactaccggttaccttaccggaaccctacgtaccgtaacggtacaacgtccggtacgtacgacggttcgtacgttaacggttattttaccgttacgttaggtttaacttttagttacgttcgaacgtntaacggttntaacgtntacgtagtgtaccctacgtacctcgttaccgccgacgtacggcgaacgtggtaacgaacgaacgtaaacgtacgtggtacgtcgtacgcttaccgattcg

SEQ ID NO: 136110 - DNA, 717 bp, Homo sapiens
  misc_feature: GYAE6OF02INALQ.38.1.A01.1.454.CMB.1.raw
  modified_base (193)..(193): a, c, t, g, unknown or other
  misc_feature (193)..(193): n is a, c, g, or t
tcagtcgatcacgtcacgaccggtgctcgatttagacgtctcatcagggggagaactgctcagttaggacccagacggaaccatggaagccccagcgcagcttctcttcctcctgatactctggctcccagaaatcactggagaaatcgtgatgacgcagtctccagccaccctgtctgtgtctccagggganagacgcccaccctctcctgcagggccagtcagtagtgttaagaacacctagcctaggtaccatcgaagtaaccgtggcccaggcctcccagtacctcctacacttctatgatgaccacgtcccaaccgagggccctacgtcgggtctaccccgaggtcccgtaggttccaaggttcgggaccgtagggttcgggggttacctaggggaacctaagggttacgtttaccaaccgttcccttaccgaaccctagtccgaacgtccgaacgtcccgtgacgtacgttacgaggtaaagttacgttttagtacgtttaagtttttattacgtttacgtacctaggtaccttaaggttactacggttacgtacgtaacgggttccggtacccgttaccgtaccgttacccgtacccggtttaccgggaccgtaacggggtacctaaccgggttaaccgtaacgggtaaaccaaaacggttaaaaccgttacggttacggtacggtaccttacggacctaaccgttaccg

SEQ ID NO: 136111 - DNA, 898 bp, Homo sapiens
  misc_feature: GYAE6OF02JKKVT.38.1.A01.1.454.CMB.1.raw
  modified_base (892)..(892): a, c, t, g, unknown or other
  misc_feature (892)..(892): n is a, c, g, or t
tcagtcgatcacgtcacgaccggtgctcgatttagacgtctcatcgagggggaggaactgctcagttaggacccagacggaaccatggaagccccagcgcagccttctcttcctacctgactactctggcctacccagaaatcactggaagaatcgtagatgacgctagtctccgagcccaccgtgtcgttagtcgtcctaccggaggggagaacgccgtaccctaccctcctacggtcgcgacgggaccctacgtacgaaggtacggttacgttaacgtaaaccgtaacccgtacgacccggttacggtaaccctactaccgtaaaccggtaaacccgtcggggtacccgtaaacggtccccgttaaccggtaccggtaaccccttacccggacctaaacgttaaccgttaacgtaacggtacgttaccgtaaccgtaccgttaccccggaaacccgggtaccggggacccttaccggttaccgggttaaccgtaccccggtaacggttaccggttacggtaccggtaacggtccgggtacgggtttaacgggttcccgggttagggtaacccgggtaacggttacggttaaccggttaccgttaacccgttaccgtaaaccgtaccgttaaacgtcccggggtatacccgggtacgtacccgttaacggtaccggttaacggttacgtaaacggtttaacggttacgtttacggttaacctttaaggtttaccgtttaagttccgtaacgttaccggtatacgggttactacgttagtacggttcggttaccgttacgtctaccttacggtaaccgtccgggacgttaggacccgttaacggacgtaacgtaacgtaaacgtacgtaccggtagaccgttcgacgttacncttacg

SEQ ID NO: 136112 - DNA, 831 bp, Homo sapiens
  misc_feature: GYAE6OF02FM835.38.1.A01.1.454.CMB.1.raw
  modified_base (166)..(166): a, c, t, g, unknown or other
  misc_feature (166)..(166): n is a, c, g, or t
  modified_base (203)..(203): a, c, t, g, unknown or other
  misc_feature (203)..(203): n is a, c, g, or t
  modified_base (208)..(208): a, c, t, g, unknown or other
  misc_feature (208)..(208): n is a, c, g, or t
  modified_base (221)..(221): a, c, t, g, unknown or other
  misc_feature (221)..(221): n is a, c, g, or t
  modified_base (541)..(541): a, c, t, g, unknown or other
  misc_feature (541)..(541): n is a, c, g, or t
tcagtcgatcacgtcacgaccggtgctcgatttagacgtctcatcagggggaggaactgctcagttaggacccagacggaaccatggaagccccagcgcagcttctcttcctcctgattactctggctcccagaaatcactggaagaaatcgtgatgacgcagtcnccaggccaccctgtccttgtgttcctaccaggggggnaacgngtcccacccgttntaccctggccaggggcccaagttccgaaggtaacgttggttttaacgtaaaccaacccgttacgccgtgggttaaccctatcaacgtaaaccttcgggaccacggaccttccccgaggaccttacccttcgacttccttaagcgtaaatggacctaactaccccaccggttaacgggcccctaacgttcggggttaccgttaccccacgggtcccctaagggggttttacccaggggtttacgggcccgttaaggttccgggggtttaccgtcggggaactaacgggtgtttacccgaactttccgtaccaacccgtaanccgtacgacgacgtacccttggaccgtacgtacttacggtaacggttaactttttacggttacgtaagtttttaacggtttttactttaacgggtcgtttaacgtaccggttaagttacttacggttaacgttacggttaaccgttagggtacccgggttcctaacggttaccctttaacccgttcccggttacggaccggggaccggttaaaccggcggttaacccggttaaagaaaccgtaaacgtaccgttaggaccgggttactacggttacccgaccttaaccgg

SEQ ID NO: 136113 - DNA, 567 bp, Homo sapiens
  misc_feature: GYAE6OF01B90L3.35.5.A05.1.454.CMB.1.raw
  modified_base (291)..(291): a, c, t, g, unknown or other
  misc_feature (291)..(291): n is a, c, g, or t
  modified_base (299)..(299): a, c, t, g, unknown or other
  misc_feature (299)..(299): n is a, c, g, or t
  modified_base (322)..(322): a, c, t, g, unknown or other
  misc_feature (322)..(322): n is a, c, g, or t
tcagtacagatcgtcacgaccggtgctcgatttagatagatagacagggggctctgcttcagctgtgagcgcagaaggcaggactcgggacaatcttcatcatgacctgctccctctcctcctcacccttctcattcactgcacagggtcctgggcccaatctgtcttgacgcagccgccctcagtgtctgcggcccaggacaacaggtcacatctcttgctctggatccaagtttgggagtagttatgtttcttggtaccagcaactccaggatcacgccccaaacttcnctatttanagaacaataataagccggcctanaggtaatttccagaccgtattctctggctccaggtctggcacgtcagcccaccgtggaactcaccggactccgaggcgtggggacgaggccgattatacgtgcgacgaacggtagggaataaacgaacggtagaagttggttaggagttcgttcgggacgggcgggtaaccaggtcgtacgacccgtacgtaacggtccgacggacccgaacggtcctaccgcccccgtcggtcctccgttcccg

SEQ ID NO: 136114 - DNA, 694 bp, Homo sapiens
  misc_feature: GYAE6OF01EM8S6.35.5.A05.1.454.CMB.1.raw
  modified_base (184)..(184): a, c, t, g, unknown or other
  misc_feature (184)..(184): n is a, c, g, or t
  modified_base (349)..(349): a, c, t, g, unknown or other
  misc_feature (349)..(349): n is a, c, g, or t
tcagtacagatcgtcacgaccggtgctcgatttagatagatagacagggggctctgcttcagctgtgagcgcagaaggcaggactcgggacaatcttcatcatgacctgctccctctcctcctcacccttctcattcactgcacgagggtcctgggcccaatctgtcttgacgcagccgccctnagtgtctgccggcccaggacaacgaggtcaccatctctgctctggactccgtaaggtttgggattagtttagttcgtttcgttacgggtaacctacgactaaacctcccgaaggtaccttaccgaaccccgtaacccccctaaaactttccgtacctaattttanacgtaactaaagtaagtaacggtccgtacctacgtaaggtaacttccgtagtaccgtatcctcgtcgcctcgtacgtcgtaggacctacggtacacgaccctacgtacgggactaccggaccgtacctcggacgggtacgacgggggacgaacggtcgtaatttacgtacgtcgcgtaaccgtacggtaggtaactaaacgaacgttagagttgggttacggacggttcgggtaccgggacggtaccgggtaaccgtacggtaccgtcgggaacccgttacggacggtaccgacccgacccgaaacgtacctccccgtaccccgtcgggtaccctccgttcccgg

SEQ ID NO: 136115 - DNA, 710 bp, Homo sapiens
  misc_feature: GYAE6OF02GIG8N.35.5.A05.1.454.CMB.1.raw
  modified_base (353)..(353): a, c, t, g, unknown or other
  misc_feature (353)..(353): n is a, c, g, or t
tcagtacagatcgtcacgaccggtgctcgatttagatagatagacagggggctctgcttcagctgtgagcgcagaaggccaggactcgggacaatcttcatcatgacctgctccctctcctcctcacccttctcattctactgcacagggtcctgggcccaatctgtcttgacgcaggccgccctcacgtcgtctgcggccccagggacaacaggtcaccatctcttgctctggactccgtaagtttgggagtagttatggtttcttggtaccagcaactcccaggatcacgccccaaacttctctatttagcgaactaataataacgccggtaccctacgaggaacttccgngtaccgtattcgtactggcctcgaggtctggcacgtcacgccaccgtggaactccgaaccggctccgacgggtccgtagggggaacctacgggtccgtaagtttacttaccgtcggaccgtacgtaaaccggtggggtaaacttaaaccggtaaacggttacgtaacgttcggggtttagggtaaccggtttccggttaaccggggaccgggtaccggggtaaccctaacgggtcccgttaacgggtaaccccggtttaccggttaaacggtacccgaaccggtaccccggtaaacgggtcccgtttaccccggacccccccggtttcgggttaccccgtaacccgttttcccccgg

SEQ ID NO: 136116 - DNA, 959 bp, Homo sapiens
  misc_feature: GYAE6OF02HT3VX.35.5.A05.1.454.CMB.1.raw
tcagtacagatcgtcacgaccggtgctcgatttagatagatagactagggggtcgggtctggcttccagctgtggagtccgcgagtaacggctagggactcgggacaaatccttacatacatgaacctgcctacccctctcgtcctttcgaccctttctacattcgttaccttgtcactagggttccctaaggggccctaactcgttgtcttggacgcaggtccgcctcgacgtggtctggccgtccccgaggaccaaacgcgggttccggaccctagtcgttcctttcgtccttcgttggactccgtaaggttttcgggtaggtttagtttaacttggtttttccgttacgggtaaccctagactaacgtacccgaggtacgttcccaaccgacccccgtaaactttccgtaacggtagttttacgtcggaactaagtaactaacgccggtaccttacgtaaggtaacttccgttaggaacccgtaatttccgtacgttaccggaccccctaggttccttcgggaccgtaaccggttccgacggtaccccaccccgttagggtaaacttcccgaaaccgggtaaccgttacccgaacgggttacccgtaacgggggaaaccgtaaccgggtaccggttaactttaacgtttaccgttacggaacgttaaccgtaaacggttaaccgggtaagttaaaaccggtaaaccggttaacgggtaacgttaccggggtttacggggtaacctttaccgggtttccggggtaaccgggttacccggggttaaccgtaacggggttaccggttaaccgggttaaccccggttttaacccgttaaaccgggttacccccgggtaacgggtaacccccccggggttaaacgggttcccggttacccgggttaccccccccgtttccgggttaaccccctacccggtttacccccgttaaccccgggg

SEQ ID NO: 136117 - DNA, 649 bp, Homo sapiens
  misc_feature: GYAE6OF02GBRG1.35.5.A05.1.454.CMB.1.raw
  modified_base (321)..(321): a, c, t, g, unknown or other
  misc_feature (321)..(321): n is a, c, g, or t
  modified_base (331)..(331): a, c, t, g, unknown or other
  misc_feature (331)..(331): n is a, c, g, or t
tcagtacagatcgtcacgaccggtgctcgatttagatagatagacagggggctctgcttcagctgtgagcgcagaaggcaggactcgggacaatcttcatcatgacctgctccctctcctcctcacccttctcattcactgcacagggtcctgggcccaatctgtcttgacgcagccgccctcagtgtctgcggcaccaggacaacaggtcaccatctcttgctctggatccaagtttgggatagttatgtttcttggtaccagcaactcccaggatcacgccccaaacttctcatttatgacaataataagcggccctanaggaattccngaccgtattcctctgctccagtctcggcacgtcagccacccgtgggactcgaccgactccgacggcgtggggacgacggccgaagtttacgttacgtcggaccgacgtaacggtagggtaaactaaaccggtaaaccggttaaggtaacgtttagggttacgggtaacggttccggtttaccggggaccggggtacccggggaaccgaacgggtccgttacgggtaaccccggttaccgttaaacggtaccggtaacgtacccccggaagggttccccgaccggttcccccccgttacgggttaccccttaaccccgg

SEQ ID NO: 136118 - DNA, 619 bp, Homo sapiens
  misc_feature: GYAE6OF02F3L16.35.5.A05.1.454.CMB.1.raw
  modified_base (302)..(302): a, c, t, g, unknown or other
  misc_feature (302)..(302): n is a, c, g, or t
tcagtacagatcgtcacgaccggtgctcgatttagatagatagacagggggctctgcttcagctgtgagcgcagaaggcaggactcgggacaatcttcatcatgacctgctcccctctcctcctcacccttctcattcactgcacagggtcctgggcccaatctgtcttgacgcagccgccctcagtgtctgcggccccaggacaacaggtcaccatctcttgctctggatccaagtttgggagtagttatgtttcttggtaccagcaactcccaggatcacgcccccaaattctcatttangaactaataataagcggcctgagaattcctgaccgtattctctggccccaggtctggctacgtcacgcccacccgtgggaactccgaaccggactccgagggtccgtgggggaacgacgggaccgtagtttaacgttaccgtgaccgacgtaacggtgggaactaaacgaacgtagtagttggttagggagttccgttcgggcggtaccggggaaccaagggtcgtacggaacccggttccgtaaacggttccacggtaccccgtaaagggcccttccggacccccccgttggtcccgtaccttcccgttaccccgg

SEQ ID NO: 136119 - DNA, 805 bp, Homo sapiens
  misc_feature: GYAE6OF02G3N22.35.5.A05.1.454.CMB.1.raw
tcagtacagatcgtcacgaccggtgctcgatttagatagatagacaggggctctgcttcagctgtgagcgcagaaggcaggactcgggacaatcttcatcatgacctgctccctctcctcctcacccttctcattcactgcacaggtcctgggcccaatctgtcttgacgcacgcccgcctcgtagtggtctgccggccccagggacctaacaggtccaccatcctctgtcctacgtggacttccgaagtttgggagttagttagttcgtttcgttaggtacctaaggccaaacctcccgtaagggacttaccacccggtacccctaaactttcctacttattttaacacgtaacctaaattaaagtaacgtcccggaccccttagaaggtaaccttccgtaccgtaacgtatttccgacgttggaccttaccggaggttccctaagggtccctaaggtacccgtaacgaccccgtaacccggtacggtaaacgttacccgaaccggtaaccccggttccgaacggggtaccggttacgggggaacccggttagggaccccgttaagttaaccgtttaccggactaccgggtaacgaaccgggttaaggaacgttaaacccgtaaacgggttacgaacgggtttaggtttaccggggtaacgttcccgggttttacggacccgggggtacgtaacccggtagtccgggttaccggtaacccggtacccggtttaacgacccggtaccggtaacccgaccgtaccggaccccgtttaccccggccggtaccgtacccgttcccggg

SEQ ID NO: 136120 - DNA, 808 bp, Homo sapiens
  misc_feature: GYAE6OF02J2486.35.5.A05.1.454.CMB.1.raw
  modified_base (153)..(153): a, c, t, g, unknown or other
  misc_feature (153)..(153): n is a, c, g, or t
  modified_base (249)..(249): a, c, t, g, unknown or other
  misc_feature (249)..(249): n is a, c, g, or t
  modified_base (541)..(541): a, c, t, g, unknown or other
  misc_feature (541)..(541): n is a, c, g, or t
  modified_base (704)..(704): a, c, t, g, unknown or other
  misc_feature (704)..(704): n is a, c, g, or t
tcagtacagatcgtcacgaccggtgctcgatttagatagatagacagggggctctgcttcagctgtgagcgcagaaggcaggactcgggacaatcttcatcatgacctgcctccctctcctcctcacccttctcattccgacttcgcaaccgngggtcctgggacccaatctgttctgacgcacggccgtccctagagtcgtctcggaccggcccaggaacctaacgaggtcccaactcttcctcgtcncctacgtaggtaactccggttaaggttggacttagttacttggtttacgtaacggaaccgagtcctaacccgttccacgggactacccgtaccgtaccccctaaacttccgttacttaagttttaccgacgttaaaacgtaaattaacgtacggtacccgtccgtaacgacggttaaccttccgaagtaccgttactccgtcgggtacgtcccgttcggacgttccgcggtacctaccggtactaccgccgtaaccggtacggtaaccgtcccggtaaccgtactaccgggnggtacccgggtttacgggaaccgtaccgggtaccggttaactttccgtacgtacggttccgaaccgtaacgggttaagaaccgtttaaacgacggttaaacggtcgtaacggggttacgtccgggttaaccgggttcgggaaccggttaacggtaccgggtanacccggtaccgggtaacctcggttaaaccgcccggaaccggttacccgacccggggtttacccaccgttcccccggaaaccgttccggaaccccgtttcccggg

SEQ ID NO: 136121 - DNA, 706 bp, Homo sapiens
  misc_feature: GYAE6OF02GU4KB.35.5.A05.1.454.CMB.1.raw
  modified_base (177)..(177): a, c, t, g, unknown or other
  misc_feature (177)..(177): n is a, c, g, or t
  modified_base (188)..(188): a, c, t, g, unknown or other
  misc_feature (188)..(188): n is a, c, g, or t
  modified_base (214)..(214): a, c, t, g, unknown or other
  misc_feature (214)..(214): n is a, c, g, or t
  modified_base (269)..(269): a, c, t, g, unknown or other
  misc_feature (269)..(269): n is a, c, g, or t
tcagtacagatcgtcacgaccggtgctcgatttagatagatagacagggggctcgtgcttcagctgtgagcgcagaaggcaggactcgggacaatcttcatcatgacctgctcccctctcctcctcaccctcctcactcactgtgctagggtcctgggcccagcctgtgctgacctnacgccaccctnagtccgtcgtccggggacccccgggnacggagggtccaccatcgtcttgtcgtggaactctacgttaccaatagtcggaancaatacgtagtaactcggtaccacctaacgttccgaacggaacccggtcccccaaagtccctactacttacgagtagaataactcgacggccggtccctacggaccggggttcccctacggaaccgtactttacgtcgtccggtacctaccgaacggttccgtacgcccgtaacctcgaccgttccccgtacccgtacggaccctagtaacccgtaggttacccggcctaccgtacggtcgtacgggagtagtcggtaacgtcttaggtaactttacgttacgtacggtgacgtacgactacggtgacgtagtacgtacgttcgtcccgttcgtacggtttcgggttcgggttttaacgggtcggttaccggggaccgggtaccgtaacggtaccgtcggtacccggtacccgttccggtacccgagtaacccccgg

SEQ ID NO: 136122 - DNA, 942 bp, Homo sapiens
  misc_feature: GYAE6OF02I1AQS.35.5.A05.1.454.CMB.1.raw
tcagtacagatcgtcacgaccggtgctcgatttagatagatagacagggggctctgcttcagctgtgagcgcagaaggcaggactcgggacaatcttcatcatgacctgcctccctctcctcctctacccttctcattccactgactacgacgggttccgtcgggacccctaatctcgttccttacgacgccacgccccgtccccttcgtacggttcggttccgtcggaccccgggaccccgaacgggaaccaaaccggtacggtacccaaccgtacttcccttccgttacgttccttaccgttcggaaccttttaccggttaagggttttggggtaacgtttaacggttttagttttcggttttaccgtttaccggtacctaccgtaccgtaaacccgttacccgtacgggtaccttacccgaaccccggttaaccccccgttaactttacccgttacctttaacgttttaaacgttaaccgtaaaacgttaaaacctttaaaaggttaaccccgtaccgggtaccccctttaaggttaaacggttaacccttttaccggttaaccgaaccgttttaccgttaccgtttccggtaccggtttcccgtacggttcggttaccgtcggtaccgtacggtaccctaccgtacccgtaacggtacgtaccgtaccgtaccggttaccgaccgtacgggtccggtacggggaccggacggttaccgttaacgttacgtaccgtaccggtcggaaaccgtggtaaccgtaccgtaacgtaacggttgtaccggttaggttacggttaaccgggttccgggttacccggtacggggtaacccgtcgacccggttaccgtaacccggttcgtaaacccggttaccgacggtaaccgtacccggtccgttaccggccccttaccggtaccggaccccttacggtccccgg

SEQ ID NO: 136123 - DNA, 1019 bp, Homo sapiens
  misc_feature: GYAE6OF02FRG82.35.5.A05.1.454.CMB.1.raw
tcagtacagatcgtcacgaccggtgctcgatttagatagatagacagggggctctgcttcagctgtgagcgcagaaggcaggacgtcgggacaatcttcatcatgacctgcctccctctcctcctctacccttctctacttcactgcacgacgggtccgtcggacccaatctgtctgaccgtcacgcccgccctcgtagtcgtctcggcccggaccccgaggaaccaaacgtacggttaacctattccgtcgttcgctcgtaggtacttaccgtaagggtttcgggaagtttagttagtttcggttttaccgttacggtaccgtaacgtaccgtaacccgttaccccgaagggtaccttacccggtaacccgtaaccccccttaaacgttttaccttaaccgtttaattttaaccgtaacggaaaaccttaaacgttaaaacgtaaccggtcccggtaccctaacggtaacggttaacctttaccgacgttaccgtacttccgtacggtcgtccgttacggtacggttccgtacggtacctacggttaccgtacccgacccgtaaccggtaacggggtaacccttacccgggtaaccccggaccgttaccccgggaagggttcccggggtaaaccgggggtaacccgtaaccgggggttaacccgtttaacggttttaaccgttacccgggtaccggtaacccggttaacccgggttaacggggttaaaccgggttaaaacccgttaaaaacgggttaacccgggttaaacgggttacgggttttaaccggggtttacggggttaaccccgggtttccggggtttaacccccggggggaccggggttaaacccggggtaaacccgttaaccgggtacccgggttacccgggtaacccgggtttaacccggtaaccggtaaccccggtaaccccggaacccgggttacccgggtcccgttaccccgggtcccccgggttaccgtaccccggtttaccccggttacccgtttccccccggg

SEQ ID NO: 136124 - DNA, 771 bp, Homo sapiens
  misc_feature: GYAE6OF02JEIQY.35.5.A05.1.454.CMB.1.raw
  modified_base (418)..(418): a, c, t, g, unknown or other
  misc_feature (418)..(418): n is a, c, g, or t
tcagtacagatcgtcacgaccggtgctcgatttagatagatagacagggggctctgcttcagctgtgagcgcagaaggcaggactcgggacaatcttcatcatgacctgcctcccctctcctcctcacccttctcattcactgcacgagggtcctcgggaccctaatcgtgttcttcggaccgcacgcccgccctcgtagtcgtcgtcggcccggaccccagggaccaacgacggtccaaccacttccttccttgcctgtacggactaccgtaagggtttgggacgttagtttattcgtttacgttcggtacctagacctacctaccgaggtactaccgaccgaccccctaacttctactattacactaactaataacgtaacggccgtcctagaacgttacttccgtacgtaacctntttcgtacgcggtcctacggtaggttcgcgtacctaccgtacgtacgaccctaccggtaggtaaccctaccggaaccggtaccgtaccggacgggtcggtacgggggaaccgtacggtaccgttaagttaccgtacggtaccgaccggtacgtaacgggacgggtaaactaaacggtacggttagtcggtttacgggttacggcggtttaccgggtaccgggaccggtaccggggtaaccctacgggtccgtaaccgggttaccggtaaccggtttaacgccggaacccggtacccggtaccgggtacccgttacccggtaccccgtaccggttacccgttacccgttcccgg

SEQ ID NO: 136125 - DNA, 414 bp, Homo sapiens
  misc_feature: GYAE6OF01DXEQM.47.19.B08.1.454.CMB.1.raw
  modified_base (410)..(414): a, c, t, g, unknown or other
  misc_feature (410)..(414): n is a, c, g, or t
tcagagctcacgtacacgaccggtgctcgatttagtgagtcagtaagggaaagagccaccctctcctgcagggccagtcagactgttaacttcaactacttagcctggtaccagcacaaacctggccaggctcccaggctcctcatctatggcgcatccagcagggccactggcatcccagacacgttcagtggcagtgggtctgggacagacttcactctcaccatcagcagactggagcctgaagattttgctagtttattactgtcagcaacgtaaatactggcctccgctcactttcggcggagggaccagggtgacagtgaaacgaactggtggctgcaccatctgtcttcatccttcccgctatctgatacgtgagctctgagcgggctggcaaggcgcatagnnnnn

SEQ ID NO: 136126 - DNA, 423 bp, Homo sapiens
  misc_feature: GYAE6OF01DUHIK.47.19.B08.1.454.CMB.1.raw
  modified_base (410)..(410): a, c, t, g, unknown or other
  misc_feature (410)..(410): n is a, c, g, or t
  modified_base (416)..(423): a, c, t, g, unknown or other
  misc_feature (416)..(423): n is a, c, g, or t
tcagagctcacgtacacgaccggtgctcgatttagtgagtcagtaagggaaagagccaccctctcctgcagggccagtcagaatattcactcctacttagcctggtaccaacagaaacctggtcaggctcccaggctcctcatctatgatgcatccaacagggccactggcatcccagacaggttcagtggcagtgggtctgggacagacttcactctcaccatcagcagcctagagcctgaagactttggacttttattactgtcagcagcgtgagttctggcctccgctccacgtttcggcggagggaccgagggtggagatacgaaacgacgtgtggctgcaccatctgtcttcatccttcccgcatctgtatacgtgacgcttctgacggcgggctggcaagggcncgatgnnnnnnnn

SEQ ID NO: 136127 - DNA, 415 bp, Homo sapiens
  misc_feature: GYAE6OF01CQ0BF.47.19.B08.1.454.CMB.1.raw
  modified_base (403)..(403): a, c, t, g, unknown or other
  misc_feature (403)..(403): n is a, c, g, or t
  modified_base (409)..(415): a, c, t, g, unknown or other
  misc_feature (409)..(415): n is a, c, g, or t
tcagagctcacgtacacgaccggtgctcgatttagtgagtcagtaagggaaagagccaccctctcctgcagggccagtcagactgttaacttcaactacttagcctggtaccaacagaaacctggtcaggctcccaggctcctcatctatgatgcatccaacagggccactggcatcccagacaggttcagtggcagtgggtctgggacagacttcactctcaccatcagcagcctagagcctgaagactttggactttattactgtcagcagcgtgagttctggcctccgctcactttcggcggtagggaccagggtcggagatacaaaacgactgtggctgcaccatctgtcttcatcttcccgcatctgatacgtgagctctgagcgggctggcaaggcncatagnnnnnnn

SEQ ID NO: 136128 - DNA, 542 bp, Homo sapiens
  misc_feature: GYAE6OF01A2IIV.47.19.B08.1.454.CMB.1.raw
  modified_base (526)..(542): a, c, t, g, unknown or other
  misc_feature (526)..(542): n is a, c, g, or t
tcagagctcacgtacacgaccggtgctcgatttagtgagtcagtaagggaaagagccaccctctcctgcagggccagtcagactgttaacttcaactacttagcctggtaccagcacaaacctggccaggctcccaggctcctcatctatggcgcatccagcagggccactggcatcccagacacgttcagtggcaggtgggtctgggacagacttcactctcaccatcagcagactggagcctgaagtattttgctagtgtattactgtcagtcagtataggaagtccctcccctaattccaccgttttccgggccccttaggggaccctaaaggggtcggtaattacggtaacgaaaaccggtaacgttggtcggtccttaggaccctaaccgtacttcgttacggttccctttacctacgtttccctttacccccggaccttacttcgttacgtaacgttaccggtgtaacgtccgtacgtggacggtccgggtcgtacgggcgaacgggccgacgagtaggnnnnnnnnnnnnnnnnn

SEQ ID NO: 136129 - DNA, 436 bp, Homo sapiens
  misc_feature: GYAE6OF01B8T0E.47.19.B08.1.454.CMB.1.raw
  modified_base (240)..(240): a, c, t, g, unknown or other
  misc_feature (240)..(240): n is a, c, g, or t
  modified_base (384)..(384): a, c, t, g, unknown or other
  misc_feature (384)..(384): n is a, c, g, or t
  modified_base (413)..(414): a, c, t, g, unknown or other
  misc_feature (413)..(414): n is a, c, g, or t
  modified_base (416)..(436): a, c, t, g, unknown or other
  misc_feature (416)..(436): n is a, c, g, or t
tcagagctcacgtacacgaccggtgctcgatttagtgagtcagtaagggaaagagccaccctctcctgcagggccagtcagactgttaacttcaactacttagcctggtaccagcacaaacctggccaggctcccaggctcctcatctatggcgcatccagcagggccactggcatcccagacacgttcagtggcagtgggtctgggacagacttcactctcaccatcagcagactggancctgaagtattttgcagtgtattactgtcagcagtatggaagcttccattcactttcggcctggaccaggtgatgtacaacgactgtgctgcacatctgtcttcacttccttcccgctacttctagtactacgtgacgtctcgngacggcggctgggcaagggcacgagtagnngnnnnnnnnnnnnnnnnnnnnn

SEQ ID NO: 136130 - DNA, 437 bp, Homo sapiens
  misc_feature: GYAE6OF01BDUTP.47.19.B08.1.454.CMB.1.raw
  modified_base (372)..(372): a, c, t, g, unknown or other
  misc_feature (372)..(372): n is a, c, g, or t
  modified_base (427)..(437): a, c, t, g, unknown or other
  misc_feature (427)..(437): n is a, c, g, or t
tcagagctcacgtacacgaccggtgctcgatttagtgagtcagtaagggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagacgcctgaagtatttttgctacttttattactgtcagcagcgtagcaactggcctctcactttcggcggagggaccgagggtggagatcgaggaacgaacgtggtggctgcacatctgtcttcactccttcccgctntctgatcgtgactctcgtgaggtccggggctgggactaacgggcgtaccagtagnnnnnnnnnnn

SEQ ID NO: 136131 - DNA, 696 bp, Homo sapiens
  misc_feature: GYAE6OF01D369B.47.19.B08.1.454.CMB.1.raw
  modified_base (130)..(130): a, c, t, g, unknown or other
  misc_feature (130)..(130): n is a, c, g, or t
  modified_base (188)..(188): a, c, t, g, unknown or other
  misc_feature (188)..(188): n is a, c, g, or t
tcagagctcacgtacacgaccggtgctcgatttagtgagtcagtaaggggcactcaacaaccacatctgtcctctagagaaaaccctgtgagcacagctcctcaccatggactggacctggaggatcctnttcttgggtgcagcagctacaagtcgacccactcccaggtgcagctggtgcgagtcgngggctaggaggtgaagacgccgtagggcctcgtaggtgtacgtcctcgtacgtacgacggttcttacgtacggtaactaccaaccttacctaaccaatttatcggtaattacgtacgtaacggttggggcgaaccgacgtcggaccctagggtacgaacggggttaagtcggtaaggtaggtaggtagtcggggtaatggttaaaccgtaaaccaacggtaaagttaaaacgaacaacggactaacgttagcctaacgaacggtaaggtttacccaaggggtaccgaagacgtacgaaccgtacgtaaccctacgaaccgaaccgtaccactaaaccctaacacgaccaaccgtacgtacgtaacggtacgtacgacgacgacgacgtacgacgtacgtacgtacgtacggtaccggacggtaccggtacggtacgttacgtacgtacggtcggtacggacggtacgtacgtacgtacgtacgtacggtacgtcggtcggtcggtacg

SEQ ID NO: 136132 - DNA, 666 bp, Homo sapiens
  misc_feature: GYAE6OF01DOZZZ.47.19.B08.1.454.CMB.1.raw
  modified_base (621)..(621): a, c, t, g, unknown or other
  misc_feature (621)..(621): n is a, c, g, or t
  modified_base (642)..(650): a, c, t, g, unknown or other
  misc_feature (642)..(650): n is a, c, g, or t
  modified_base (652)..(652): a, c, t, g, unknown or other
  misc_feature (652)..(652): n is a, c, g, or t
  modified_base (654)..(655): a, c, t, g, unknown or other
  misc_feature (654)..(655): n is a, c, g, or t
  modified_base (659)..(659): a, c, t, g, unknown or other
  misc_feature (659)..(659): n is a, c, g, or t
  modified_base (661)..(664): a, c, t, g, unknown or other
  misc_feature (661)..(664): n is a, c, g, or t
  modified_base (666)..(666): a, c, t, g, unknown or other
  misc_feature (666)..(666): n is a, c, g, or t
tcagagctcacgtacacgaccggtgctcgatttagtgagtcagtaagggaaagagccaccctctcctgcagggccagtcagactgttaacttcaactacttagcctggtaccagcacaaacctggccaggctcccaggctctcatctatgatgcatccaacgacgggccacgtggcactcccagccgtaggttcaggtggctaggtgacgtcgtgggactacgtccttcacctctaccaccatcaacgcacgtaccttagacgtcctagaaaacgtttgtttacgaccttaacgtttaacttaccgttgtacgtaacggcctacggttacggtaacgacctaacggtccggtaccctccggtcctacgttaccgggttttcggggaaccgggacggtaacggtaggggacgtaaagtactaaccggaaacgtacggtcggtaggtacccgtcggaaccctaaaccgttcgtttaaccgtcgtttacctaacgttaccgtttcccctacccggacttaccgttaggttaactaacgtttacgggtacacccgtttcgtaacggttacggaccggttcggcggtaccgggaacccgaggttacaaccgttagtacggacgtgnagtccaggtacttgaagtcgnnnnnnnnntncnnctcncnnnntn

SEQ ID NO: 136133 - DNA, 831 bp, Homo sapiens
  misc_feature: GYAE6OF01B532Q.47.19.B08.1.454.CMB.1.raw
  modified_base (172)..(172): a, c, t, g, unknown or other
  misc_feature (172)..(172): n is a, c, g, or t
tcagagctcacgtacacgaccggtgctcgatttagtgagtcagtaagggaaagagccaccctctcctgcagggccagtcagactgttaacttcaactacttagcctgaccagcacaacctggcaggctccaggctcctcatctatgatgacactaccaacgtacggctacgnggaccacttcccaaggtccgtaaggtttccaaggtcggacgaggtacgaggttcgtacgggactacggacctttaccacttccacctaccataccgacgtaccacgtacgtacgtacgccgttaagtaaacggttcttttagaacctttacttttacttaacgttctcgaaggtaccgtaaggtccgtaagtacctaacggttcggtaccctttacgacccggttaggttacccgggagggtaaccgggaaccgggttaggggtacgaacggtacgtaacggtaaccggtaaggaaccgtttgggtacgttaccggaaccggtaaccccgaaagggtttacctttcgggtaaccgttttaccggttacttaaccccgtacccggttttacccccagttaaccgtttacgttaacgttaacggttaacggacctttaaacggtccgttaaggacggggtaaccgggtacgggtaacccgggtttaacgaaaccgggttaccggggaaacttacccgggaaatttaaccggacgttacggaacggttcggaattaaggtccgaaacgtacgtacgtacgtacgtacgtaacggtaacacggtaacggtaacggacgtacgtacgaacgtacgtacgacgtacgtaccgtaacgtagtaacg

SEQ ID NO: 136134 - DNA, 554 bp, Homo sapiens
  misc_feature: GYAE6OF01B7XFV.47.19.B08.1.454.CMB.1.raw
  modified_base (157)..(157): a, c, t, g, unknown or other
  misc_feature (157)..(157): n is a, c, g, or t
  modified_base (527)..(554): a, c, t, g, unknown or other
  misc_feature (527)..(554): n is a, c, g, or t
tcagagctcacgtacacgaccggtgctcgatttagtgagtcagtaagggaaagagcccaccctctcctgcagggccagtcagactgttaacttcaactacttagcctggtaccagcaacaaacctggccaggcctcccaggctcctcatctatggcncatccagcagggccagtggcactcccagacacgttcagtggcaggtgggtctgggacagtacttcactctcaccatcagcagacgtggacgtccgtagaagtattttgctagttagttattactgtacagcaagttagtaggaacgtccctaccctattcctaccgtttccggccgtacgggaaccgtaagggtggtacgtacgtaacgaaaacgtaccgtggtaggtcctacggacaaccgtacttcgttacgttcttacctaccttcccgttaccccgacctagtttcctagtacgttaaccggtgtacgtcgttcgtagggaacgggtccgggtacggtcggaaccggtacggcttaacaggtaagnnnnnnnnnnnnnnnnnnnnnnnnnnnn

SEQ ID NO: 136135 - DNA, 408 bp, Homo sapiens
  misc_feature: GYAE6OF02G6EM8.47.19.B08.1.454.CMB.1.raw
  modified_base (241)..(241): a, c, t, g, unknown or other
  misc_feature (241)..(241): n is a, c, g, or t
  modified_base (400)..(408): a, c, t, g, unknown or other
  misc_feature (400)..(408): n is a, c, g, or t
tcagagctcacgtacacgaccggtgctcgatttagtgagtcagtaagggaaagagccgaccctctcctgcagggccagtcagactgttaacttcaactacttagcctggtaccagcacaaacctggccaggctcccagactcctcatctatggcgcatccagcagggccactggcatcccagacacgttcagtggcagtgggtctgggacagacttcactctcaccatcagcagactggancctgaagattttgcagtgtattactgtcagcagtatggaagctccccattcactttcggccctggaccaaggtgatgtcaaacgactgtggctgcacatctgtcttcatcttcccgcatctgatacgtgagctctgagcgggctggcaaggcgcatagnnnnnnnnn

SEQ ID NO: 136136 - DNA, 405 bp, Homo sapiens
  misc_feature: GYAE6OF02IFNIS.47.19.B08.1.454.CMB.1.raw
  modified_base (398)..(405): a, c, t, g, unknown or other
  misc_feature (398)..(405): n is a, c, g, or t
tcagagctcacgtacacgaccggtgctcgatttagtgagtcagtaagggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgcgtctgggacagagttcactctcaccatcaacagcctgcagtctgaagattttgctagtttattactgtcagcagtatcataactggccgctcaccttcggccaagggcacgactggagattaaacgactgtggctgcacatctgtcttcatcttcccgctatctgatacgtgagctctgagcgggctggcaaggcgcatgnnnnnnnn

SEQ ID NO: 136137 - DNA, 439 bp, Homo sapiens
  misc_feature: GYAE6OF02HTDID.47.19.B08.1.454.CMB.1.raw
  modified_base (410)..(410): a, c, t, g, unknown or other
  misc_feature (410)..(410): n is a, c, g, or t
  modified_base (423)..(423): a, c, t, g, unknown or other
  misc_feature (423)..(423): n is a, c, g, or t
  modified_base (430)..(439): a, c, t, g, unknown or other
  misc_feature (430)..(439): n is a, c, g, or t
tcagagctcacgtacacgaccggtgctcgatttagtgagtcagtaagggaaagagccaccctctcctgcagggccagtcagagtgttaacaactacttagcctggtaccaacagagacctggccaggctcccaggctcctcatctatgatgtatccaacagggccactggcaccccagtcaggttcagtggcagtgggtctgggacagacttcactctcaccatcagcagcctagacgcctgaagtattttgctaattttaattactgtcaccagcgtgccaacgtggccttaatacttcctaccttttcggccctgggaccaaaggtggaaatcaaaacgaactgtggctgcacatctgtcttcacttcctcccgcctatcctgaatacgtgagtctcgtgagccgggntgggacaagggcnaagtagnnnnnnnnnn

SEQ ID NO: 136138 - DNA, 482 bp, Homo sapiens
  misc_feature: GYAE6OF02J27NH.47.19.B08.1.454.CMB.1.raw
  modified_base (285)..(285): a, c, t, g, unknown or other
  misc_feature (285)..(285): n is a, c, g, or t
  modified_base (301)..(301): a, c, t, g, unknown or other
  misc_feature (301)..(301): n is a, c, g, or t
  modified_base (417)..(417): a, c, t, g, unknown or other
  misc_feature (417)..(417): n is a, c, g, or t
  modified_base (444)..(444): a, c, t, g, unknown or other
  misc_feature (444)..(444): n is a, c, g, or t
  modified_base (448)..(448): a, c, t, g, unknown or other
  misc_feature (448)..(448): n is a, c, g, or t
  modified_base (452)..(482): a, c, t, g, unknown or other
  misc_feature (452)..(482): n is a, c, g, or t
tcagagctcacgtacacgaccggtgctcgatttagtgagtcagtaagggaagagccaccctctcctgcagggccagtcagactgttaacttcaactacttagcctggtaccagcacaaacctggccaggctcccaggcctcctcatctatggcgcatccagcagggccactggcatcccagacacgttcagtggcagtgggtctgggacagacttcactctcaccatcagcagacctggagcctagaagatttttgcctaaactttattactagtacaaaaaatntaacagtcgccccgtntcgtacgtttcgggcggagggaccaagggtcgagtactacgaaacgtacgtgtcgctgaccacgatctcgttcttcacttcctcccgactactctagactacgtgacgtcttacgnggacggtcggtcgtggacgacggcgtntaancgtnnnnnnnnnnnnnnnnnnnnnnnnnnnnnnn

SEQ ID NO: 136139 - DNA, 446 bp, Homo sapiens
  misc_feature: GYAE6OF02G81S2.47.19.B08.1.454.CMB.1.raw
  modified_base (240)..(240): a, c, t, g, unknown or other
  misc_feature (240)..(240): n is a, c, g, or t
  modified_base (347)..(347): a, c, t, g, unknown or other
  misc_feature (347)..(347): n is a, c, g, or t
  modified_base (418)..(420): a, c, t, g, unknown or other
  misc_feature (418)..(420): n is a, c, g, or t
  modified_base (422)..(446): a, c, t, g, unknown or other
  misc_feature (422)..(446): n is a, c, g, or t
tcagagctcacgtacacgaccggtgctcgatttagtgagtcagtaagggaaagagccaccctctcctgcagggccagtcagactgttaacttcaactacttagcctggtaccagcacaaacctggccaggctcccaggctcctcatctatgatgcatccaacagggccactggcatcccagacaggttcagtggcagtgggtctgggacagacttcactctcaccatcagcagcctagancctgaagactttgcagtttattactgtcagcaacgtaatactggcctccgctcactttcggcggagggaccagggtgacagtgaaacgactgtggctgcaccatctntcttcattccttcccgcacttctgacttacgtgacgctcgtgaggcgggctggcgaacgggcgacagtagnnngnnnnnnnnnnnnnnnnnnnnnnnnn

SEQ ID NO: 136140 - DNA, 419 bp, Homo sapiens
  misc_feature: GYAE6OF02FZ622.47.19.B08.1.454.CMB.1.raw
  modified_base (240)..(240): a, c, t, g, unknown or other
  misc_feature (240)..(240): n is a, c, g, or t
  modified_base (361)..(361): a, c, t, g, unknown or other
  misc_feature (361)..(361): n is a, c, g, or t
  modified_base (373)..(373): a, c, t, g, unknown or other
  misc_feature (373)..(373): n is a, c, g, or t
  modified_base (398)..(398): a, c, t, g, unknown or other
  misc_feature (398)..(398): n is a, c, g, or t
  modified_base (404)..(419): a, c, t, g, unknown or other
  misc_feature (404)..(419): n is a, c, g, or t
tcagagctcacgtacacgaccggtgctcgatttagtgagtcagtaagggaaagagccaccctctcctgcagggccagtcagactgttaacttcaactacttagcctggtaccagcacaaacctggccaggctcccaggctcctcatctatggcgcatccagcagggccactggcatcccagacacgttcagtggcagtgggtctgggacagacttcactctcaccatcagcagactggancctgaagattttgcagtgtattactgtcagcagtatggaagctcccattcactttcgccctgggaccaaggtgatgtacaaacgaacgtgtgtctgcaccatctgtctcatccttcccgcnctctgactcgtnagctctgagcgggctggcacggcgnagtagnnnnnnnnnnnnnnnn

SEQ ID NO: 136141 - DNA, 447 bp, Homo sapiens
  misc_feature: GYAE6OF02GFNXZ.47.19.B08.1.454.CMB.1.raw
  modified_base (278)..(278): a, c, t, g, unknown or other
  misc_feature (278)..(278): n is a, c, g, or t
  modified_base (372)..(372): a, c, t, g, unknown or other
  misc_feature (372)..(372): n is a, c, g, or t
  modified_base (424)..(447): a, c, t, g, unknown or other
  misc_feature (424)..(447): n is a, c, g, or t
tcagagctcacgtacacgaccggtgctcgatttagtgagtcagtaagggaaagagccaccctctcctgcagggccagtcagactgttaacttcaactacttagcctggtaccagcacaaacctggccaggctcccaggctcctcatctatggcgcatccagcagggccactggcatcccagacacgttcagtggcagtgggtctgggacagacttcactctcaccatcagcagactggagcctgaagattttgctagtgttattactgtcagcagtanggacgctcccattcacgtttccggcctgggaccaaggtggatcgtacaaacgactgtaggctgcacctatctgtcttcacttccttcccgcctntcctgacttcgtgacgtctcgtgacggcgggtctcggcgaaggctacagtgnnnnnnnnnnnnnnnnnnnnnnnn

SEQ ID NO: 136142 - DNA, 471 bp, Homo sapiens
  misc_feature: GYAE6OF02FPNJB.47.19.B08.1.454.CMB.1.raw
  modified_base (239)..(239): a, c, t, g, unknown or other
  misc_feature (239)..(239): n is a, c, g, or t
  modified_base (372)..(372): a, c, t, g, unknown or other
  misc_feature (372)..(372): n is a, c, g, or t
  modified_base (438)..(438): a, c, t, g, unknown or other
  misc_feature (438)..(438): n is a, c, g, or t
  modified_base (442)..(471): a, c, t, g, unknown or other
  misc_feature (442)..(471): n is a, c, g, or t
tcagagctcacgtacacgaccggtgctcgatttagtgagtcagtaagggaaagagccaccctctcctgcagggccagtcagactgttaacttcaactacttagcctggtaccagcacaaacctggccaggctcccaggctcctcatctatggcgcatccagcagggccactggcatcccagacacgttcagtggcagtgggtctgggacagacttcactctcacatcagcagactggancctgaagattttgctagtgtattactgtcagcagtatggaagctccccattcactttcggcctggacctaaggtgatgtacaaacgactgtggctgacacctatcgtcgtcttactacttccttcccgacctntcgtacgtaactacggtgtaacgtcgtctgggacggtcggggctaggcgttaaggccgcgaatcgntcgnnnnnnnnnnnnnnnnnnnnnnnnnnnnnn

SEQ ID NO: 136143 - DNA, 548 bp, Homo sapiens
  misc_feature: GYAE6OF02HIIP7.47.19.B08.1.454.CMB.1.raw
  modified_base (154)..(154): a, c, t, g, unknown or other
  misc_feature (154)..(154): n is a, c, g, or t
  modified_base (239)..(239): a, c, t, g, unknown or other
  misc_feature (239)..(239): n is a, c, g, or t
  modified_base (244)..(244): a, c, t, g, unknown or other
  misc_feature (244)..(244): n is a, c, g, or t
  modified_base (276)..(276): a, c, t, g, unknown or other
  misc_feature (276)..(276): n is a, c, g, or t
  modified_base (508)..(508): a, c, t, g, unknown or other
  misc_feature (508)..(508): n is a, c, g, or t
  modified_base (512)..(513): a, c, t, g, unknown or other
  misc_feature (512)..(513): n is a, c, g, or t
  modified_base (517)..(519): a, c, t, g, unknown or other
  misc_feature (517)..(519): n is a, c, g, or t
  modified_base (522)..(529): a, c, t, g, unknown or other
  misc_feature (522)..(529): n is a, c, g, or t
  modified_base (531)..(531): a, c, t, g, unknown or other
  misc_feature (531)..(531): n is a, c, g, or t
  modified_base (533)..(536): a, c, t, g, unknown or other
  misc_feature (533)..(536): n is a, c, g, or t
  modified_base (538)..(538): a, c, t, g, unknown or other
  misc_feature (538)..(538): n is a, c, g, or t
  modified_base (541)..(542): a, c, t, g, unknown or other
  misc_feature (541)..(542): n is a, c, g, or t
  modified_base (544)..(548): a, c, t, g, unknown or other
  misc_feature (544)..(548): n is a, c, g, or t
tcagagctcacgtacacgaccggtgctcgatttagtgagtcagtaagggaaagagccaccctctcctgcagggccagtcagactgttaacttcaactacttagcctggtaccagcacaaacctggccaggctcccaggctcctcatctatggcncatccagcgagggccacgtggcatcccagaccacgttcagtgcagtgggtctgggacagtacttcactctcacatcagcagacgnggacnctagaagtattttgactaatttattactgtanagctaagtaataaatacgtcggcctcgtacgttccgaccgaaggacgaacgtaagtaggaacgtaacttaaaacgaacgttggtagtaccgtacgacctaacctacttccgttacttccgtttaccgtagtttccccgtttcccgaacctgtaccgttacgtaagttacgtaacgtgtacctcggtggacggcgggtacgtcgggacgtaccggtacgacgtagtagcgtancagnngtgnnnagnnnnnnnngngnnnntngcnngnnnnn

SEQ ID NO: 136144 - DNA, 675 bp, Homo sapiens
  misc_feature: GYAE6OF02FMRLD.47.19.B08.1.454.CMB.1.raw
  modified_base (612)..(612): a, c, t, g, unknown or other
  misc_feature (612)..(612): n is a, c, g, or t
  modified_base (631)..(631): a, c, t, g, unknown or other
  misc_feature (631)..(631): n is a, c, g, or t
  modified_base (634)..(634): a, c, t, g, unknown or other
  misc_feature (634)..(634): n is a, c, g, or t
  modified_base (643)..(643): a, c, t, g, unknown or other
  misc_feature (643)..(643): n is a, c, g, or t
  modified_base (665)..(665): a, c, t, g, unknown or other
  misc_feature (665)..(665): n is a, c, g, or t
tcagagctcacgtacacgaccggtgctcgatttagtgagtcagtaagggaaagagccaccctctcctgcagggccagtcagactgttaacttcaactacttagcctggtaccagcacaaacctggccaggctcccaggctcctcatctatggcgcatccagcagggccactggcatccccagacacgttcagtggcaggtgggtctgggacagacttcactctcaccatcagcagactcggagcctggaaagtatttttgactaggtgttaacgtttactggtacaagtccaagttagtagggaacggtcccttccccctaatttcccgtaacctttttcccggggccccctttacgggggaacccctaaaggggttcgggtaacttcggtaaccaaaaacggtaaccgtggtacgggtcttacggacctaacctacgttccgttcgtaccgttttacaacgttttccctttccccggacctaattccgtttacggtaacgttaccggttgaacggtcctttaccgttcgggtaacggtcccggggggtactacggggtacctaaaaggggtccctaacgtaacggttacggcgtacgtgcgtactggtccngttagactgggacacggtncgngagtagcgntacgtcacgcgtacgtacgagngagtctagag

SEQ ID NO: 136145 - DNA, 511 bp, Homo sapiens
  misc_feature: GYAE6OF02JYRPE.47.19.B08.1.454.CMB.1.raw
  modified_base (149)..(149): a, c, t, g, unknown or other
  misc_feature (149)..(149): n is a, c, g, or t
  modified_base (205)..(205): a, c, t, g, unknown or other
  misc_feature (205)..(205): n is a, c, g, or t
  modified_base (216)..(216): a, c, t, g, unknown or other
  misc_feature (216)..(216): n is a, c, g, or t
  modified_base (247)..(247): a, c, t, g, unknown or other
  misc_feature (247)..(247): n is a, c, g, or t
  modified_base (373)..(373): a, c, t, g, unknown or other
  misc_feature (373)..(373): n is a, c, g, or t
  modified_base (462)..(462): a, c, t, g, unknown or other
  misc_feature (462)..(462): n is a, c, g, or t
  modified_base (471)..(471): a, c, t, g, unknown or other
  misc_feature (471)..(471): n is a, c, g, or t
  modified_base (473)..(473): a, c, t, g, unknown or other
  misc_feature (473)..(473): n is a, c, g, or t
  modified_base (476)..(479): a, c, t, g, unknown or other
  misc_feature (476)..(479): n is a, c, g, or t
  modified_base (481)..(484): a, c, t, g, unknown or other
  misc_feature (481)..(484): n is a, c, g, or t
  modified_base (486)..(486): a, c, t, g, unknown or other
  misc_feature (486)..(486): n is a, c, g, or t
  modified_base (488)..(488): a, c, t, g, unknown or other
  misc_feature (488)..(488): n is a, c, g, or t
  modified_base (490)..(493): a, c, t, g, unknown or other
  misc_feature (490)..(493): n is a, c, g, or t
  modified_base (495)..(495): a, c, t, g, unknown or other
  misc_feature (495)..(495): n is a, c, g, or t
  modified_base (497)..(499): a, c, t, g, unknown or other
  misc_feature (497)..(499): n is a, c, g, or t
  modified_base (501)..(502): a, c, t, g, unknown or other
  misc_feature (501)..(502): n is a, c, g, or t
  modified_base (504)..(507): a, c, t, g, unknown or other
  misc_feature (504)..(507): n is a, c, g, or t
  modified_base (510)..(511): a, c, t, g, unknown or other
  misc_feature (510)..(511): n is a, c, g, or t
tcagagctcacgtacacgaccggtgctcgatttagtgagtcagtaagggaaagagccaccctctcctgcagggccagtcagactgttaacttcaactacttagcctggtaccagcacaaacctggccaggctcccagctcctcatctanggcgcatccagcagggccacgtggcatcccagacacgttcagtgcagtggctggangacttcactcncaccagtcacgcagacgtgacgctagaattntttgctagtttactcgtgtacagactaagtaaactcgtggaccctccgcttcgtacgttcggacggagggtaccagggtcgactaagtacgaaacctagtgtacgactcgaccactacgtctcgtntccgtacttcccgtaaccggcctaacgtcttcgtaaacgtcgtacgtacctgtccgtaggtacggcggcgtacggacgtacggaccgtntacgtagcngntcnnnngnnnntngngnnnngncnnngnncnnnngtnn

SEQ ID NO: 136146 - DNA, 460 bp, Homo sapiens
  misc_feature: GYAE6OF02GE7RX.47.19.B08.1.454.CMB.1.raw
  modified_base (154)..(154): a, c, t, g, unknown or other
  misc_feature (154)..(154): n is a, c, g, or t
  modified_base (283)..(283): a, c, t, g, unknown or other
  misc_feature (283)..(283): n is a, c, g, or t
  modified_base (368)..(368): a, c, t, g, unknown or other
  misc_feature (368)..(368): n is a, c, g, or t
  modified_base (387)..(387): a, c, t, g, unknown or other
  misc_feature (387)..(387): n is a, c, g, or t
  modified_base (395)..(395): a, c, t, g, unknown or other
  misc_feature (395)..(395): n is a, c, g, or t
  modified_base (434)..(437): a, c, t, g, unknown or other
  misc_feature (434)..(437): n is a, c, g, or t
  modified_base (440)..(460): a, c, t, g, unknown or other
  misc_feature (440)..(460): n is a, c, g, or t
tcagagctcacgtacacgaccggtgctcgatttagtgagtcagtaagggaaagagccaccctctcctgcagggccagtcagactgttaacttcaactacttagcctggtaccagcacaaacctggccaggctcccaggctcctcatctatggcncatccagcagggccactggcatcccagacacgttcagtggcaggtgggtctggggacagactttcactctcaccatccagcagactggagcctgaagtattttgctagtgttattactgtctagcagtntaggacgcctacccattcctacgtttccggcctcgggacctaaggtgatgtacaaacgtactgtggctcgcacgatctgttctcncttccttcccgctctcgtntactcgtngtcctcgtggcggtcggtagtcggacgaggcgcaagtannnnacnnnnnnnnnnnnnnnnnnnnn

SEQ ID NO: 136147 - DNA, 659 bp, Homo sapiens
  misc_feature: GYAE6OF02JBIXI.47.19.B08.1.454.CMB.1.raw
  modified_base (205)..(205): a, c, t, g, unknown or other
  misc_feature (205)..(205): n is a, c, g, or t
  modified_base (620)..(621): a, c, t, g, unknown or other
  misc_feature (620)..(621): n is a, c, g, or t
  modified_base (623)..(623): a, c, t, g, unknown or other
  misc_feature (623)..(623): n is a, c, g, or t
  modified_base (633)..(634): a, c, t, g, unknown or other
  misc_feature (633)..(634): n is a, c, g, or t
  modified_base (636)..(636): a, c, t, g, unknown or other
  misc_feature (636)..(636): n is a, c, g, or t
  modified_base (638)..(638): a, c, t, g, unknown or other
  misc_feature (638)..(638): n is a, c, g, or t
  modified_base (642)..(642): a, c, t, g, unknown or other
  misc_feature (642)..(642): n is a, c, g, or t
  modified_base (644)..(645): a, c, t, g, unknown or other
  misc_feature (644)..(645): n is a, c, g, or t
  modified_base (647)..(649): a, c, t, g, unknown or other
  misc_feature (647)..(649): n is a, c, g, or t
  modified_base (651)..(651): a, c, t, g, unknown or other
  misc_feature (651)..(651): n is a, c, g, or t
  modified_base (653)..(658): a, c, t, g, unknown or other
  misc_feature (653)..(658): n is a, c, g, or t
tcagagctcacgtacacgaccggtgctcgatttagtgagtcagtaagggaaagagccaccctctcctgcagggccagtcagactgttaacttcaactacttagcctggtaccagcacaaacctggccaggctcccaggcctcctcatctgggatgcatccaacagggccgctggcactcccagccaggttcaggtgcagtggtcngggacagacttcactctcaccatcagcacgcctagcgcctagtaagtattttgacttactttacttacgtcgtacagcagacgtacacgaacgtcggaccttcgtaccgtacggtttaccgggacgggtaacgggaccgtaggggtaggaacgagtaccgaagggaacgtaacgttgggttaccggacgttaccggacctaaccgttacgttaccgttaccgttacccgtttactaaccgtttccccgttcccccggtaaccttaaccgttttaccggttacgttaaaccggtttacccggggttaggtaaccgtttcccgttacggttaacggggacccgggtccgggggttaccggtacggggaaaccggtaaccgggccggaacgttaacgtacgggtcacggagcttcganngngctcgtaganncnanacgnanncnnncncnnnnnnc

SEQ ID NO: 136148 - DNA, 698 bp, Homo sapiens
  misc_feature: GYAE6OF02I2T5P.47.19.B08.1.454.CMB.1.raw
  modified_base (273)..(273): a, c, t, g, unknown or other
  misc_feature (273)..(273): n is a, c, g, or t
  modified_base (581)..(581): a, c, t, g, unknown or other
  misc_feature (581)..(581): n is a, c, g, or t
tcagagctcacgtacacgaccggtgctcgatttagtgagtcagtaaggggcactcaacaaccacatctgtcctctagagaaaaccctgtgagcacagctcctcaccatggactggacctggaggatcctcttcttggtggcagcagctacaagtgcccactcccaggtgcagctggtgacagtcgtgggctgaggtgaagagccgtgggctcgagtagacggtctacctgacaaggtcttacgtgtactactaccttaccaactaacgtttangtaatactaccgacgtaggtcgcgaacgacggcctacggtacggaacggacgggtcgttaggacggtaggggtagtacggggtagttaggagttaccgtaaaaccctaacggtaaagtaaacctaaacgaacgtacggtacttagacgtaccgaactacggtaaagttaccggacgggacctaggtaacgtcccgttaaccgttacgggaaaccgaaccggaactaacccgtaccaaacccttacaaccgtccccgtactaaaggacgtacggcgacgtacgcggtaacacgtacgttcgaatacgtnaacccgggttaaggaaccctccggggtatttacggttacgttgtaccggtggaccgggacggtaagtaccgttagtacttaacggtccggtataaccggggtccggtataaccgggg

SEQ ID NO: 136149 - DNA, 836 bp, Homo sapiens
  misc_feature: GYAE6OF02HUV29.47.19.B08.1.454.CMB.1.raw
  modified_base (152)..(152): a, c, t, g, unknown or other
  misc_feature (152)..(152): n is a, c, g, or t
  modified_base (778)..(778): a, c, t, g, unknown or other
  misc_feature (778)..(778): n is a, c, g, or t
tcagagctcacgtacacgaccggtgctcgatttagtgagtcagtaagggaaagagccaccctctcctgcaggccagtcagactgttaacttcaactacttagcctggtaccagcacaacctggccaggctcccaggctctcatctatcggcncatccagcagggccacgtggcatcccagacctacgttcaggtcggactagggtcgggtacgttaggggactaacggacctttacaccttctacccaacctacgtccgaacggaccgtacggtaaccgtaggggtaccgtacccggttaggaaaacgttagtttttacgggacgttacggttaacggttaactttaccgttacggtaaccgtaacggtacggtaaacggttaacggtaacgggtaaaccgtccccggttaacccccttaagttacccgttaaccggttttaccccggaccccggtttaccggggaaaccgttaaacggggtacggttaacgtcggttaaaccgaaaaaccggttacggtacggtttacggtaccggtacgtccgttaaaccgacgtttacgttcgtaccgttccttacggttcccgtacccggttactacggttccttagtaaccgttacgtacgggaacctccgtacgttacgacgggtccgggtacgttaccgggaccgtaacgggtccgtaccgtaggtactacggacctagtaacgttccgaacggtacgttccggacctacctaggtcccgtaaggttccctaagccgtagtaccggttaancggacggtaccgtaaggtccaaccggtagttacacgttacgggtaccttagggtaacg

SEQ ID NO: 136150 - DNA, 305 bp, Homo sapiens
  misc_feature: GYAE6OF01ANUSR.13.20.B09.1.454.CMB.1.raw
  modified_base (303)..(305): a, c, t, g, unknown or other
  misc_feature (303)..(305): n is a, c, g, or t
tcagtcacgtactacacgaccggtgctcgatttagtgtagtgtgaaggggccttcaggggtcccagaccgattctctggctccagctcaggaaacacagcttccttgaccatcactggggctcaggcggaagatgaggctgactattactgcaactcccgggacagcagtggtaaacatttcaatgtgttattcggcggagggaccaagctgaccgtcctcggtcagcccaaggctgccccctcggtcactctgttcccacctcctctagtacgtgactgagcgggctggcaaggcgcatagnnn

SEQ ID NO: 136151 - DNA, 310 bp, Homo sapiens
  misc_feature: GYAE6OF01DDKVT.13.20.B09.1.454.CMB.1.raw
  modified_base (306)..(310): a, c, t, g, unknown or other
  misc_feature (306)..(310): n is a, c, g, or t
tcagtcacgtactacacgaccggtgctcgatttagtgtagtgtgaaggggccttcaggggtcccagaccgattctctggctccagctcaggaaacacagcttccttgaccatcactggggctcaggcggaagatgaggctgactattactgcaactcccgggacagcagtggtaaacatttcaatgtgttaattcggcggagggaccaagctgaccgtcctcggtcagcccaaggcctgccccctcggtcactctgttcccgccctcctctagtacgtgactgagcgggctggcaaggcgcatagnnnnn

SEQ ID NO: 136152 - DNA, 310 bp, Homo sapiens
  misc_feature: GYAE6OF01DS3UA.13.20.B09.1.454.CMB.1.raw
  modified_base (304)..(310): a, c, t, g, unknown or other
  misc_feature (304)..(310): n is a, c, g, or t
tcagtcacgtactacacgaccggtgctcgatttagtgtagtgtgaagggggccttcaggggtcccagaccgattctctggctccagctcaggaaacacagcttccttgaccatcactggggctcaggcggaagatgaggctgactattactgcaactcccgggacagcagtggtaaacatttcaatgtgttattcggcggagggaccaagctgaccgtcctcggtcagcccaaggctgccccctcggtcactctgttcccgcctcctctagtacgtgactgagcgggctggcaaggcgcatagnnnnnnn

SEQ ID NO: 136153 - DNA, 309 bp, Homo sapiens
  misc_feature: GYAE6OF02HUB09.13.20.B09.1.454.CMB.1.raw
  modified_base (304)..(309): a, c, t, g, unknown or other
  misc_feature (304)..(309): n is a, c, g, or t
tcagtcacgtactacacgaccggtgctcgatttagtgtagtgtgaagggggccttcaggggtcccagaccgattctctggctccagctcaggaaacacagcttccttgaccatcactggggctcaggcggaagatgaggctgactattactgcaactcccgggacagcagtggtaaacatttcaatgtgttattcggcggagggaccaagctgaccgtcctcggtcagcccaaggctgccccctggtcactctgttcccaccctcctctagtacgtgactgagcgggctggcaaggcgcatagnnnnnn

SEQ ID NO: 136154 - DNA, 304 bp, Homo sapiens
  misc_feature: GYAE6OF02F46Q6.13.20.B09.1.454.CMB.1.raw
  modified_base (293)..(293): a, c, t, g, unknown or other
  misc_feature (293)..(293): n is a, c, g, or t
  modified_base (299)..(304): a, c, t, g, unknown or other
  misc_feature (299)..(304): n is a, c, g, or t
tcagtcacgtactacacgaccggtgctcgatttagtgtagtgtgaagggggccttcaggggtcccagaccgattctctggctccaagtctggcacctcagcctccctggccatcagtgggctccggtccgaggatgaggctgattattactgtgcagcatgggatgacagcctgagtggtccggtgttcggcggagggaccaagctgaccgtcctaggtcagcccaaggctgccccctggtcactctgttccccgccctcctctagtacgtgactgagcgggctggcaaggcncatagnnnnnn

SEQ ID NO: 136155 - DNA, 221 bp, Homo sapiens
  misc_feature: GYAE6OF01AR4O7.25.25.C03.1.454.CMB.1.raw
  modified_base (218)..(221): a, c, t, g, unknown or other
  misc_feature (218)..(221): n is a, c, g, or t
tcagactgtacagtcacgaccggtgctcgatttagtagtgtagatttgggtttgggccggggcaccctggtcacggtctcgtcagcttccaccaagggcccatcggtcttcccctggcgccctgctccaggagcacctctggggcacagcggccctgggctgcctggtcaaggactacttccactgtacagtctgagcgggctggcaaggcgcatagnnnn

SEQ ID NO: 136156 - DNA, 218 bp, Homo sapiens
  misc_feature: GYAE6OF01CAUSY.25.25.C03.1.454.CMB.1.raw
  modified_base (217)..(218): a, c, t, g, unknown or other
  misc_feature (217)..(218): n is a, c, g, or t
tcagactgtacagtcacgaccggtgctcgatttagtagtgtagatttgggtttgggccgggcaccctggtcacggtctcgtcagcttccaccaagggcccatcggtcttcccctggcgccctgctccaggagcacctctggggcacagcggccctgggctgcctggtcaaggactacttccactgtacagtctgagcgggctggcaaggcgcatagnn

SEQ ID NO: 136157 - DNA, 303 bp, Homo sapiens
  misc_feature: GYAE6OF01B5JHY.25.25.C03.1.454.CMB.1.raw
  modified_base (268)..(268): a, c, t, g, unknown or other
  misc_feature (268)..(268): n is a, c, g, or t
  modified_base (284)..(303): a, c, t, g, unknown or other
  misc_feature (284)..(303): n is a, c, g, or t
tcagactgtacagtcacgaccggtgctcgatttagtagtgtagatttgggtttgggtcccatcgaaggttcagcggcagtggatcgtgggacagaattcactctcaccatcaacagtctgcagcctgatgattttgcaacttattactgccaacactatcttagttatccggtcagttttggccaggggaccaagctggagatcaaacgactgtggctgcaccatctgtcttcatcttccgcatctgaactgtacagtctgagcgggntggcaaggcgcatagnnnnnnnnnnnnnnnnnnnn

SEQ ID NO: 136158 - DNA, 161 bp, Homo sapiens
  misc_feature: GYAE6OF01CM2ZK.25.25.C03.1.454.CMB.1.raw
  modified_base (161)..(161): a, c, t, g, unknown or other
  misc_feature (161)..(161): n is a, c, g, or t
tcagactgtacagtcacgaccggtgctcgatttagtagtgtagatttgggtttgggccctgggacgagagtggatatcatacgaactgtggctgcaccatctgtcttcatcttcccgccatctgaactgtacagtctgagcgggctggcaaggcgcatagn

SEQ ID NO: 136159 - DNA, 156 bp, Homo sapiens
  misc_feature: GYAE6OF01B2SJH.25.25.C03.1.454.CMB.1.raw
  modified_base (154)..(156): a, c, t, g, unknown or other
  misc_feature (154)..(156): n is a, c, g, or t
tcagactgtacagtcacgaccggtgctcgatttagtagtgtagatttgggtttgggacgagagtggatatcatacgaactgtggctgcaccatctgtcttcatcttcccgccatctgaactgtacagtctgagcgggctggcaaggcgcatagnnn

SEQ ID NO: 136160 - DNA, 290 bp, Homo sapiens
  misc_feature: GYAE6OF01A9EBF.25.25.C03.1.454.CMB.1.raw
  modified_base (286)..(290): a, c, t, g, unknown or other
  misc_feature (286)..(290): n is a, c, g, or t
tcagactgtacagtcacgaccggtgctcgatttagtagtgtagatttgggtttggggtcccatcaaggttcagcggcagtggatctgggacagaattcactctcaccatcaacagtctgcagcctgatgattttgcaacttattactgtcaaaaatttgacagtgacccgtggatgttcggcccagggaccaaggtggacatcaaacgaactgtggctgcaccatctgtcttcatcttcccgccatctgaactgtacagtctgagcgggctggcaaggcgcatagnnnnn

SEQ ID NO: 136161 - DNA, 171 bp, Homo sapiens
  misc_feature: GYAE6OF01BXYK0.25.25.C03.1.454.CMB.1.raw
  modified_base (161)..(171): a, c, t, g, unknown or other
  misc_feature (161)..(171): n is a, c, g, or t
tcagactgtacagtcacgaccggtgctcgatttagtagtgtagatttgggtttgggccctgggacgagagtggatatcatacgaactgtggctgcaccatctgtcttcatcttcccgccatctgaactgtacagtctgagcgggctggcaaggcgcatagnnnnnnnnnnn

SEQ ID NO: 136162 - DNA, 260 bp, Homo sapiens
  misc_feature: GYAE6OF01DB546.25.25.C03.1.454.CMB.1.raw
  modified_base (195)..(195): a, c, t, g, unknown or other
  misc_feature (195)..(195): n is a, c, g, or t
  modified_base (223)..(260): a, c, t, g, unknown or other
  misc_feature (223)..(260): n is a, c, g, or t
tcagactgtacagtcacgaccggtgctcgatttagtagtgtagatttgggtttgggccggggcaccctggtcacggtctcgtcagcttccaccgaacgggcccatcggtcttccccctgggcgccctgctccaggagcacctctggggcacagcggccctgggctgcctggtcaaggactacttccactgtaccngtctgagcgggctggcaaggcgcatagnnnnnnnnnnnnnnnnnnnnnnnnnnnnnnnnnnnnnn

SEQ ID NO: 136163 - DNA, 222 bp, Homo sapiens
  misc_feature: GYAE6OF01D6P1Q.25.25.C03.1.454.CMB.1.raw
  modified_base (221)..(222): a, c, t, g, unknown or other
  misc_feature (221)..(222): n is a, c, g, or t
tcagactgtacagtcacgaccggtgctcgatttagtagtgtagatttgggtttggggccggggcaccctggtcacggtctcgtcagcttccaccaagggcccatcggtcttccccctggcgccctgctccaggagcacctctgggggcacagcggccctgggctgcctggtcaaggactacttccactgtacagtctgagcgggctggcaaggcgcatagnn

SEQ ID NO: 136164 - DNA, 174 bp, Homo sapiens
  misc_feature: GYAE6OF01BZ0U6.25.25.C03.1.454.CMB.1.raw
  modified_base (160)..(174): a, c, t, g, unknown or other
  misc_feature (160)..(174): n is a, c, g, or t
tcagactgtacagtcacgaccggtgctcgatttagtagtgtagatttgggtttgggccctgggacgagagtggatatcatacgaactgtggctgcaccatctgtcttcatcttcccgccatctgaactgtacagtctgagcggctggcaaggcgcatagnnnnnnnnnnnnnnn

SEQ ID NO: 136165 - DNA, 175 bp, Homo sapiens
  misc_feature: GYAE6OF01BYP8G.25.25.C03.1.454.CMB.1.raw
  modified_base (161)..(175): a, c, t, g, unknown or other
  misc_feature (161)..(175): n is a, c, g, or t
tcagactgtacagtcacgaccggtgctcgatttagtagtgtagatttgggtttgggccctgggacgagagtggatatcatacgaactgtggctgcaccatctgtcttcatcttcccgccatctgaactgtacagtctgagcgggctggcaaggcgcatagnnnnnnnnnnnnnnn

SEQ ID NO: 136166 - DNA, 220 bp, Homo sapiens
  misc_feature: GYAE6OF01EHEWV.25.25.C03.1.454.CMB.1.raw
  modified_base (220)..(220): a, c, t, g, unknown or other
  misc_feature (220)..(220): n is a, c, g, or t
tcagactgtacagtcacgaccggtgctcgatttagtagtgtagatttgggtttggggccggggcaccctggtcacggtctcgtcagcttccaccaagggcccatcggtcttccccctggcgccctgctccaggagcacctctgggggcacagcggcctgggctgcctggtcaaggactacttccactgtacagtctgagcgggctggcaaggcgcatagn

SEQ ID NO: 136167 - DNA, 286 bp, Homo sapiens
  misc_feature: GYAE6OF01DNNM6.25.25.C03.1.454.CMB.1.raw
  modified_base (154)..(154): a, c, t, g, unknown or other
  misc_feature (154)..(154): n is a, c, g, or t
  modified_base (224)..(225): a, c, t, g, unknown or other
  misc_feature (224)..(225): n is a, c, g, or t
  modified_base (229)..(230): a, c, t, g, unknown or other
  misc_feature (229)..(230): n is a, c, g, or t
  modified_base (232)..(232): a, c, t, g, unknown or other
  misc_feature (232)..(232): n is a, c, g, or t
  modified_base (234)..(234): a, c, t, g, unknown or other
  misc_feature (234)..(234): n is a, c, g, or t
  modified_base (240)..(286): a, c, t, g, unknown or other
  misc_feature (240)..(286): n is a, c, g, or t
tcagactgtacagtcacgaccggtgctcgatttagtagtgtagatttggggtttgggggccggggcaccctggtcacggtctcgtcagcttccaccaagggcccatcggtcttcccctggcgccctgctccaggagcacctcgtgggggcaacnggtccggccctgggctgctggtcaggactacttccatgtactagtctgagcggctgacgaaggctcatgnngacnnantnacgatnnnnnnnnnnnnnnnnnnnnnnnnnnnnnnnnnnnnnnnnnnnnnnn

SEQ ID NO: 136168 - DNA, 161 bp, Homo sapiens; identical to SEQ ID NO: 136158
  misc_feature: GYAE6OF02GC3JH.25.25.C03.1.454.CMB.1.raw
  modified_base (161)..(161): a, c, t, g, unknown or other
  misc_feature (161)..(161): n is a, c, g, or t

SEQ ID NO: 136169 - DNA, 154 bp, Homo sapiens
  misc_feature: GYAE6OF02GGHP1.25.25.C03.1.454.CMB.1.raw
  modified_base (154)..(154): a, c, t, g, unknown or other
  misc_feature (154)..(154): n is a, c, g, or t
tcagactgtacagtcacgaccggtgctcgatttagtagtgtagatttgggtttgggaccaaggtggaaagcaaacgaactgtggctgcaccatctgtcttcatcttcccgccatctgaactgtacagtctgagcgggctggcaaggcgcatagn

SEQ ID NO: 136170 - DNA, 166 bp, Homo sapiens
  misc_feature: GYAE6OF02H5QGK.25.25.C03.1.454.CMB.1.raw
  modified_base (161)..(166): a, c, t, g, unknown or other
  misc_feature (161)..(166): n is a, c, g, or t
tcagactgtacagtcacgaccggtgctcgatttagtagtgtagatttgggtttgggccctgggacgagagtggatatcatacgaactgtggctgcaccatctgtcttcatcttcccgccatctgaactgtacagtctgagcgggctggcaaggcgcatagnnnnnn

SEQ ID NO: 136171 - DNA, 301 bp, Homo sapiens
  misc_feature: GYAE6OF02I2IE8.25.25.C03.1.454.CMB.1.raw
  modified_base (218)..(219): a, c, t, g, unknown or other
  misc_feature (218)..(219): n is a, c, g, or t
  modified_base (234)..(234): a, c, t, g, unknown or other
  misc_feature (234)..(234): n is a, c, g, or t
  modified_base (254)..(254): a, c, t, g, unknown or other
  misc_feature (254)..(254): n is a, c, g, or t
  modified_base (262)..(262): a, c, t, g, unknown or other
  misc_feature (262)..(262): n is a, c, g, or t
  modified_base (271)..(271): a, c, t, g, unknown or other
  misc_feature (271)..(271): n is a, c, g, or t
  modified_base (292)..(301): a, c, t, g, unknown or other
  misc_feature (292)..(301): n is a, c, g, or t
tcagactgtacagtcacgaccggtgctcgatttagtagtgtagatttgggtttggggtcccatcaaggttcagcggcagtggatctgggacagaattcactctcaccatcaacagtctgcagcctgatgattttgcaacttattactgccaacactatcttagttatccggtcagttttggccaggggaccaagctggagatcaaacgaatgtggctnnaccatctgtcttctntctccgtaccatctgaactnttacagtnttgaagggnggtcgtgacgagcgctatagnnnnnnnnnn

SEQ ID NO: 136172 - DNA, 155 bp, Homo sapiens
  misc_feature: GYAE6OF02HZ5WC.25.25.C03.1.454.CMB.1.raw
  modified_base (154)..(155): a, c, t, g, unknown or other
  misc_feature (154)..(155): n is a, c, g, or t
tcagactgtacagtcacgaccggtgctcgatttagtagtgtagatttgggtttgggaccaaggtggaaagcaaacgaactgtggctgcaccatctgtcttcatcttcccgccatctgaactgtacagtctgagcgggctggcaaggcgcatagnn

SEQ ID NO: 136173 - DNA, 558 bp, Homo sapiens
  misc_feature: GYAE6OF02GVZXL.25.25.C03.1.454.CMB.1.raw
  modified_base (535)..(535): a, c, t, g, unknown or other
  misc_feature (535)..(535): n is a, c, g, or t
  modified_base (545)..(545): a, c, t, g, unknown or other
  misc_feature (545)..(545): n is a, c, g, or t
tcagactgtacagtcacgaccggtgctcgatttagtagtgtagatttgggtttgggaagcagagcctggggcatctccaccatggcctggacccctctcctcctccagcttctcaccctctgctcagggtcctgggcacagtctgcgctgacccaggaagactcggtgtcggggaccgtgggacagaaagtcaccctgtcttgttctggtacgagcgacaacattggaacgtatcctgtgggctggtaccaacagaatggtcacggtccccccaaaactgtgatgtctggagatgttccgccctcagggatccctgcccgcttctctggtcagtgtctgggaccacagcctccctgactatcgcggcctcagcctgagacgaggctcggtactactgctcagcatgggactctgagcgtcgctgctcgaggtccgttcgggccggggggtacccggttggacccgttccgtacggtcacggcccaaaggcctcgccccctcggtccaccgttccgtcgttccccgccctcctacncctcgtaccngtctgacgtcggg

SEQ ID NO: 136174 - DNA, 225 bp, Homo sapiens
  misc_feature: GYAE6OF02FL4U5.25.25.C03.1.454.CMB.1.raw
  modified_base (221)..(225): a, c, t, g, unknown or other
  misc_feature (221)..(225): n is a, c, g, or t
tcagactgtacagtcacgaccggtgctcgatttagtagtgtagatttgggtttggggccggggcaccctggtcacggtctcgtcagcttccaccaagggcccatcggtcttccccctggcgccctgctccaggagcacctctgggggcacagcggccctgggctgcctggtcaaggactacttccactgtacagtctgagcgggctggcaaggcgcatagnnnnn

SEQ ID NO: 136175 - DNA, 168 bp, Homo sapiens
  misc_feature: GYAE6OF02FPQLF.25.25.C03.1.454.CMB.1.raw
  modified_base (161)..(168): a, c, t, g, unknown or other
  misc_feature (161)..(168): n is a, c, g, or t
tcagactgtacagtcacgaccggtgctcgatttagtagtgtagatttgggtttgggccctgggacgagagtggatatcatacgaactgtggctgcaccatctgtcttcatcttcccgccatctgaactgtacagtctgagcgggctggcaaggcgcatagnnnnnnnn

SEQ ID NO: 136176 - DNA, 230 bp, Homo sapiens
  misc_feature: GYAE6OF02GJ64Q.25.25.C03.1.454.CMB.1.raw
  modified_base (220)..(230): a, c, t, g, unknown or other
  misc_feature (220)..(230): n is a, c, g, or t
tcagactgtacagtcacgaccggtgctcgatttagtagtgtagatttgggtttggggccggggcaccctggtcacggtctcgtcagcttccaccaagggcccatcggtcttccccctggcgccctgctccaggagcacctctggggcacagcggccctgggctgcctggtcaaggactacttccactgtacagtctgagcgggctggcaaggcgcatagnnnnnnnnnnn

SEQ ID NO: 136177 - DNA, 562 bp, Homo sapiens
  misc_feature: GYAE6OF01BGVGS.1.41.D08.1.454.CMB.1.raw
  modified_base (311)..(311): a, c, t, g, unknown or other
  misc_feature (311)..(311): n is a, c, g, or t
  modified_base (408)..(408): a, c, t, g, unknown or other
  misc_feature (408)..(408): n is a, c, g, or t
  modified_base (443)..(443): a, c, t, g, unknown or other
  misc_feature (443)..(443): n is a, c, g, or t
tcagacgagtgcgtcacgaccggtgctcgatttagtcacgcgagaaagggaaagggggaggaactgctcagttaggacccagagggaaccatggaagccccagctcagcttctcttcctcctgctactctggctcccagatatcaccggagaagttgtgttgacacagtctccagcccaccctgtctttgtctccaggggaaacagcccaccctctcctgcagggccagtcagagtgtttcagctccttagcctggtaccaacagaaacctggccaggcctcccaggcctcctcatcctatgcatccaacncgggccactggcactcccagccaggttcagtggcaggtgggtctggggacaggtacttcgactcctacaccatcagcagcctagacgcctagaagtntttgactagtttattactgtcagcagtcgtaacgngtcgccctgtacgttcgggacggtacggtccgaagggtcggagacgtacgtaaacgtacgtaggtcggctgacctacacgtcgtacgttcttacctattcccttcccgtaccccttccc

SEQ ID NO: 136178 - DNA, 821 bp, Homo sapiens
  misc_feature: GYAE6OF01BRZRX.1.41.D08.1.454.CMB.1.raw
  modified_base (755)..(755): a, c, t, g, unknown or other
  misc_feature (755)..(755): n is a, c, g, or t
  modified_base (796)..(796): a, c, t, g, unknown or other
  misc_feature (796)..(796): n is a, c, g, or t
tcagacgagtgcgtcacgaccggtgctcgatttagtcacgcgagaaagggaaagggggaggaactgctcagttaggacccagagggaaccatggaagccccagctcagcttctcttcctcctgctactctggctcccagatatcaccggagaagttgtgttgacacagtctccgagcccaccctgtctttgtctccgaggggaacacgcccaccctctccgtgcgacggcctagtcagtagtttgtttccacgcttccgtacgccgtacggtaaccaaacgacgaaaccgtcggaccgtacgtacccgtcccgaggtccttccttacacgttacgtagtcgacctaaccgtaccgtaaccgaccgggtacccgaacggttccggaccctaaccgttaccccggaaaccggtacccgttacgggttaactaacggggttccggaacggttcggggtcgggttacggtacgggtaacgtaccggtacctttacgtaccgtaccttaccgaaaccgtacgtacgaaccggaccgtaacggtacccgttaacggaacccgttcccggtaagtttaacgtttacgttttaccgacgttttaaagtttaacttaccggttagtacggtaacgtacgtacgggtaaccgttacgccggttacccgtccctacggttacggttaccggggaccgggttagggtacccggttaagggtcggaacgtacgaaaccggtaacggttacgcggttacggccttaacnccggtaaccttcgttacggttcccttccttaaaccccgttntccccgttccccgtacccttccccg

SEQ ID NO: 136179 - DNA, 545 bp, Homo sapiens
  misc_feature: GYAE6OF01EIL9S.47.48.E04.1.454.CMB.1.raw
  modified_base (391)..(391): a, c, t, g, unknown or other
  misc_feature (391)..(391): n is a, c, g, or t
tcagagctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcagtcaggggcgttgcaaatgctttggcctggtttcagcagacaccagggaacggcccctaagcgcctgatctatggtgcatacactttgaaaagtgggtccatcaaggttcagcgcagtaggtctgggacagagttcactctcactatcagcggctgcagcctgaagtnttctgctaactttattactgtcctccagtatgtatcgtccttacccgtccggtactttccggaccgtaacgggaccgtaaagggtagggtaaataaccgaaaaccggtaaacgttacgggttacggtacgtacggaccaacccgtatttacccg

SEQ ID NO: 136180 - DNA, 524 bp, Homo sapiens
  misc_feature: GYAE6OF01DX2LK.47.48.E04.1.454.CMB.1.raw
  modified_base (222)..(222): a, c, t, g, unknown or other
  misc_feature (222)..(222): n is a, c, g, or t
  modified_base (393)..(393): a, c, t, g, unknown or other
  misc_feature (393)..(393): n is a, c, g, or t
tcagagctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggngagtcgagggcgttgcaaatgcttggcctggtttcagcagacacgagggaacgccctaagcgcctgatctatggtgcatacactttgcaaaggtcgggtccatcaaggttcagcggcagtaggtctgggacagtagttcactctctactatcagcgctgcagcctagaatnttctgctaattatactgtctcgattactgtatgtaccttacccgtcggttaccttcggaccgtaaacggggaccgtaagggtacggaaactaccgaaaacgtacgttggtacgcgtacggactaccgtacg

SEQ ID NO: 136181 - DNA, 496 bp, Homo sapiens
  misc_feature: GYAE6OF01BDPXH.47.48.E04.1.454.CMB.1.raw
  modified_base (392)..(392): a, c, t, g, unknown or other
  misc_feature (392)..(392): n is a, c, g, or t
tcagagctcacgtacacgaccggtgctcgatttagagagcgtcacagagagaaggggaggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcagggcgttgcaaatgctttggcctggtttcagcagacaccagggaaggcccctaagcgcctgatctatggtgcatacactttgcaaagtgggtccatcaaggttcagcggcagtaggtctggacagagttcactctcactatcagcggctgcagcctgaagtnttctgctaacttattactgtctcctagtatgatgaccttcctcggtacttcggaccgaagggaccaagggtacgaaactcgaaacgtactagagctgctaaccg

SEQ ID NO: 136182 - DNA, 674 bp, Homo sapiens
  misc_feature: GYAE6OF01BG9DS.47.48.E04.1.454.CMB.1.raw
  modified_base (316)..(316): a, c, t, g, unknown or other
  misc_feature (316)..(316): n is a, c, g, or t
tcagagctcacgtacacgaccggtgctcgatttagagagcgtcacagagagaaggggaggaatcagtcccactcaggacacagcatggacatgagggtccccgctcagctcctggggctcctgctgctctggtttccccagggtgcctaggtggtcgggactaggtccaaagggctcgaaccctaggtctccatcctcctgtctgcatctgtagagacagatcaccatcacttgccgggcgagtcagggcttgcaaatgcttggctggttcagcagacaccgagggaacgcccctaagccgcctgatcgtatggtnctatacctacgtttgactaaaggtcgggtacccaagtactaaacggttgacggcggctaagggtacgggttccgtaggggaacctaggtacggtttccaaccttcgttaccaacctttaagtacgacggccgggtccctacgaccgacgtacgttagtaacgtttacttcgttacgtaactttaacgtttacgttaccttacgttaccgtaccgttaagttacgttagtacgttaccgttacccgttacccgttaccggttaccggttaccggtaaccggtaaccgggtaacggtaacggtaacggtaaacgtaaacgtaaacgtaacggtacggtacggtacgtccgtaccgtaccg

SEQ ID NO: 136183 - DNA, 496 bp, Homo sapiens
  misc_feature: GYAE6OF01D1825.47.48.E04.1.454.CMB.1.raw
  modified_base (394)..(394): a, c, t, g, unknown or other
  misc_feature (394)..(394): n is a, c, g, or t
  modified_base (421)..(421): a, c, t, g, unknown or other
  misc_feature (421)..(421): n is a, c, g, or t
tcagagctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcaggggcgttgcaaatgctttggcctggtttcagcagacaccagggaaggcccctaagcgcctgatctatggtgcatacactttgcaaagtggggtcccatcaaggttcagcggcagtaggtctgggatagagttcactctcactatcagcggcctgcagcctgaagnttctgcaacttattactgtctccagtntgatgcttaccctcggtactttcggcctaagggacctaagggtggaaatcgaaacgaactgtaggctcgcactac

SEQ ID NO: 136184 - DNA, 526 bp, Homo sapiens
  misc_feature: GYAE6OF01ACLXP.47.48.E04.1.454.CMB.1.raw
tcagagctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcagggcgttgcaaatgctttggcctggtttcagcagacaccagggaacggcccctaagcgcctgatctatggtgcatacactttgcaaagtggggtcccatcaaggttcagcggcagtaggtctgggacagagttcactctcactatcagcggctgcagcctgaagtatctgctaacttattactgtctctagtatgatcgtccttacccgtcggtactttccgggaccgtaacgggtacccaagggttacggaaactaccgaaaacggtaacgtaggtacggactcgccgtaccgtacg

SEQ ID NO: 136185 - DNA, 524 bp, Homo sapiens
  misc_feature: GYAE6OF01AQ6BH.47.48.E04.1.454.CMB.1.raw
  modified_base (379)..(379): a, c, t, g, unknown or other
  misc_feature (379)..(379): n is a, c, g, or t
  modified_base (393)..(393): a, c, t, g, unknown or other
  misc_feature (393)..(393): n is a, c, g, or t
  modified_base (401)..(401): a, c, t, g, unknown or other
  misc_feature (401)..(401): n is a, c, g, or t
  modified_base (424)..(424): a, c, t, g, unknown or other
  misc_feature (424)..(424): n is a, c, g, or t
  modified_base (458)..(458): a, c, t, g, unknown or other
  misc_feature (458)..(458): n is a, c, g, or t
  modified_base (462)..(462): a, c, t, g, unknown or other
  misc_feature (462)..(462): n is a, c, g, or t
tcagagctcacgtacacgaccggtgctcgatttagagagcgtcacagagagaaggggctcagagaggagccttagccctggactccaaggcctttccacttggtgatcagcactgagcacagaggactcaccatggaattggggctgagctgggttttccttgttgctattttagaaggtgtccagtgtgaggtgcaattggtgcaatctgggggaggcttggtccagccgtggggggtccctcagactctcctgtgcagcctctggattcacctttagttcctcttggatgaattgggtccgccagctccgaggggaagggctggaggtgggttggcaacataatccagataggaatcaagaaactatgtgactctgngaaggccattcacntctcaganacaacgccaagactctctgttcngacaagtgacagccagacgagtacgaagacacgntgtntattacgtgttgtgttctcgtcgaccgtcccgtacgggcccgtaccgttgggtccgttcggg

SEQ ID NO: 136186 - DNA, 506 bp, Homo sapiens
  misc_feature: GYAE6OF01A0FM2.47.48.E04.1.454.CMB.1.raw
  modified_base (420)..(420): a, c, t, g, unknown or other
  misc_feature (420)..(420): n is a, c, g, or t
tcagagctcacgtacacgaccggtgctcgatttagagagcgtcacagagagaaggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcagtcagggcgttgcaaatgctttggcctggtttcagcagacaccaggaaggcccctaagcgcctgatctatggtgcatacactttgcaaagtggggtcccatcaaggttcagcggcagtaggtctgggacagagttcactctcactatcagcggctgcagcctgaagattctgctaacttattactgtctccagtatgntcgtcttaccctcggactttcggacctaacggggaccaaggtcggaaataccgaaacgaactacggtaggacctggccaacgtacg

SEQ ID NO: 136187 - DNA, 802 bp, Homo sapiens
  misc_feature: GYAE6OF01AD2UG.47.48.E04.1.454.CMB.1.raw
  modified_base (221)..(221): a, c, t, g, unknown or other
  misc_feature (221)..(221): n is a, c, g, or t
  modified_base (299)..(299): a, c, t, g, unknown or other
  misc_feature (299)..(299): n is a, c, g, or t
tcagagctcacgtacacgaccggtgctcgatttagagagcgtcacagagagaaggggaagtcagtcccactcaggacacagcatggacatgagggtccccgctcagctcctggggctcctgctgctctggttcccaggtgccaggtgtgacatccagatgacccagtctccatcctcctgtctgcatctgtaggagacagagtcaccatcacttgccgggnagtcaggggcttgcaatgctttggccttggtttcagcagacaccagggaacggcccctaagccgcctgatctatggtncatacacttttggacaaaggttcgggggtaccctatacgtaaagggtttcaaggccggtcaaggttacgggtccttagggggaacctaggtacggtttcctaacgttccgtaccgtaacgttaactaccgaacggggtcccgggtcccttacggggaccctaaacgggcccccgttttaagggaaaaccggttactttttccggtaacgggtaccctttaaaaccgttttaacgttttaacccgttcggtttaccccgtttaccgttaaagggtttaaccttaggggttaactttaccggggttacccccttttttaaacccccggttcccggggttaaccttttttaaccccggggggaaccccgttaaaaacccgggggggtaacccgttaaaaacgggggttacggggtaaaaacgtttaacccgttaaaaacccggaaaccggtttcggggtttaaccggggacccctttaacgggtacccggaaccccctttaaacgg

SEQ ID NO: 136188 - DNA, 530 bp, Homo sapiens
  misc_feature: GYAE6OF01BDXXA.47.48.E04.1.454.CMB.1.raw
  modified_base (392)..(392): a, c, t, g, unknown or other
  misc_feature (392)..(392): n is a, c, g, or t
  modified_base (396)..(396): a, c, t, g, unknown or other
  misc_feature (396)..(396): n is a, c, g, or t
tcagagctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcagtcaggggcttgcaaatgctttggcctggtttcagcagacaccagggaaggcccctaagcgcctgatctatggtgcatacactttgcaaagtggggtcccatcaaggttcagcggcagtaggtctgggacagagttcactctcactatcagcggcctgcagcctgaagnttcngctaacttattactgtctccagtatgatgtccttaccctcggtacttttccgggacccgtaacggggaccctaaagggtacggaaaacgttaccgaaaaccgtaacgttggtacggacgtcggctacccgtacg

SEQ ID NO: 136189 - DNA, 545 bp, Homo sapiens
  misc_feature: GYAE6OF01CS4E7.47.48.E04.1.454.CMB.1.raw
  modified_base (536)..(536): a, c, t, g, unknown or other
  misc_feature (536)..(536): n is a, c, g, or t
tcagagctcacgtacacgaccggtgctcgatttagagagcgtcacagagagaaggggaggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcaagtcagagcattaacagcgatttaaattggtatcaccaagaaaccagggaaacgcccctaacctcctgatctacgatgcatccaatttggaaacaggggtcccatcaaggttcaggtggaagtggatcgtgggactagtattttactttcactatcagcagcctgcagcctagaatatattagacaactattaacttactgtacaacagtatactataactcctacccctactttccggccccttagggaaccctaaaggtcgggtaataataccgaaaacgaacgttgtacggtcttacgacctaacctnttccgttcg

SEQ ID NO: 136190 - DNA, 583 bp, Homo sapiens
  misc_feature: GYAE6OF01CHQMN.47.48.E04.1.454.CMB.1.raw
tcagagctcacgtacacgaccggtgctcgatttagagagcgtcacagagagaaggggaggaatcagtcccactcaggacacagcatggacatgacgggtccccgctcagctcctggggctcctgctgctctggttcccaggtgccaggtgtgacatccagatgacccagtctccatccctccctgtctgcatctgtaggagacagagtcaccatcacttgccgggcagtcagggcgttgcaatgctttggcctggttcagcagacaccgagggaacggcccctaagcgcctgatctatggtgcatacactttgactaaaggtcgggtcccatcaaaggttcaaggcggacagtagggtctaggggacaggagttcactctacactatcaggcggcctgacacgcctagaagtattctgtactaaacttattaaccttcgtccttacctagtaacttggtaactcgtaccgtttaacccgtccgggtaactttcccgggaaccgtaaacggggaacccctaaaggggtacggaaaacgttaaccgaaaacggtaaccgtaggttacgggctaggtccctaaacc

SEQ ID NO: 136191 - DNA, 656 bp, Homo sapiens
  misc_feature: GYAE6OF01DW3JB.47.48.E04.1.454.CMB.1.raw
tcagagctcacgtacacgaccggtgctcgatttagagagcgtcacagagagaaggggaggtctcagagaggagcctttagccctggactccaaggcctttccacttggtgatcagcactgagcacagaggactcaccatggaattggggctgagctgggttttccttgttgcttatttagaaggtgtccagtgtgaggtgcaattggtgcaatcgtgggggagcttggtccagccgtgggggtccctcgagactctcctgtgcagcctcgtggattcctaccttttagttcctcttggatgaattcgggtccgccagactccgagggaagggctgggagtgggtggacaacataaactccaagataggaagtcaaaggtaaaacctagtagtaggtaactcgtaccgtaggaaacggggtcctaactttacccgacctaagttcctacccgaaggaacgaaccgaaaccgaccctaaaacgtaaccttccttacgttcgttttaccacggtaaccaaaagttcggaaccacggtcctaggacgtagtaccgaaagaccgacggtaccttggttagttaacgttacgttggttagttcgttccttacgtcggtaacccgtcccgttaccggggcccgttacccgttgggttccccgg

SEQ ID NO: 136192 - DNA, 578 bp, Homo sapiens
  misc_feature: GYAE6OF01C8TMK.47.48.E04.1.454.CMB.1.raw
  modified_base (198)..(198): a, c, t, g, unknown or other
  misc_feature (198)..(198): n is a, c, g, or t
tcagagctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatcgacccagtctcactccctcctgtctgcatctgtagganacagatcaccatcacgttgccgggcgagtcgagggtcgttgacaagtgtcgttggccttggtttcagcagacacgagggaacgccctaagcgccgtgactctagtggtgactataactactttgaactaaagggtcggggtacccatacgtaaggttccaggcggacgtaaggtcggtcgtagggacaggtagtcactctacgacttatcgaggccgtacctcgacgacgtcctagaacgtacttctcgaactaactttattactgtacccttaccgtaagtactgtacgttcgtcccttaccggtccggttacgttccggacgtaacgggaccgtaaggtacgaaactaccgaaagtacgtggtacgatcgctaccgtc

SEQ ID NO: 136193 - DNA, 510 bp, Homo sapiens
  misc_feature: GYAE6OF01BNXE2.47.48.E04.1.454.CMB.1.raw
  modified_base (384)..(384): a, c, t, g, unknown or other
  misc_feature (384)..(384): n is a, c, g, or t
  modified_base (397)..(397): a, c, t, g, unknown or other
  misc_feature (397)..(397): n is a, c, g, or t
tcagagctcacgtacacgaccggtgctcgatttagagagcgtcacagagagaaggggaggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcagtcagggcgttgcaaatgctttggcctggtttcagcagacaccagggaaggcccctaagcgcctgatctatggtgcatacactttgcaaagtgggtccatcaaggttcagcggcagtaggtctgggacagagttcactctcactatcagcggcctgcancctagaagattcngctaacttattactgtctcctagtatgaatgccttacccgtcggtactttcggcccgaagggaccaaagggtcggaaaatcgaaaacgtaacgttagtaggctggctaacccg

SEQ ID NO: 136194 - DNA, 525 bp, Homo sapiens
  misc_feature: GYAE6OF01AODZW.47.48.E04.1.454.CMB.1.raw
tcagagctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcagggcgttgcaaatgctttggcctggtttcagcagacaccagggaaggcccctaagcgcctgatctatggtgcatacactttgcaaagtggggtcccagtcaaggttcagcggcagtaggtctgggacagagttcactctcactatcagcggcctgcagcctagaagattctgctaacttattactgtctccgagttatgatgtccttacccgtcggtacctttccgggacccgtaaggggacctaagggtaggaaacgtaccgaaaacggaacgttggtacggctcgccaccgtaag

SEQ ID NO: 136195 - DNA, 501 bp, Homo sapiens
  misc_feature: GYAE6OF01EL6HF.47.48.E04.1.454.CMB.1.raw
  modified_base (221)..(221): a, c, t, g, unknown or other
  misc_feature (221)..(221): n is a, c, g, or t
  modified_base (355)..(355): a, c, t, g, unknown or other
  misc_feature (355)..(355): n is a, c, g, or t
  modified_base (395)..(395): a, c, t, g, unknown or other
  misc_feature (395)..(395): n is a, c, g, or t
tcagagctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctcctgtctgcatctgtaggagacagagtcaccatcacttgccgggngagtcaggggcttgcaaatgctttggcctggtttcagcagacaccagggaaggcccctaagcgcctgatctatggtgcatacactttgcaaagtggggtccatcaaggttcagcggcagtaggtctgggacagngttcactctcaccatcagcggcctgcagcctgaagattcngctaacttattactgtctcagtatgatcgcttaccctcggtactttcggaccaagggaccctaagggtacgaaactcgaaacgaacttggtaggctggcacgtacg

SEQ ID NO: 136196 - DNA, 493 bp, Homo sapiens
  misc_feature: GYAE6OF01A95GP.47.48.E04.1.454.CMB.1.raw
  modified_base (224)..(224): a, c, t, g, unknown or other
  misc_feature (224)..(224): n is a, c, g, or t
  modified_base (391)..(391): a, c, t, g, unknown or other
  misc_feature (391)..(391): n is a, c, g, or t
  modified_base (432)..(432): a, c, t, g, unknown or other
  misc_feature (432)..(432): n is a, c, g, or t
  modified_base (439)..(439): a, c, t, g, unknown or other
  misc_feature (439)..(439): n is a, c, g, or t
tcagagctcacgtacacgaccggtgctcgatttagagagcgtcacagagagaaggggaggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggnagtcagggcgttgcaaatgctttggcctggtatcagcagaaaccagggaagttcctaagctcctgatctatgttacatccacttgctaattcggggtcccatctcggtcagtggcagtgatctggacagtatttcactctcaccatcagcagcctgcagcctgaagntgttagctaacttattactagtactaaaattataacagtcnccccgtntctacgttcggacggacggacaggtggacgatacgaaacgactagcgtgtgacc

SEQ ID NO: 136197 - DNA, 526 bp, Homo sapiens
  misc_feature: GYAE6OF01CJ5SV.47.48.E04.1.454.CMB.1.raw
tcagagctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttggccgggcgagtcgaggggcgttgcaaatgctttggcctggtttcagcagacaccagggaaggccccctaaagccgcctggatctatggtgcatacactttgcaaagtggggtcccatcaaggttcagcggcagtaggtctgggacagagttcactctcactatcagcggcctgcagcctagaagtattctgtcaactttattactgtcctccagttatgtatgtccttacccgtcggtacctttccggaccgaagggacccgtaagggtaggaaactaccaaacgaacgtggtaggactcgcaccgtacg

SEQ ID NO: 136198 - DNA, 488 bp, Homo sapiens
  misc_feature: GYAE6OF01AC5G9.47.48.E04.1.454.CMB.1.raw
tcagagctcacgtacacgaccggtgctcgatttagagagcgtcacagagagaaggggaggaatcagtcccactcaggacacagcatggacatgagggtccccgctcagctcctggggctcctgctgctctggtttcccaggtgccaggtgtgacatccagatgacccagtctccatcctccctgtctgcatctgtaggagacagagtcaccatcacttgccgggcgagtcagggcgttgcaaatgctttggcctggtttcagcagacaccagggaaggcccctaagcgcctgatctatggtgcatacactttgcaaagtgggtccatcaaggttcagcggcagtaggtctgggacagagttcactctcactatcagcgctgcagcctgagattctgctaacttattactgtctcctagtatgatgcttaccctcgtacttcggccaacgggaccaaggtcgaaatcaaacgtactgtaggctgctacc

SEQ ID NO: 136199 - DNA, 675 bp, Homo sapiens
  misc_feature: GYAE6OF01CJBTA.47.48.E04.1.454.CMB.1.raw
  modified_base (201)..(201): a, c, t, g, unknown or other
  misc_feature (201)..(201): n is a, c, g, or t
tcagagctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatcgaccctagtcctccatccctccctgtctgcatctgtagganacagagtcaccatcacgttcggccgggcgagtcgagggtcgttgactaatcgtcgtttggcttggttcagcagacgaccgagggaccgaccccgtaagccgcctagactctagtggtagctatactacgtttcgacgtaaggtcgggtacctagtacgtaaggttcgacggcggtacgtaggtacggtcgtagggaactaggtacgttaccgactccgtactactacgtccgacggtcccggaccgtcggaccgtacggccgtaaggtaacgtacttccgtacgtaaccttaactttacgttaaccgttcgttaccttaccgtaagttacgttacgttacgtccggttacccttaccccggttacgggttaacccgtttaccgggaacccggtaaacgggtaaccggttaagggtaacggtaaacgtaccgtaaaaccgtacgttacggtacggaccgtcgaccgtaccgtacg

SEQ ID NO: 136200 - DNA, 531 bp, Homo sapiens
  misc_feature: GYAE6OF01E3MU6.47.48.E04.1.454.CMB.1.raw
  modified_base (438)..(438): a, c, t, g, unknown or other
  misc_feature (438)..(438): n is a, c, g, or t
tcagagctcacgtacacgaccggtgctcgatttagagagcgtcacagagagaagggggaatcagtcccactcaggacacagcatggacatgagggtccccgctcagctcctggggctcctgctgctctggttcccagataccagatgtgacatccagatgacccagtctccatcctccctgtctgcatctgtaggagacacagtcaccatcacttgccgggcgagtcaggacattagcaattatttagcctggtatcagcagaaaccagggaaagttcctaagctcctgatctatgttacatccactttgcaattcggggtcccatctcggttcagtggcagtgatctggacagatttcactctcaccatcagcagcctgcagcctgaagatgttgcaacttattactagtacaaaaatataaacagtacgccccgtntcctaccgtttccgggacgggtacggggaacccaaaggggttcgggaacgaattaaccgaaaacggtaacgttaggtcgggtcgtggtacccg

SEQ ID NO: 136201 - DNA, 529 bp, Homo sapiens
  misc_feature: GYAE6OF01D7UZ6.47.48.E04.1.454.CMB.1.raw
  modified_base (398)..(398): a, c, t, g, unknown or other
  misc_feature (398)..(398): n is a, c, g, or t
tcagagctcacgtacacgaccggtgctcgatttagagagcgtcacagagagaaggggaggaatcagtcccactcaggacacagcatggacatgagggtccccgctcagctcctggggctcctgctgctctggttcccaggtgccaggtgtgacatccagatgacccagtctccatcctcctgtctgcatctgtaggagacagagtcaccatcacttgccgggcgagtcagggcgttgcaaatgctttggcctggtttcagcagacaccagggaaggcccctaagcgcctgatctatggtgcatacactttgcaaagtgggtccatcaaggttcagctgcagtaggtctagggacaggacgttcaactctacactatcagcggcctgcagcctagaagnttctgcaacttattactgtctcctagttatgtatcgtaccttacccgtcggtaccttttccgggaccctaaggggacccaaagggtacggaaagtaaccgaaacgtaacgtaggtcgggtctggtaacccg

SEQ ID NO: 136202 - DNA, 507 bp, Homo sapiens
  misc_feature: GYAE6OF01ANCMA.47.48.E04.1.454.CMB.1.raw
  modified_base (395)..(395): a, c, t, g, unknown or other
  misc_feature (395)..(395): n is a, c, g, or t
  modified_base (399)..(399): a, c, t, g, unknown or other
  misc_feature (399)..(399): n is a, c, g, or t
tcagagctcacgtacacgaccggtgctcgatttagagagcgtcacagagagaagggggaatcagtcccactcaggacacagcatggacatgagggtcccccgctcagctcctggggctcctgctgctctggttcccaggtgccaggtgtgacatccagatgacccagtctccatcctccctgtctgcatctgtaggagacagagtcaccatcacttgccgggcgagtcagggcgttgcaaatgctttggcctggtttcagcagacaccagggaaggcccctaagcgcctgatctatggtgcatacactttgcaaagtggggtcccatcaaggttcagcggcagtaggtcgtgggacaggagttcactctcactatcagcgctgcagcctagaagnttcngctacttattactgtctcgagtatgatcgccttaccgtcgtactttccggacctaacggggacctaagggtaggaataccgaaacgtactggtgacgtgccacgtacg

SEQ ID NO: 136203 - DNA, 705 bp, Homo sapiens
  misc_feature: GYAE6OF01CX8SO.47.48.E04.1.454.CMB.1.raw
tcagagctcacgtacacgaccggtgctcgatttagagagcgtcacagagagaagggggaatcagtcccactcaggacacagcatggacatgagggtcccccgctcagctcctggggctcctgctgctctggttcccaggtgccaggtgtgacatccagatgacccagtctccatccctccctgtctgcatctggtaggagacagagtcaccatcacttcggccgggcgagtcgaggggtccttagacaaatgtcgtttggccttggtttcagcagacaccgaggggaacggcccctaagccgcctgatcgtagtggtgacatactacgtttagacgtaaaggtcggggtaccagtacgaaggttcaggcggacgtaggtaggtcgtagggaacgaggtacgttcctactcgtacctaactacgtaccgacggcggtaccctggaccgtaacggacccgttaggaaaggttactttaccgtacggtaccttaacgtttaactttaccgttcggttacccttaccgtaagttacgttacgtaacgttccgttaccccgtttaacccggttccgggttacccgttttacccggggaaacccgtaaacggggggtaacccggtaaaggggtaacggtaaaacgttaaccggaaaaccggtaacggttacgggtacgggtaccgtacgggtacccctaacgttaacccgg

SEQ ID NO: 136204 - DNA, 558 bp, Homo sapiens
  misc_feature: GYAE6OF01DKIM4.47.48.E04.1.454.CMB.1.raw
  modified_base (359)..(359): a, c, t, g, unknown or other
  misc_feature (359)..(359): n is a, c, g, or t
  modified_base (386)..(386): a, c, t, g, unknown or other
  misc_feature (386)..(386): n is a, c, g, or t
  modified_base (399)..(399): a, c, t, g, unknown or other
  misc_feature (399)..(399): n is a, c, g, or t
tcagagctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcaagtcagagcaattaacagcgaatttaaaattggtatcaccaagaaaaccagggaaacgcccctaacctcctgatctatgctgcatccagtttgcatagtgggtcccatctaggttcagtgcagtggatcgtggacngtatttcactctcaccatcagcagtcngcaacctgaagtnttctgactaactttattactgtacctacctagtatgattcgtcctttaaccccgttcggtaccttttccgggacccgtaaaacggggtaaccctaaaggggttacggaaaaacttccgaaaaaccggtacgttacggtagggccttcggacctaacccg

SEQ ID NO: 136205 - DNA, 876 bp, Homo sapiens
  misc_feature: GYAE6OF01CJBQW.47.48.E04.1.454.CMB.1.raw
tcagagctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctggtaggagacagagtcaccatcacttggccggcgagtcaggggtcgttgacaaatgtctttggccttggtttcagcagacaccgagggaacggccctaagccgcctagatctagtggtgcatactacgtttgacgtaaaggtcggggtacccagtacgtaaagggttccaggtacggccgtaaggttacgggtacgttaggggaacctaagggtaacggtttacctaaccgtttccttaaccgtaaccgtttaaccgttaccggaaacggggtcccgggtaccccgttaggaacccgtaacggtaccccgttaaggtaaacgggttaaccttttccgtacggttaaacccgttttaaaacttttaaccgttttaaccgtttaccggttaaccccgtttacccgttaaaagggtttaacgttaaccgggttaacgtttacccgggtttaaccccccgttttaaaccccccggggttttacccgggttttaaaacccccgggtttttaccccggggttaaaaccccggggttaaaaaacccggggggttaaaacccccgttaaaagggggggttaaaaccggttaaaaacccgggtttaaacccggaaaaaacccggttaaacccgggtttacgggtaaccggggttaccgtaacccgggtaacccgttaacccccgtttaaacccgg

SEQ ID NO: 136206 - DNA, 521 bp, Homo sapiens
  misc_feature: GYAE6OF01C5IUJ.47.48.E04.1.454.CMB.1.raw
  modified_base (515)..(515): a, c, t, g, unknown or other
  misc_feature (515)..(515): n is a, c, g, or t
  modified_base (518)..(518): a, c, t, g, unknown or other
  misc_feature (518)..(518): n is a, c, g, or t
tcagagctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttggtcgggcgagtcaggacattagcaattatttagcctggtatcagcagaaaccagggaaagttcctaagctcctgatctatgttacatccactttgctaattcggggtccatctcggttcagcggcgagtaggtctgggacagagttcactctcactatcacgcggcctgcagcctagagtattctgacttaacttatttactcgttctcctagttatgtactcgtccttacccgtcggttaccttcggaccgtagggaccgaaggtaggaaactacgaaacgtacgtcgtcgactgccnctntcg

SEQ ID NO: 136207 - DNA, 536 bp, Homo sapiens
  misc_feature: GYAE6OF01DAXYC.47.48.E04.1.454.CMB.1.raw
  modified_base (309)..(309): a, c, t, g, unknown or other
  misc_feature (309)..(309): n is a, c, g, or t
  modified_base (391)..(391): a, c, t, g, unknown or other
  misc_feature (391)..(391): n is a, c, g, or t
tcagagctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcaggggcgttgacaaatgctttggcctggtttcagcagacaccgagggaacggcccctaagcgcctgatctatggtgcatacncttgacaaaggtcgggtccatcgaaggttcaggcggcgaggtaggtcgtgggacagtagtcactctcactatcagcgctgcngcctgaacgtatctgtactacttattactgtcctacgtagtatgtatcgtccttacccgtcggttaccgttccggaccgaacgggtacccgaaagggtaggtaaacttacgaaaaccgtactacggtcgactcgcgtaccgtacg

SEQ ID NO: 136208 - DNA, 515 bp, Homo sapiens
  misc_feature: GYAE6OF01AFF0U.47.48.E04.1.454.CMB.1.raw
tcagagctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcagtcagggcgttgcaaatgctttggcctggtttcagcagacaccgagggaaggcccctaagcgcctgatctatggtgcatacactttgcaaagtggggtcccatcaaggttcagcggcagtaggtctgggacagagttcactctcactatcagcgcctgcagcctgaagattctgactaacttattactgtctccagtatgatgtccttacccgtcgtactttccggaccgaacgggtaccgaagggttacggaaactacgaaaacgaactggtacggactagctaccgtacg

SEQ ID NO: 136209 - DNA, 539 bp, Homo sapiens
  misc_feature: GYAE6OF01B3KE5.47.48.E04.1.454.CMB.1.raw
  modified_base (414)..(414): a, c, t, g, unknown or other
  misc_feature (414)..(414): n is a, c, g, or t
tcagagctcacgtacacgaccggtgctcgatttagagagcgtcacagagagaaggggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttggccgggcgagtcaggggcgttgcaaatgcgtttggcctggtttcagcagacaccgagggaacggcccctaagcgcctgatctagtggtgcatactactttgacaaaggtcggggtcccagtcgaaggttcagcggcaggtaggtcgtagggacaggtagttcactctcactatcgagcggcctgcagcctagaagtnttctgtactaacttattactgtctccgagtatgtattcgtccttaccgtcggttaccgttccggaccgtaacgggaccgtaagggtacggaaatacgaaacgtacgtgtacgactgccacgtacg

SEQ ID NO: 136210 - DNA, 595 bp, Homo sapiens
  misc_feature: GYAE6OF01BRHQT.47.48.E04.1.454.CMB.1.raw
tcagagctcacgtacacgaccggtgctcgatttagagagcgtcacagagagaaggggaggaatcagtcccactcaggacacagcatggacatgagggtccccgctcagctccgtggggctcctgctgctctggttcccaggtgccaggtgtgacatccagatgacccagtctctatccctcctgtctgcatctgtaggagacagagtcaccatcacgttcgccgggcgagtcgagggtcgttgcaaatgctttggccttggtttcaggcagacacgagggaacggccctaagcgcctgatctactggtgcatactactttgactaaaggtcgggtaccccagttacgaaggttcgaacggcggcgtaaggtaggtcgtgggacagagttcactcgtactactatcagcggcctgcagcctagagtacttctgactaacttatttaacctcgttactcctaagtacttgtaactcgtacccttaccgtaccggttaccgtttaccggacccggtaaacgggtacctaacggggtaaacggtaaacgttaaacccaaaacggtaaccgttcgggtacggtacgtcgaccctaacccg

SEQ ID NO: 136211 - DNA, 937 bp, Homo sapiens
  misc_feature: GYAE6OF01BDMZB.47.48.E04.1.454.CMB.1.raw
tcagagctcacgtacacgaccggtgctcgatttagagagcgtcacagagagaaggggctcagagaggagccttagccctggactccaaggcctttccacttggtgatcagcactgagcacagaggactcaccatggaattgggctgagcttgggttttccttgttgtcttattttagaaggtgtccagtgtgaggtgctaattggtgcaatcgtgggggaggcgttggtccagccgtcggggggtccctcgagactctcctgtgcacgtcctcgtggtactttcctaccttttacgttccttcgtttggtacttaggtaacgtttcggggttcccgaccgtacggtaccgttaccggaagggggtaacgggggtccgttggggtaagggttcgggggtttacggaaccgtaaaacgtaaacgttaaaaccgtacccgtaaaggtaacggttagggtaaacgttaccgaaaacggtaaaaaacccgttaggttaacgggttacgggtaacccgtttaccgttaccggtacgggtaaaccgggggtacccgttaaagtttaccccgtaaacccgtacgttaccccgttaaccgtaaacggtaaaccggaaacccgaaaacccggaacccgtaaaacgtaacccgtttcccgttaccgttttacggttttacccgtacggtaaacctaaaaggttacgggaaaccgtaaccggtacccggttagggtaaaccggttaacggttaaccgggtaaaacggtacccgtaaaccggggttccgttttacgggttaacggttttaaacgttttaaccggttgggttttacggttacggtttcccgttaccgttaccgggtaaccccgggttccccgggtttaccccggggtaccccggggtttaaaccccggttttccggggtccccggtttttacccggggggg

SEQ ID NO: 136212 - DNA, 530 bp, Homo sapiens
  misc_feature: GYAE6OF01D2YLT.47.48.E04.1.454.CMB.1.raw
  modified_base (396)..(396): a, c, t, g, unknown or other
  misc_feature (396)..(396): n is a, c, g, or t
tcagagctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcagtcagggcgttgcaaatgctttggcctggtttcagcagacaccagggaaggcccctaagccgcctgatctatggtgcatacactttgcaaagtggggtcccatcaaaggttcagcggcagtaggtctgggacagagttcactctacactatcagcggcctgcagcctagaagnttctgctaactttattactgtctaccagttatgattcgtttaccccgtcggtactttccggacctaagggacccgtaaaggtcgggaaattaccgaaaacgtaactggtcggtacctggacctacctagttccg

SEQ ID NO: 136213 - DNA, 513 bp, Homo sapiens
  misc_feature: GYAE6OF01AHJO3.47.48.E04.1.454.CMB.1.raw
  modified_base (394)..(394): a, c, t, g, unknown or other
  misc_feature (394)..(394): n is a, c, g, or t
  modified_base (411)..(411): a, c, t, g, unknown or other
  misc_feature (411)..(411): n is a, c, g, or t
  modified_base (422)..(422): a, c, t, g, unknown or other
  misc_feature (422)..(422): n is a, c, g, or t
tcagagctcacgtacacgaccggtgctcgatttagagagcgtcacagagagaaggggaggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcagggcgttgcaaatgctttggcctggtttcagcagacaccaggggaaggcccctaagcgcctgatctatggtgcatacactttgcaaagtgggtcccatcaaggttcagcggcagtaggtctgggacagagttcactctcactatcagcggcctgcagcctgagnttctgcaacttattacngtctcagttangtatcgcttaccctcggtaccgtttcggaccgtaacgggaccgaagggtcggaaacgttacaaacggtaacgtggtaggcgtgctaacccg

SEQ ID NO: 136214 - DNA, 509 bp, Homo sapiens
  misc_feature: GYAE6OF01BB92T.47.48.E04.1.454.CMB.1.raw
  modified_base (501)..(501): a, c, t, g, unknown or other
  misc_feature (501)..(501): n is a, c, g, or t
  modified_base (505)..(505): a, c, t, g, unknown or other
  misc_feature (505)..(505): n is a, c, g, or t
tcagagctcacgtacacgaccggtgctcgatttagagagcgtcacagagagaaggggaggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcagggcgttgcaaatgctttggcctggtttcagcagacaccagggaaggcccctaagcgcctgatctatggtgcatacactttgctaagtgggtcccatcaaggttcagcgcagtggatcgtgggacaggatttcgactctcaccatcagcagtctgcaacctgaagtattttgctaacttactactgtacaatagtacgttaccggtaccccgtactactttggacccgtagggaccctaaacgtcggacagtcaaacgactgtggctgacnccgntccg

SEQ ID NO: 136215 - DNA, 533 bp, Homo sapiens
  misc_feature: GYAE6OF01BTQZ6.47.48.E04.1.454.CMB.1.raw
tcagagctcacgtacacgaccggtgctcgatttagagagcgtcacagagagaaggggaggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcagggcgttgcaaatgctttggcctggtttcagcagacaccagggaacggcccctaagcgcctgatctatggtgcatacactttgacaaagtgggtcccatacgaaggttcaggcggcaggtaggtcgtgggactaggtacgttcacgtctcactatcagcggctgcagctgagtacttctcgactaacttattactgttctccgtatatagattcgtcctttacccgtcggtacctttccggaccgaaacgggacctaagggtcgaaacgtacgaaaccgtagtacggtaggctcgctaacccg

SEQ ID NO: 136216 - DNA, 704 bp, Homo sapiens
  misc_feature: GYAE6OF01CV6QP.47.48.E04.1.454.CMB.1.raw
tcagagctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcgagggcgttgcaaatgctttggcctggtttcagcagacaccgagggacggcccctaagcgcctgatctagtggtgcatacactttgactaaaggtcggggtaccatacaaggttcagcggacaggtaggtcgtagggactagtacgttacacgttctcgaacttatcgaacggtccggtcctagaccgacggcccttaggaaagtactttacctaggtaccctaaaccgttttaactttaccgtttacgttcccgttacccgtaaggttattacggtaacgttacccggttacccgttttaacccccggttaaccgggttaacccgtttttacccggggaaccccggtaaaacgggggtaaaccccggtaaagggggtttaaacgggtaaaaacgttaaccccgaaaaaacgggttaacccgtttacggggttaacggggtacccgtttaaccgggacccgttaacccgttaaaccg

SEQ ID NO: 136217 - DNA, 524 bp, Homo sapiens
  misc_feature: GYAE6OF01A1TNO.47.48.E04.1.454.CMB.1.raw
tcagagctcacgtacacgaccggtgctcgatttagagagcgtcacagagagaaggggaggaatcagtcccactcaggacacagcatggacatgagggtccccgctcagctcctggggctcctgctgctctggttcccaggtgccaggtgtgacatccagatgacccagtctccatccctccctgtctgcatctgtaggagacagagtcaccatcacttgccgggcgagtcagggcgttgcaaatgctttggcctggtttcagcagacaccagggaacggcccctaagcgcctgatctatggtgcatacactttgactaaagtcggggtcccatcaaggttcagcggcaggtaggtcgtgggacagagttcactctcactatcagcggctgcagcctagacgtattctgctaactttattactcgtctacgtagttatcgatcgacttaccctcggtaccttcgggaccgaacggggtaccaagggtacggaaactacgaaacgtacgtagtggctggcctaacg

SEQ ID NO: 136218 - DNA, 511 bp, Homo sapiens
  misc_feature: GYAE6OF01CWD63.47.48.E04.1.454.CMB.1.raw
  modified_base (355)..(355): a, c, t, g, unknown or other
  misc_feature (355)..(355): n is a, c, g, or t
tcagagctcacgtacacgaccggtgctcgatttagagagcgtcacagagagaaggggaggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcagggcgttgcaaatgctttggcctggtttcagcagacaccagggaaggcccctaagcgcctgatctatggtgcatacactttgcaaagtgggtcccatcaaggttcagcggcagtggtctgggacngagttcactctcactatcagcgcctgcagcctgaagattctgctaacttattactgtctcctagtatgattgccttacccgtcggtacctttcgggaccgtaacggggaccaagggtcggaaactacgaaacgtaactggtaggctggctaacccg

SEQ ID NO: 136219 - DNA, 824 bp, Homo sapiens
  misc_feature: GYAE6OF01C6YCG.47.48.E04.1.454.CMB.1.raw
tcagagctcacgtacacgaccggtgctcgatttagagagcgtcacagagagaaggggctcagagaggagccttagccctggactccaaggcctttccacttggtgatcagcactgagcacagaggactcaccatggaattggggctgagctgggtttccttgttgctattttagaggtgtccagtgtgaggtgctaattggtgcaatcgtgggggaggtcttggtccagccgtggggggtccctcgagacctctccgtgtcgcagcctcgtggattcctaccttttacgttccttcgttaggtattggtaaacgtttcgggtcccgccaacggtaaccgtcccgaagggggtaaggggccgttaggggtagggttggggtttagggacctaaaaccgtaagttaaaacgtcccgaaaggtacgttaaggggaaacgttacgaaaacggtaaaaacccttagttacggtacggaccttccgttacgtagggtaaacgggcccgtaattacccaccgtaacttccgacccgaaggaacggaacccaaaacccggtaccgtaaaacgtaacccgttccttacgttacgtttacccgtagaaccgtaaaagtttccgggaacctacggtaccccgtttaagggacggtaaccgggttaaccgaaaggtaccccggtaacgggttacccgtttgggttaacggtttaaaccttacggttacggttaggtttccggtacccttaccggttccgggaaaccccgttcccccgggttacggggtacccccccgggtttacgttcccggggtttacccgttttacccgggggg

SEQ ID NO: 136220 - DNA, 541 bp, Homo sapiens
  misc_feature: GYAE6OF01CN78D.47.48.E04.1.454.CMB.1.raw
tcagagctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttggccgggcgagtcgaggggtcgttgcaaatgctttggcctggtttcagcagacaccgagggaaggcccctaagcgcctgactctatggtgcatacactttgacaagtcggggtccatcaaggttcagcggcagtaggtcgtggacagagttcactctcactatcagcgctgcagctagaagtatctgactaactttatacttgtacctctagtatgtagttcgtccttacccgttcggtaccgtttcggacccgtaacgggaccgtaagggtacggtaaacgtaccgaaaacgtaacgtacggttacgacgtcgacgtccgtaacg

SEQ ID NO: 136221 - DNA, 584 bp, Homo sapiens
  misc_feature: GYAE6OF01CSGTQ.47.48.E04.1.454.CMB.1.raw
  modified_base (224)..(224): a, c, t, g, unknown or other
  misc_feature (224)..(224): n is a, c, g, or t
  modified_base (371)..(371): a, c, t, g, unknown or other
  misc_feature (371)..(371): n is a, c, g, or t
tcagagctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagacgtcaccatcacttggccgggngagtcgaggggtcgttagcaaatgctttggcctggttcagcagacacgaggacgccctaagcgcctgatcgtagtggtgctatactactttgactaaggtcgggtaccatacgtaaggttcagctggctagtagtcgtagggatagngttcactcgtctactatcgagcgctcgcgacgtcctagaacgtattctagtactaacgtttattacgttactaccgttactaagttcgtagtaacgttcgtacctttacccgttacggttacccgtttaccggaaccggtaaacgggtaacccggaagggttacggaaaactaccgaaacggtaaccgtaggtacggtcgtagtccctaaccg

SEQ ID NO: 136222 - DNA, 564 bp, Homo sapiens
  misc_feature: GYAE6OF01C06WD.47.48.E04.1.454.CMB.1.raw
  modified_base (307)..(307): a, c, t, g, unknown or other
  misc_feature (307)..(307): n is a, c, g, or t
  modified_base (344)..(344): a, c, t, g, unknown or other
  misc_feature (344)..(344): n is a, c, g, or t
  modified_base (375)..(375): a, c, t, g, unknown or other
  misc_feature (375)..(375): n is a, c, g, or t
tcagagctcacgtacacgaccggtgctcgatttagagagcgtcacagagagaaggggaggtctcagagaggagccttagccctggactccaaggcctttccacttggtgatcagcactgagcacagaggactcaccatggaattggggctgagctgggttttccttgttgctacttttagaaggtgtccagtgtgaggtgcaattggtgcaatctgggggagcttggtccagcctggggggtccctcagactctcctgtgcagcctcgtggattctacctttagttcctcttggatgaattgggccnccagactccgaggggagggctgggagtgggtggcaanataaatccagagtggaagtcaagaaaacctntgtgactctgtgaagggccgattccaacctatcctccgagacgaaccgaacgccaaagaactctacttgtttactgactaaatggaacacgtcctgagtagtacggagacgaccggtctggtagttagttacgtggttgttgtccttccgtgacccgtcccgtccgggtcccggtccgttcgggtcccg

SEQ ID NO: 136223 - DNA, 541 bp, Homo sapiens
  misc_feature: GYAE6OF01DSA4A.47.48.E04.1.454.CMB.1.raw
tcagagctcacgtacacgaccggtgctcgatttagagagcgtcacagagagaaggggaggaatcagtcccactcaggacacagcatggacatgagggtccccgctcagctcctggggctcctgctgctctggttcccaggtgccaggtgtgacatccagatgacccagtctccatcctcctgtctgcatctgtaggagacagagtcaccatcacttggccgggcgagtcgagggcgttgcaaatgctttggccttggtttcagcagacaccgagggaacggcccctaagccgcctgatctagtggtgcatacactttgacaaggtcgggtcccagtacaaggttcaggcggactaggtaggtcgtagggacaggtagttcactctacactatcagcgctgcagccgtagagtattctcgactaacttattacgtcgtcctactagtatgtagtcgtaccttaccgtcggtaccttacggaccgtaagggtaccgaagggtacgaaacgtacgaaacgtacgtagtacggtctgcgtaaccg

SEQ ID NO: 136224 - DNA, 572 bp, Homo sapiens
  misc_feature: GYAE6OF01DF00O.47.48.E04.1.454.CMB.1.raw
  modified_base (448)..(448): a, c, t, g, unknown or other
  misc_feature (448)..(448): n is a, c, g, or t
tcagagctcacgtacacgaccggtgctcgatttagagagcgtcacagagagaaggggaggaatcagtcccactcaggacacagcatggacatgagggtccccgctcagctcctggggctcctgctgctctggttcccaggtgccaggtgtgacatccagatgacccagtctccatccctccctgtctgcatctgtaggagacagagtcaccatcacttggccgggcgagtcgaggggcgttgacaaatgctttcggccttggtttcagcagacaccgagggaacggcccctaagccgcctgatctagtggtgcatactactttgactaaaggtcgggtaccccaagttacgtaaggttcaaggccggacgtaaggtagggtccgtaggggaaccaggtacgttaccacgttctaaactacttatcaggcgacctgcacgcctagaagnttctgactaacttattactgtctctagtatgtattcgaccttaccgtcgtaccgtttcggaccgtaaacgggacctaagggtagtaaactacgaaacgtacgttaggtacggtctcgctaaccg

SEQ ID NO: 136225 - DNA, 707 bp, Homo sapiens
  misc_feature: GYAE6OF01ECBYV.47.48.E04.1.454.CMB.1.raw
tcagagctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttcgccgggcgagtcgaggggtcgttgacaaatgtctttggccttggtttcagcagacaccgagggaacggcccctaagccgcctgatctatggtgcactactacgtttgacgtaacggtcggggtaccctagtacgtaaggttcgaggtcggacgtaggttacgggtcgtagggaacgaggtacgttaccgacttccgtacctaactactaccgacgtacgtacgttctacgaccctaaccgttagtaaagttactttttacggaacctttaaacttttaactttaccttcggttacccttaccgttaagttagttacgttaacgttacgttacccctttaaccccggttaccggttaacccgttttacccgggaaacccggtaaaccggggtaaccggtaaacggggttaacggtaaaacggtaacccgaaaaccggttaacggttacggttaccgggtacctaccgggtaacctacccgtaacgtttcccg

SEQ ID NO: 136226 - DNA, 524 bp, Homo sapiens
  misc_feature: GYAE6OF01A7GVL.47.48.E04.1.454.CMB.1.raw
  modified_base (433)..(433): a, c, t, g, unknown or other
  misc_feature (433)..(433): n is a, c, g, or t
tcagagctcacgtacacgaccggtgctcgatttagagagcgtcacagagagaaggggctcagagaggagccttagccctggactccaaggcctttccacttggtgatcagcactgagcacagaggactcaccatggaattggggctgagctgggttttccttgttgctattttagaaggtgtccagtgtgaggtgcaattggtgcaatctggggggaggcttggtccagcctggggggtccctcagactctcctgtgcagcctctggattcacctttagttcctcttggatgaatttgggtccgccagactccagggaagggctggagtgggttggcaacataaatccagatggaagtcaagaaaacctatgtggactctctggaagggccattcaccatctcagagacaacgccaagaactctactgtttcngcaaatggaacagcctgagagtcgaagacgacggctgtagtattacgtgtgtgtctcgtgaccgccttcggacccggtccttggccttcgg

SEQ ID NO: 136227 - DNA, 565 bp, Homo sapiens
  misc_feature: GYAE6OF01EURCF.47.48.E04.1.454.CMB.1.raw
tcagagctcacgtacacgaccggtgctcgatttagagagcgtcacagagagaagggggaatcagtcccactcaggacacagcatggacatgagggtcccccgctcagctcctggggctcctgctgctctggttcccaggtgccaggtgtgacatccagatgacccagtctccatcctccctgtctgcatctgtaggagacagagtcaccatcacttggccgggcgagtcgaggggtcgttgcaaatgtctttggcctggtttcagcagacaccgaggggaacggcccctaaggccgccgtgatctagtggtgcattactactttgactaaaggtcggggtaccctatcgtaggttcgagtggcaggtggtagtcgtagggactaggtactttcacttctcacctatcagcagtctgacctaacgtgaagtacttctagtactaacttattactagtcctactagttataggtatcgtaccttacccgtcggttacgttaccggaccgtaacgggtaccgtaaggtacgaaacgtacgaaacgtaacgtggtaggcgtgctaaccg

SEQ ID NO: 136228 - DNA, 576 bp, Homo sapiens
  misc_feature: GYAE6OF01CAH1G.47.48.E04.1.454.CMB.1.raw
tcagagctcacgtacacgaccggtgctcgatttagagagcgtcacagagagaaggggaggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcagtcagggcgttgcaaatgctttggccttggtttcagcagacaccagggaacggcccctaagcgcctgatctatggtgcatacactttgactaaaggtgggtcccatcaaggttcagcggcagtaggtctgggacagagttcacgtctcactatcagcggctgcacgtcctagaacgatttcgtgacctaaactttattacttcgttactaccctagttattagtacttcgtacctttacccgtccggttaccgtttaccgggaacccgtaaacggggtaaccctaaacggggttacggtaaaacttaaccgaaaacggtaacgttaggtacgggactcgggacctaacccg

SEQ ID NO: 136229 - DNA, 582 bp, Homo sapiens
  misc_feature: GYAE6OF01EEOZL.47.48.E04.1.454.CMB.1.raw
tcagagctcacgtacacgaccggtgctcgatttagagagcgtcacagagagaaggggaggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttggccgggcgagtcgagggcgttgcaaatgcttggcctggtttcagcagacaccgagggaacgccctaagcgcctgatctatggtgcatactacgtttgactaaaggtcgggtacccagtacgaaggttcagcggcaggtaggtcgtgggacctaggtacgttcacttccgtacaaccgattacgagtctaagtcgtagacctaaccgtagtaaagttacgttttacgacttaaccttactaacttcgtactaaacgtagtaacgtttaaccggtacccttacggttactacgtttcggaccgtaggggtaaccctaaacgtcggaactacgtacaaacgactaggtcgactagacacgtgttacg

SEQ ID NO: 136230 - DNA, 561 bp, Homo sapiens
  misc_feature: GYAE6OF01B1T78.47.48.E04.1.454.CMB.1.raw
  modified_base (552)..(552): a, c, t, g, unknown or other
  misc_feature (552)..(552): n is a, c, g, or t
tcagagctcacgtacacgaccggtgctcgatttagagagcgtcacagagagaaggggaggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttggccgggcgagtcgagggcgttgacaaatgtcgtttggccttggtttcagcagaccaccgagggaacggaccccgtaagccgcctgactctagtggtgcatactactttgcgtaaggtcgggtcccatcgaacggttcagcgcgaggtaggtcgtagggacaggacgttacacttcgtacactatccaggccgtcctgccagcctagtaagtacttctcgacttaacttattactagtcctaccgtagtattcgtatcgtccttacccgtacggtaccgtttacggaccgtaacggtacgtaaggtacgaaactacgaaacgtacgtggaggtcncgtctaccg

SEQ ID NO: 136231 - DNA, 599 bp, Homo sapiens
  misc_feature: GYAE6OF01C0Y5V.47.48.E04.1.454.CMB.1.raw
  modified_base (201)..(201): a, c, t, g, unknown or other
  misc_feature (201)..(201): n is a, c, g, or t
  modified_base (429)..(429): a, c, t, g, unknown or other
  misc_feature (429)..(429): n is a, c, g, or t
  modified_base (444)..(444): a, c, t, g, unknown or other
  misc_feature (444)..(444): n is a, c, g, or t
tcagagctcacgtacacgaccggtgctcgatttagagagcgtcacagagagaaggggaggaatcagtcccactcaggacacagcatggacatgagggtccccgctcagctcctggggctcctgctgctctggttcccaggtgccaggtgtgacatccagatcgacccagtcctccatccctcctgtctgcatctgtagganacagacgtcacatcacgttggccggcgagtcgaggggtcgttgactaatgtcgtttggccttggttcagcacgacaccgaacgggaacgcccgtaagccgcctgactctagtggtgacacgtactacgtttgacgtaaggtcgggtacctagtacgaaggttcgacggcggctaaggtacggtcgtagggaactaggtacgttcgactctacactatcgacgcggtcngcacgccgtagagtnttcgacgtactaactttagttccttgttacctaccgtagtactagtactcgtacccgttaccgttccggtaccgtttaccggaccgtaaacggtaaccgaagggtacggtaaacgtaaccgaaacgtacgttacggacggtctcgaccgtaaccg

SEQ ID NO: 136232 - DNA, 670 bp, Homo sapiens
  misc_feature: GYAE6OF01C9CZL.47.48.E04.1.454.CMB.1.raw
tcagagctcacgtacacgaccggtgctcgatttagagagcgtcacagagagaaggggaggaatcagtcccactcaggacacagcatggacatgagggtccccgctcagctcctggggctcctgctgctctggttcccaggtgccaggtgtgacatccagatgacccagtctccatccctccctgtctgcatctgtaggagacagagtccaaccatccacgttcggccgggcgagtcgaggggcgttgcaaatgctttggccttggtttcagcagacaccagggaacggcccctaagcgcctgatctatggtgcatacactttcgacaaaggtcggggtaccctagtacgtaaaggttcaggtcggacgtacggtacgggtcttggggaactaggacggtttcaacttcgtacctaacttaacttccgaacggccggtccttacgccacgtccctaggtaacgtagttttacggtacctaacgtttaccttacgttcggtaccaaacggtaacgttacggttaaccgggttaacccccgttaaccgttaccggttttcggaacccggtaacggggtaaacccctaaacgtacgggaacctaaacgttacccgaaaaccgtaaaccgttggttaccgggtcgttaacgacctaaccctagttccgtttaccg

SEQ ID NO: 136233 - DNA, 621 bp, Homo sapiens
  misc_feature: GYAE6OF01EDP6N.47.48.E04.1.454.CMB.1.raw
tcagagctcacgtacacgaccggtgctcgatttagagagcgtcacagagagaaggggaggtctcagagaggagccttagccctggactccaaggcctttccacttggtgatcagcactgagcacagaggactcaccatggaattggggctgagctgggttttccttgttgctattttagaaggtgtccagtgtgaggtgcaattggtgcaatcgtgggggaggcttggtccagccgtggggggtccctcagactctcctgtgcacgcctcgtggattcctaccttttagttccttcgttggatgtaagtttggggtcccgccagacctccgaggggaagggctgggagtgggttgcaacataaatccagataggaatacaaacgtaaaacctgtagtcggactctcgtaggaacgggcctagttccaacctatacctaccagaacgaacaaccgaccaaagtaacctctcttgtttctagacctaaagtcggaactagacctaggacgtagtacgaagaccgacggtcgtaggttagttacgtttacgttggttggttcgttccgttacgtacggtacccgtcccggttacccggggcccggttacccgttcgggtcccgg

SEQ ID NO: 136234 - DNA, 595 bp, Homo sapiens
  misc_feature: GYAE6OF01AXV96.47.48.E04.1.454.CMB.1.raw
tcagagctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctcctgtctgcatctgtaggagacagagtcaccatcacttggccgggcagtcgagggcgttgcaaatgctttggcctggtttcagcagacaccgagggacggcccctaagcgcctgatctatggtgcatacactttgactaaaggtcggggtcccatacgtaaggttcgagcggcaggtaggtcgtgggacaggagttcacttcgtcactactcgacgcggcctgctacgccgtagaacgtacttctcgtactaactttacttaacgttcgttaccttaccgtagttacgttgttacgtcgttaccctttaaccccgttcgggtaccgttttaccgggacccgtaaacggggtacccgtaaagggttacggaaaacttaccgaaaacggtacgtacggttcggaccgtcgacaccgttacg

SEQ ID NO: 136235 - DNA, 863 bp, Homo sapiens
  misc_feature: GYAE6OF01CQDHB.47.48.E04.1.454.CMB.1.raw
tcagagctcacgtacacgaccggtgctcgatttagagagcgtcacagagagaaggggaggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcacatcacttggccgggcgagtcgagggcgttgcaaatgctttggccttggttcagcagacacgagggaacggcccctaagccgcctgactctagtggtgctaatactactttacgacgtaaacggtcgggtaccctaagtacgtaaacggttcgaacggtaccgggtacgtaacgggttacgggttaccggtacgggggtaacctaaagggtaacggtttacccgtaacctttacccgttaccctaaaccgtttaacgttacccggaaacgggtcccgggttaccccgttaacgggtacccgtaaccgggtaccccggtttaaaggtaaaaccggttaacgttttcccgttaacgggtaaaccctttaaaaccgtttttaaccgtttttaaaccgtttaccggtttacccgtttaacccccgttaaggtttaacgttaacgggttaacgtttacccggttaaccccgttttaaacccccggttacccggggtttaacccggtttttacccggggaaaccccgggttaaaaacgggggtaaaccccggttaaaacggggtttaaacggggtaaaaacccgtttaaacccgggaaaaacccggttaacggtttaaccgggttacgggttaacccgttaccggacccgttaaaacccgg

SEQ ID NO: 136236 - DNA, 765 bp, Homo sapiens
  misc_feature: GYAE6OF01ATSRF.47.48.E04.1.454.CMB.1.raw
tcagagctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatccctccctgtctgcatctgtaggagacacagtcaccatcacttggccgggcagtcgaggggtcttgactaaatgcgtttggccttggtttcagcgagacgaccgaacgggaacggaccccgtaacggccggtccgtagagtcctagtggtcgactatactactttagacgtaaaggtcggggtaccctagtacgtaacgggttcgacggtccggtacgtaacggttacgggttaccgtaggggtaacgtaaggtacgtttaccgtactccgttacctaacgttaactaccggaacggtcccggtcccgttacggaccgtacgtacccgttaaggaaagttaccgtttacgtacgtaacccgttaacttttaacgtttaccgttcgtttacccgttaccgtaacgtttaacgttcggtaacgtttaccggtaccccgttttaccccggtaccgggtttaacccgtttaccgggaaccccggttaaccggggtaaaccgtaaacggggttaaccgggaaaaacgttacccggtaaaaaccgtaacggttaccggttacgggacccgttccggtaacccgtaacccggttaccgg

SEQ ID NO: 136237 - DNA, 538 bp, Homo sapiens
  misc_feature: GYAE6OF01A7DFI.47.48.E04.1.454.CMB.1.raw
tcagagctcacgtacacgaccggtgctcgatttagagagcgtcacagagagaaggggaggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcagggcgttgcaaatgctttggcctggtttcagcagacaccgagggaacggcccctaagcgcctggactctatggtgcatactactttgactaaaggtcgggtcccagtcgaaggttcacggcggctaggtacggtcgtgggacagacgttcactcctcactatcgagcggcctgccgagtccgtagacgtattcctagtctaactttattacttgtactctagtatgatcgtaccgttaccctcggtaccttccggaccgtacgggaccaagggtgaaacgtacaaaccgtaactggagcgtgcgtacc

SEQ ID NO: 136238 - DNA, 535 bp, Homo sapiens
  misc_feature: GYAE6OF01D71RH.47.48.E04.1.454.CMB.1.raw
  modified_base (355)..(355): a, c, t, g, unknown or other
  misc_feature (355)..(355): n is a, c, g, or t
  modified_base (384)..(384): a, c, t, g, unknown or other
  misc_feature (384)..(384): n is a, c, g, or t
  modified_base (414)..(414): a, c, t, g, unknown or other
  misc_feature (414)..(414): n is a, c, g, or t
  modified_base (438)..(438): a, c, t, g, unknown or other
  misc_feature (438)..(438): n is a, c, g, or t
  modified_base (500)..(500): a, c, t, g, unknown or other
  misc_feature (500)..(500): n is a, c, g, or t
  modified_base (505)..(505): a, c, t, g, unknown or other
  misc_feature (505)..(505): n is a, c, g, or t
tcagagctcacgtacacgaccggtgctcgatttagagagcgtcacagagagaaggggaggtctcagagaggagccttagccctggactccaaggcctttccacttggtgatcagcactgagcacagaggactcaccatggaattggggctgagctgggttttccttgttgctattttagaaggtgtccagtgtgaggtgcaattggtgcaatctgggggaggcttggtccagcctggggggtccctcagactctcctgtgcagcctctggattcacctttagttcctcttggatgaattgggtccgcagactccgagggaagggctgggagtggttggcaacgataaatccaganggaagtcaagaaaacctatgtggactctntagaagggccagttcaccatcctaccaganacaacgcaagactctctcgtttcngacaagtggacagcctagaagcgtacgaagacgacggtctgtacgttattaccgtgttgttntcctntacggctcctcgggcccgtccgttggtccg

SEQ ID NO: 136239 - DNA, 583 bp, Homo sapiens
  misc_feature: GYAE6OF01DJ5Z5.47.48.E04.1.454.CMB.1.raw
tcagagctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcgaggggcgttgacaatgctttggcctggtttcagcagacacgagggaacggcccctaagcgcctgatctatggtgcatactactttagacgtaaggtcggggtcccagtacgtaaggttcgaggcggacgtaggtaggtcgtagggactagtacgttcactctacactatcaggcggcctgcacgtcctaggaacgtcttctagtactaactttattactcgttactaccgtagtatagtacttcgtccttacccgtcggttaccgtttaccggaccgtaaacggggaaccgtaaagggttaacggtaaaactaccgaaaacgtaacgttcggtacggacttcgacctaccgtacg

SEQ ID NO: 136240 - DNA, 630 bp, Homo sapiens
  misc_feature: GYAE6OF01EATWC.47.48.E04.1.454.CMB.1.raw
  modified_base (194)..(194): a, c, t, g, unknown or other
  misc_feature (194)..(194): n is a, c, g, or t
tcagagctcacgtacacgaccggtgctcgatttagagagcgtcacagagagaagggggaatcagtcccactcaggacacagcatggacatgagggtccccgctcagctcctggggctctgctgctctggttccaggtgccaggtgtgacatccagatgacccagtctccatcctcctgtctgcatctgtagganacagatcaccatcacgttgccgggcgagtcgagggtcgttgacaatgtcgtttggccttggtttcagtcgacgacgaccgagggaacggaccccgtaaggccgtcctgactctagtggtcgacatactacgtttagacgtaaaggtcggggtacccagtacgtaaggttcacggcggtacgtaggtacgggtcgtacgggactaggtacgtttccgacgttctactacttacgtcgacggtccgtacctgacgtacgacccgtaggaacgttactttcgtacgtacttaactttactttacgtcgttacctacgtagttattacgtacttccgttaccgttacccgttaggttaccgttaccggaccggtaacgggtaccgtaagggtacgtaaaactaccggaaactacggtgtacggtacgtgtaccgactacg

SEQ ID NO: 136241 - DNA, 633 bp, Homo sapiens
  misc_feature: GYAE6OF01BW5G2.47.48.E04.1.454.CMB.1.raw
  modified_base (223)..(223): a, c, t, g, unknown or other
  misc_feature (223)..(223): n is a, c, g, or t
tcagagctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacgttgccgggngagtcagggcttgcaaatgctttggccttggtttcagtcagacaccgagggaacggccccgtaagcgcctgatctatggtgcatactactttgacgaaagtcggggtcccagtcgaaggttcagcggacagtaggtcgtagggacgaggtagttacgaagttctctaactagtacagtccggcctacgcgaacgccctaggtaaacgtactttcgtagtccgtaaactttaacttacgttcgttaccgttacctaagttaacttagtattcgtaccctttacccgtacgggttaccgtttaccggtaacccgtaaacggggtaaccctaaagggggttaacggtaaaacgttaccgaaaaaccggtaacgttacggttacggtaacctcggtaacccgaacccgttaacg

SEQ ID NO: 136242 - DNA, 507 bp, Homo sapiens
  misc_feature: GYAE6OF01DFHQF.47.48.E04.1.454.CMB.1.raw
  modified_base (266)..(266): a, c, t, g, unknown or other
  misc_feature (266)..(266): n is a, c, g, or t
  modified_base (371)..(371): a, c, t, g, unknown or other
  misc_feature (371)..(371): n is a, c, g, or t
  modified_base (382)..(382): a, c, t, g, unknown or other
  misc_feature (382)..(382): n is a, c, g, or t
  modified_base (389)..(389): a, c, t, g, unknown or other
  misc_feature (389)..(389): n is a, c, g, or t
  modified_base (402)..(402): a, c, t, g, unknown or other
  misc_feature (402)..(402): n is a, c, g, or t
  modified_base (417)..(417): a, c, t, g, unknown or other
  misc_feature (417)..(417): n is a, c, g, or t
tcagagctcacgtacacgaccggtgctcgatttagagagcgtcacagagagaaggggaggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcagggcgttgcaaatgctttggcctggttcagcagacncaggaaggccctaagcgcctgatctatggtgcatacactttgacaaagtcgggtccatacaaggttcagcggcagtaggtctgggacagagttcaactctcactntcagcgctgcngctgagnttctgctaacttnttactgtctcctatntgtatcgtcttacccgtgtacctttcggaccgaagggaacctaagggtcggaaaactacgtaaaacgaactacggtgactcgctaaaccg

SEQ ID NO: 136243 - DNA, 519 bp, Homo sapiens
  misc_feature: GYAE6OF01B5E98.47.48.E04.1.454.CMB.1.raw
  modified_base (394)..(394): a, c, t, g, unknown or other
  misc_feature (394)..(394): n is a, c, g, or t
  modified_base (397)..(397): a, c, t, g, unknown or other
  misc_feature (397)..(397): n is a, c, g, or t
  modified_base (400)..(400): a, c, t, g, unknown or other
  misc_feature (400)..(400): n is a, c, g, or t
tcagagctcacgtacacgaccggtgctcgatttagagagcgtcacagagagaaggggaggaatcagtcccactcaggacacagcatggacatgagggtccccgctcagctcctggggctcctgctgctctggttcccaggtgccaggtgtgacatccagatgacccagtctccatcctccctgtctgcatctgtagagacagagtcaccatccacttgccgggcgagtcagggcgttgcaatgctttggcctggttcagcagacaccagggacggccctaagcgcctgatctatggtgacatacactttgactaaaggtcgggtaccagtacaaggttcaggcggacaggtaggtcgtgggactagtacgttcactctcactatcagcgctgcngcngantctgactaacttattactgtctacgtagtatgatcgtccttacccgttcggtaccttcgggaccgtaagggaccctaagggtcgaaagtacaaacgtacgtacgtagcttcgctaaccg

SEQ ID NO: 136244 - DNA, 594 bp, Homo sapiens
  misc_feature: GYAE6OF01EZNBC.47.48.E04.1.454.CMB.1.raw
  modified_base (307)..(307): a, c, t, g, unknown or other
  misc_feature (307)..(307): n is a, c, g, or t
  modified_base (341)..(341): a, c, t, g, unknown or other
  misc_feature (341)..(341): n is a, c, g, or t
  modified_base (450)..(450): a, c, t, g, unknown or other
  misc_feature (450)..(450): n is a, c, g, or t
tcagagctcacgtacacgaccggtgctcgatttagagagcgtcacagagagaaggggctcagagaggagccttagccctggactccaaggcctttccacttggtgatcagcactgagcacagaggactcaccatggaattggggctgagctgggttttccttgttgctattttagaaggtgtccagtgtgaggtgcaattggtgcaatcgtgggggaggcttggtccagccgtggggggtccctcagactctcctgtgcagcctctggattcaccttttagttcctcttggatgaatttggggtccnccagactccgagggagggctggagtgggttgcanataatcagatggaagtcaagaaaacctagtgtacggactcgtcgtaggaagggcctagttccacctatcctaccgagacaacaacgaccaagaaccttctcttgtttcnacaaagtcggaacacggcctaggaagtacgtcgaaagaccgacggtcgttagtagttaacttacgttggttaggttcgttccttcgtcgacccggtcccgttccggggaccccggttaccgttgggtccgttttaccccggggg

SEQ ID NO: 136245 - DNA, 536 bp, Homo sapiens
  misc_feature: GYAE6OF01BLAYW.47.48.E04.1.454.CMB.1.raw
tcagagctcacgtacacgaccggtgctcgatttagagagcgtcacagagagaagggggaggaatcagtcccactcaggacacagcatggacatgagggtccccgctcagctccgtggggctcctgctgctctggttcccaggtgccaggtgtgacatccagatgacccagtcctccatcctccctgtctgcatctgtaggagacagagtcaccatcacgttggccgggcgagtcgaggggcgttgcaaatgtctttggcctggtttcagcagacaccaggggaacgcccctaagcgcctgatctatggtgcatacactttgacgaaaggtgggtaccatccaaaggttcaaggcggcagtaggtctgggactagagttcactctcactatcagcgctgcacgctagagtattctgctaacttatactgtctacctagttaatcgatcgtccttacccgtcggtacctttcgggaccgtaacgggtaaccgaaggtacggaaactacgaaacgtactaggtaggctcgactaacccg

SEQ ID NO: 136246 - DNA, 561 bp, Homo sapiens
  misc_feature: GYAE6OF01EH2E6.47.48.E04.1.454.CMB.1.raw
  modified_base (417)..(417): a, c, t, g, unknown or other
  misc_feature (417)..(417): n is a, c, g, or t
  modified_base (439)..(439): a, c, t, g, unknown or other
  misc_feature (439)..(439): n is a, c, g, or t
tcagagctcacgtacacgaccggtgctcgatttagagagcgtcacagagagaaggggaggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcagggtcgttgcaaatgcgtttgccgttggtttcagcagacaccgagggaacggcccctaagcgcctaggatctatggtgacatacactttgacaaagtcgggtccatctaaggttcagcgaacaggtagggtctgggaacgagtacgttcgactcttacactatcgagcgcctgccagcctagaagtnttctgacctaacttattacgtntcctactagtaattgattcgtccttacccgtcgttaccgttaccggaccggtaaggtaaccgaagggtacggtaaacgtaacgtaaacggtaaactacggtaaggtctacggcctaacccgg

SEQ ID NO: 136247 - DNA, 561 bp, Homo sapiens
  misc_feature: GYAE6OF01EWFUI.47.48.E04.1.454.CMB.1.raw
  modified_base (404)..(404): a, c, t, g, unknown or other
  misc_feature (404)..(404): n is a, c, g, or t
tcagagctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcaggggcgttgcaaatgctttggcctggtttcagcagacaccagggaacggcccctaagcgcctgatctatggtgcatacactttgactaaagtggggtcccagtcaaggttcagcggcaggtaggtcgtgggacaggtagttcacgtctcactatcaggtcgcctgcagcctgaatnttctgactaacttattactcgttactacctagtactgtattcgtaccctttacccgtcggttacctttccgggacccgtaaacggggtacccgtaaagggttacggaaaacgtacgaaaaccgtacgtacggttacggacctacgaccaccttaacg

SEQ ID NO: 136248 - DNA, 535 bp, Homo sapiens
  misc_feature: GYAE6OF01AE0BP.47.48.E04.1.454.CMB.1.raw
  modified_base (223)..(223): a, c, t, g, unknown or other
  misc_feature (223)..(223): n is a, c, g, or t
  modified_base (527)..(527): a, c, t, g, unknown or other
  misc_feature (527)..(527): n is a, c, g, or t
tcagagctcacgtacacgaccggtgctcgatttagagagcgtcacagagagaaggggaggaatcagtcccactcaggacacagcatggacatgagggtccccgctcagctcctggggctcctgctgctctggttcccaggtgccaggtgtgacatccagatgacccagtctccatcctccctgtctgcatctgtaggagacagatcaccatcacttgccgggngagtcagggcgttgcaaatgctttggcctggtttcagcagacaccgagggaacggcccctaagcgcctgatctatggtgacatacactttgacaaaggtcgggtaccatcgaaggttcaggcggcagtaggtcgtaggacagtacgttcactctcactatcagcgctcgcacgcctgaagtattctgactaactttattacttatctctaagttatgtatcgtcttacccgtccggtacgttccggaccgtaacgggacctaaagggtacggaaacgtacaaacggtaacgtaggtaggtccgngcctaccg

SEQ ID NO: 136249 - DNA, 673 bp, Homo sapiens
  misc_feature: GYAE6OF01CBJSD.47.48.E04.1.454.CMB.1.raw
  modified_base (224)..(224): a, c, t, g, unknown or other
  misc_feature (224)..(224): n is a, c, g, or t
  modified_base (366)..(366): a, c, t, g, unknown or other
  misc_feature (366)..(366): n is a, c, g, or t
tcagagctcacgtacacgaccggtgctcgatttagagagcgtcacagagagaagggggaatcagtcccactcaggacacagcatggacatgagggtccccgctcagctccgtggggctcctgctgctctggttcccaggtgccaggtgtgacatccagatgacccagtctccatcctcctgtctgcatcgtgtaggagacagactcaccatcacttggccgggngagtcgagggtcgttgcaaatgctttggcctggtttcagcagacaccgaggggacgaccccgtaagccggtcctggactctagtggtcgacatacactttgactaaggtcggggtacccatactaagggttcaacggcgganaggtgggactcgtagggactacggtattaccacttctacactaagtcacgtcgactccgcgcacggtactagtaacgttagtttttacggaaacttttacgttaagttacgtaacgtaaaccgttaagggggttaaccctaaacgggtttttccccgaccgtttaacctacccgggttttacccggggaacggggttacccgggaaacgggttaaccggggtttacgggaaggtaaacggtaaggtaaaacggttaacccgttagggtacggtaacgtaacggtaaccgtacccgtaagtttcccgg

SEQ ID NO: 136250 - DNA, 637 bp, Homo sapiens
  misc_feature: GYAE6OF01DO7K0.47.48.E04.1.454.CMB.1.raw
  modified_base (202)..(202): a, c, t, g, unknown or other
  misc_feature (202)..(202): n is a, c, g, or t
  modified_base (306)..(306): a, c, t, g, unknown or other
  misc_feature (306)..(306): n is a, c, g, or t
tcagagctcacgtacacgaccggtgctcgatttagagagcgtcacagagagaaggggaggaatcagtcccactcaggacacagcatggacatgagggtccccgctcagctcctggggctcctgctgctctggttcccaggtgccaggtgtgacatccagatcgacccagtctccatccctccctgtctgcatcgtgtagganacagagtccaaccatcacgttcggccgggcgaggtcgaggggtcgttgactaaagtgtcgtttggccgttgttcagcacgacaccgagggaacgcccgaagccncctagactcgtagtggtcgacatactacgtttagacgtaacggtcggtaccagtacgtacggttcgacgcggtcgaagttacggtcgtacggacgtagtacggttactacctactactaactacgtcgacggtccgtccgtcgacgtacgaccgttacgaacgttcttcgtacgtacttaacgtttacgttacgttcgaccttacgtaattacgtcgtaacgtccgtaaccgttccggtaccgttaccgttaccggaacggtaacgggtaaccggtaaggtacgtaaacgtaaccgaacggtaacgtcggtacgtcgtcgaccgttaaccg

SEQ ID NO: 136251 - DNA, 559 bp, Homo sapiens
  misc_feature: GYAE6OF01D3S2F.47.48.E04.1.454.CMB.1.raw
  modified_base (199)..(199): a, c, t, g, unknown or other
  misc_feature (199)..(199): n is a, c, g, or t
tcagagctcacgtacacgaccggtgctcgatttagagagcgtcacagagagaaggggaggaatcagtcccactcaggacacagcatggacatgagggtccccgctcagctcctggggctcctgctgctctggttcccaggtgccaggtgtgacatccagatgacccagtctccatcctccctgtctgcatctgtagganacagagtcaccatcacttggccgggcgagtcgagggcgttgacaaatgtctttggccttggtttcagcagacaccgagggacgccctagcgcctgatctatggtgctatactacgtttgacgtaaaggtcgggtacccagtacgtaacggttcaggcggtacgtaggtaggtcgtagggactagtacgttcactctactactatcgagccgcctgacacgcctagacgtattctagtacttaacttattacctcgtcctactagtatgtatcgtaccttacccgtcgtaccgttaccggaccgtaacggaccgtaaggtacgaaactacgaaacgtacgtacggtagcgtcgcgtaaccg

SEQ ID NO: 136252 - DNA, 663 bp, Homo sapiens
  misc_feature: GYAE6OF01A75ZG.47.48.E04.1.454.CMB.1.raw
  modified_base (380)..(380): a, c, t, g, unknown or other
  misc_feature (380)..(380): n is a, c, g, or t
tcagagctcacgtacacgaccggtgctcgatttagagagcgtcacagagagaaggggaggtctcagagaggacgccttagccctggactccaaggcctttccaccttggtgatcagcactgagcacagaggactcaccatggaattggggctgagctgggttttccttgttgctattttagaaggtgtccagtgtgaggtgcaattggtgcaaatccgtgggggaggcttggtccagccgtggggggtccctcgagactctcctgtcgcgacgccgtctgggattcctacccgttttacgttcctcgttggataggtaaagttgggtcccgcctagacctccgaagggagggcgtgggaggtgggttggcaacagtaaanccgagagtaggaagtcaagaaaacctagtgtacggactcgtacgtaggaacgggccgactttccgacctactcctccgaagtaacgaccgaaaccgccgaaagacctctccttagtttcgtagaccgtaaagtcggaacacgtccgtagaacggagtaccgaagaccgtaacggcgttaggttagtaacgtttaccgttaggttcggttacggttcccttacgtacggtacccggtccccggttacccggggtacccccggttcccggtttccgggtacccgg

SEQ ID NO: 136253 - DNA, 785 bp, Homo sapiens
  misc_feature: GYAE6OF01C14TO.47.48.E04.1.454.CMB.1.raw
tcagagctcacgtacacgaccggtgctcgatttagagagcgtcacagagagaaggggaggaatcagtcccactcaggacacagcatggacatgacgggtccccgctcagctccgtggggctcctgctgctctggttcccaggtgccaggtgtgacatccagatcgacccagtctccatccctcctgtctgcatcgtggtaggagacaggtatccaacctataccgtacgttcggcccggggcgaaggttcgaggggtcgttacgactaaagtcggtcgttttcggtccgtttcggtttaccgacggtaccgaacggaacccgaacccgggaacggggtaaacccgggacccccgtaaaacggcccggtacccttaggtaaccgttccgttaaggtcggggttacgtaccgtaaacttaccgtaacggttttacgaacggtaaacggggttccggggttaacccctaaggttaccggtaacggttcgaacggtccgggtacgtacgggttacgggttaccggtaggggaacgtaacggtacgtttaccgtaaccgttaccggtaccttaaccgttacgtaccggtaacgggtcccgggttcctacgggtacccgtacggtacccgtaaggtaacgttactttcgtacgtaaccttaactttacgttactacggttacctcgtaagtacgtgtaccgtcgtacccgtttaaccgtccggtacgttaccggacggtaacggaccgtaggtaacgtaacctaagaacgtaggtgaccggtctcgctacg

SEQ ID NO: 136254 - DNA, 636 bp, Homo sapiens
  misc_feature: GYAE6OF01CEWJT.47.48.E04.1.454.CMB.1.raw
  modified_base (198)..(198): a, c, t, g, unknown or other
  misc_feature (198)..(198): n is a, c, g, or t
  modified_base (224)..(224): a, c, t, g, unknown or other
  misc_feature (224)..(224): n is a, c, g, or t
tcagagctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatccctccctgtctgcatctgtagganacagagtcaccatcacttggccgggngagtcgaggggtcgttgcaaatgtctttggccttggtttcagcagacacgagggacgccctagcgctgatctagtggtgcatactacttgacgaaaggtcggggtcccagtacgtaacggttcgaggcggcgtaggtaggtcgtagggactaggtagttacacgtctactactactacgacggcggtcctcggacacgccgtaggaacgtacttacgtcgtaacctaacttttaactttacgttcgttccttaccgtaaggttacttacggtacttccggttacctttaaccccggttacggttaccggtttacccggaacccggtaacgggtaaccgtaaaggggttaacggtaaacgtaaccgtaaaacggtaacgtacgggtacggaccgtcgacccgtaccgttaacg

SEQ ID NO: 136255 - DNA, 565 bp, Homo sapiens
  misc_feature: GYAE6OF01B4KR6.47.48.E04.1.454.CMB.1.raw
  modified_base (294)..(294): a, c, t, g, unknown or other
  misc_feature (294)..(294): n is a, c, g, or t
  modified_base (302)..(302): a, c, t, g, unknown or other
  misc_feature (302)..(302): n is a, c, g, or t
  modified_base (353)..(353): a, c, t, g, unknown or other
  misc_feature (353)..(353): n is a, c, g, or t
  modified_base (390)..(390): a, c, t, g, unknown or other
  misc_feature (390)..(390): n is a, c, g, or t
  modified_base (418)..(418): a, c, t, g, unknown or other
  misc_feature (418)..(418): n is a, c, g, or t
tcagagctcacgtacacgaccggtgctcgatttagagagcgtcacagagagaaggggaggaatcagtcccactcaggacacagcatggacatgacgggtccccgctcagctcctggggctcctgctgctctggttcccaggtgccaggtgtgacatccagatcgacccagtcctccactccctccctgtctgcatctggtaggagacagagtcaccatcacgttgccggcgagtcgagggcgttgcaagtcgctttggcttggttcagcagacacgagggacgccctagcgccngatctagngtcgcattactacttgacgtaaaggtcggtaccagtcgaagttcgagcggnaggtaggcgtggaactgtagtcacgtctacacttacncgagccgctgacacgtaccgtagaactntttacgacgtactaaactttacgttaactcgttacctaccgtagtaatcggacttcgtcccttccgttacgtaccggtttccgaaccggtaacggtaaccgtaaggtcgaaatacccgtaaacgtcgttacggagctcgacctaacg

SEQ ID NO: 136256 - DNA, 583 bp, Homo sapiens
  misc_feature: GYAE6OF01D2HST.47.48.E04.1.454.CMB.1.raw
  modified_base (224)..(224): a, c, t, g, unknown or other
  misc_feature (224)..(224): n is a, c, g, or t
tcagagctcacgtacacgaccggtgctcgatttagagagcgtcacagagagaaggggaggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggngagtcagggcgttgcaaatgtctttggccttggtttcagtcagacaccgagggaaggcccctaagcgcctgatctatggtgcatactactttgactaaaggtcggggtcccagtcaaggttcaggcggcaggtaggtcgtgggacagtagttcactctacactatcagcgcctgcagcctagaagtacttctcggtacctaactttacttaacgttcgttacctaccgtaacgttatagtactcgttacccttacccgtcggttaccgtttccggaacccggtaaacgggtaaccgtaaacgggtacggtaaaacgtacgaaaaccgtaacgttacggtacgtacgtggacctaacccg

SEQ ID NO: 136257 - DNA, 657 bp, Homo sapiens
  misc_feature: GYAE6OF01CCKZ4.47.48.E04.1.454.CMB.1.raw
tcagagctcacgtacacgaccggtgctcgatttagagagcgtcacagagagaaggggaggaatcagtcccactcaggacacagcatggacatgagggtccccgctcagctccgtggggctcctgctgctctggttcccaggtgccaggtgtgacatccagatgacccagtctccatccctccctgtctgcatcgtgtaggagacagagtccaccatcacttgcgtgggcgagtcgagggtcgttgactaaagtgtcgtttcggtccttggtttcagcagaccgacgaagggacggaccctaagccgcctgactcgtagtggtgactatactacgtttgacgtaaacggtcgggtaccctagtacgtaaggttcgacggtcggacgtaggtaggtcgtagggactaggtacgttccacgttcctacgtactacgtccgaacggccggtcccgtggaccgacggttccgtaagtaaacggtctttacgacgtaaccttaaactttacgtttaaccgtcgttacccgttaccgtaaagttcgttacgttacctttacccgttacccggttaccggttaccgttacccgggaaccggtaaacgggtacgtaagggtacggtaaactaacgaaacgtacgtaggtacgtctcggactaaccg

SEQ ID NO: 136258 - DNA, 744 bp, Homo sapiens
  misc_feature: GYAE6OF01DQZQ4.47.48.E04.1.454.CMB.1.raw
tcagagctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtcctccatccctccctgtctgcatctgtaggagacagagtcaccatcacgttgtcgggcgagtcgagggtattagcaacgttggttacgccttggtaatcaaacgaacgaaaccgaaggaaaccgccccctaaccctcctcactctcctactcgcattccctactttacgaccgtaaaggtcggggtaccctagtccgtaaacggtttcgaacggccggacgtagggtcggtagtccggtaggggtactaagtacttttaccgaccgttacctactacttaactcaacgtcgtaacgtcccgtgaccgtacgcccgttaaggtaagtttaacgtttttaggtaaacctttttaagtttaacgtttacggttaacaaacgggttaacgggttaaccttaccggttttaccccgtacgtttcccgtaaccgtttaccgggggacgggtaaccggggaacccggtaaagggtacggggtaaagtaacgtaaacgggtaaaaacgttaacggttcggggtacgggtaccgtaacggaacccgttaacccgttagtttcccgttcgtttcccgtttaacccgg

SEQ ID NO: 136259 - DNA, 515 bp, Homo sapiens
  misc_feature: GYAE6OF01E2KRU.47.48.E04.1.454.CMB.1.raw
  modified_base (373)..(373): a, c, t, g, unknown or other
  misc_feature (373)..(373): n is a, c, g, or t
tcagagctcacgtacacgaccggtgctcgatttagagagcgtcacagagagaaggggaggtctcagagaggagccttagccctggactccaaggcctttccacttggtgatcagcactgagcacagaggactcaccatggaattggggctgagctgggttttccttgttgctattttagaaggtgtccagtgtgaggtgcaattggtgcaatctgggggaggcttggtccagcctggggggtccctcagactctcctgtgcagcctctggattcacctttagttcctcttggatgaagttgggtccgccagactccgagggaagggctggagtgggttggcaacataaatccagatggaagtcaagaaacctntgtggactctctgaagggccattcaccatctcagagacaacgccaagactctctgtttctgcaaagtggacagcctagagagtcgaagacacggctgtgtattcgtgtgtgtctctgaccgcctcggccggtccttggtccg

SEQ ID NO: 136260 - DNA, 579 bp, Homo sapiens
  misc_feature: GYAE6OF01DI0XW.47.48.E04.1.454.CMB.1.raw
  modified_base (428)..(428): a, c, t, g, unknown or other
  misc_feature (428)..(428): n is a, c, g, or t
tcagagctcacgtacacgaccggtgctcgatttagagagcgtcacagagagaaggggaggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttggccgggcgagtcgagggcgttgcaaatgctttggccgttggttcagcagacaccgagggaacggccctaagccgcctgactctatggtgctaatacactttgacgtaaaggtcgggtaccctatacgtaacggttcaggtcgggactaggtacgggtcgtgggaactaggtagttcacttctacactatcaggcgctgcacgctagagtnttctgaccttaacgttattacgtgttacctacctagtatagtacgttcgtacctttaaccccgtggttacccgtttaccggaccggtaaacgggaaccgtaagggtaacggaaactacgaaaccgtagttacggtagcctgccgtaaaccg

SEQ ID NO: 136261 - DNA, 629 bp, Homo sapiens
  misc_feature: GYAE6OF01CFFWJ.47.48.E04.1.454.CMB.1.raw
tcagagctcacgtacacgaccggtgctcgatttagagagcgtcacagagagaaggggaggaatcagtcccactcaggacacagcatggacatgagggtccccgctcagctcctggggctcctgctgctctggttcccaggtgccaggtgtgacatccagatgacccagtctccatccctcctgtctgcatctgtagagacagagtcaccatccacgttcggccgggcgaggtcgaggggtcgttgacaaatgtcgtttggccttggttcagtcagacaccgagggaacggccctaagccgctgactctagtggtcgcatactacgtttagacgtaaaggttcgggtacccagttacgtaacggttcgacggccggacgtaagggtacgggtcgtaggggaactaggtacgttcctacgtcctactacttactctacgtccggcctcgacgacgtccgtagaacgtacttccgtacgtaccttaactttacgttaccttcgttacctaccgtagttagtcgtacgttccgtaccgttacccgttcggtaccgtttaccggaccggtaacgggtaaccgtaagggtacgtaaacgtaaccgaacgtacgtggtacgtcgtacgacctaccg

SEQ ID NO: 136262 - DNA, 591 bp, Homo sapiens
  misc_feature: GYAE6OF01D8MZW.47.48.E04.1.454.CMB.1.raw
  modified_base (314)..(314): a, c, t, g, unknown or other
  misc_feature (314)..(314): n is a, c, g, or t
tcagagctcacgtacacgaccggtgctcgatttagagagcgtcacagagagaaggggaggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatccacgttggcccgggcgagtcgaggggtcgttgcaaatgtctttggcctggtttcagcagaccaccgagggacggcccctaaggccgcctgatctagtggtncatactactttgacgtaaacggtcgggtacccatcgaaggttcaggcggacaggtaggtcgtgggacaggtacgttcactctaccaccatcagctacgtctacgactaaccgtgtaacgtatttacgactaaccttactactgtaccaacgtagtaacgttaccggtaccccgttacgtaccgtttcggacccgtacgggaccctaaacgtacggtaacgactaacgaaaccggtaacgtacggtacggtacgtacaccgtacctagtcgttaccgg

SEQ ID NO: 136263 - DNA, 727 bp, Homo sapiens
  misc_feature: GYAE6OF01EA056.47.48.E04.1.454.CMB.1.raw
tcagagctcacgtacacgaccggtgctcgatttagagagcgtcacagagagaaggggctcagagaggagccttagccctggactccaaggcctttccacttggtgatcagcactgagcacagaggactcaccatggaattggggctgagctgggttttccttgttgctattttagaaggtgtccagtgtgaggtgcaattggtgcaatcgtggggggaggcttggtccagccgtggggggtccctcagactctcctgtgcacgcctctggtattccaccttttagttcccttcttggattggtaagtttcggggtcccgccagactccgaggggaaggggctgggagtgggttggacaacataaatccgagagtaggaacgtacaaacgaaaacctagtgtagggactcttacgtggaacgggtccgtaagttccaaccctatccgtaccaacggactaaccgaaacggacccaaagaaccgttacccttaccgtttacgtttaccgtcgtaactaaacgtcggaaccgtacggtacccgttaggaacggtaacgttaccggaaacgaccggaaccgggttacgttacgggttacgtttaaacgttttaccggttaggttacggttcggttcccgttaccgttacggaaccccgggttccccggttaccccggggttaccccggggttaccccggtttttccgggtccggtttttacccccgggggg

SEQ ID NO: 136264 - DNA, 529 bp, Homo sapiens
  misc_feature: GYAE6OF01AMX7L.47.48.E04.1.454.CMB.1.raw
  modified_base (346)..(346): a, c, t, g, unknown or other
  misc_feature (346)..(346): n is a, c, g, or t
  modified_base (514)..(514): a, c, t, g, unknown or other
  misc_feature (514)..(514): n is a, c, g, or t
tcagagctcacgtacacgaccggtgctcgatttagagagcgtcacagagagaaggggaggaatcagtcccactcaggacacagcatggacatgaggtccccgctcagctcctggggctcctgctactctggctccgaggtgccagatgtgacatccagatgacccagtctccatcctccctgtctgcatctgtaggagacagagtcacatcacttgccggcaagtcagagcattaacagcgatttaatgtatcacagaaacaggaacgccctaactcctgatctatgctgctatccagtttgctataggtcgggtaccatctagtcagtgcagtgatgtggcagtnttcactcgacactatcagctagtcgtacgacaccgtgtaagtacttttcgactaacttactactgtaccaactagtacgttaaccggtacccttactacgtttggaccctaaggggacctaaacgtcggaaccagtttaacccgaaacgttacgtacggtaggtaccncggtaccaccgtacg

SEQ ID NO: 136265 - DNA, 595 bp, Homo sapiens
  misc_feature: GYAE6OF01C7XG7.47.48.E04.1.454.CMB.1.raw
tcagagctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtagagacagagtcaccatcacttgccggcgagtcagggcttgcaatgcttggcctggttcagcagacacgaggaacgccctaagcgcctgatctatggtgacatacactttgacctaaaggtcggggtacccagttacgaaaggttcgaacggcggacaggttaacggtcgtagggaacaggtacgttcaacgtctacgacttatcgagcgggctaggctacgcctagtaagtattcgtagtactaacgtttattacgttacgttcttacccgaagttagtacgaacgttcgtacctttaacccgttcggtaccgtttaccggaccgtaaacggggtaacccaagggttaacggtaaacgttaccgaaaacggtaacttagggtacgacgtacgccacgttaac

SEQ ID NO: 136266 - DNA, 780 bp, Homo sapiens
  misc_feature: GYAE6OF01DAM0U.47.48.E04.1.454.CMB.1.raw
tcagagctcacgtacacgaccggtgctcgatttagagagcgtcacagagagaaggggaggtctcagagaggagccttagccctggactccaaggcctttccacttggtgatcagcactgagcacagaggactcaccatggaattggggctgagctggttttccttgttgctatttagaaggtgtccagtgtgaggtgcaattggtgcaatcgtgggggaggtcgttggtccagccgtggggggtccctcgacggactcctccgtgtcgcacggcctcgtggtattcctaccttttacgttccttcgttggtattaggtaacgtttcgggggtacccgtaccgaacggtaccttaccggaacgggggtaaacggggggtccgttaggggtagggttagggggttcgggaccgaaaaccgtaagttaaaacttaccgaaggtaacgtagggtaacggtacaaacgaaaaccgttagtacggtaggtaccttcgtacgtacgggaacggggcctacgtaccaccctatacctaccgaagacgaacgaaccgaaccgtaaacgtaacctctaccgtttagttacctagacgtaatacggaaccacgtaccgttaggaacgtaacggtacccggaaaggtaccgtacgggtaccgttagggttaaacggtttacgttaacgttcgggtttagttaccggttccggttacccgttacggtaccccggggtccccggttacccggggtacccccgggttaaccggtttcccggggtttaccccgggg

SEQ ID NO: 136267 - DNA, 703 bp, Homo sapiens
  misc_feature: GYAE6OF01CC6MN.47.48.E04.1.454.CMB.1.raw
tcagagctcacgtacacgaccggtgctcgatttagagagcgtcacagagagaaggggaatcagtcccactcaggacacagcatggacatgagggtccccgctcagctcctgggctcctgctgctctggttcccaggtgccaggtgtgacatccagatcgacccagtctccatcctccctgtctgcatctgtaggagacagagtcaccatcacttgccggcagtcagggtcgtgcaatgcttggcctggttcagcagacacgagggacgacccctagcgctgatctagtgtgctacgtactacgtttgacgtaaaggttcggggtacccagtaccgtaaagggttcaacggccggtacgtaaggttacgggtacgtacgggtacgtaacggtacgtttaccgaccgttcctaccgtaacgttacgttaccggacggaccccggttaccgtacggtaccgtacggtaccccgtaagggtaaacgttaaccgtttcgtaccggtaacctaaacgttttaacgttacgttaccggttacttacccggtaacggttaacttcggtaactttccggtacccttacccgggttaccggtaaccgttttaccgggaaccccgtaaagggaacccgttaagggtaacggaaaacgttaaccgtaaaaccggtacgttacggttacggaccgttacgtaccgtacccgttacg

SEQ ID NO: 136268 - DNA, 570 bp, Homo sapiens
  misc_feature: GYAE6OF01E3WUK.47.48.E04.1.454.CMB.1.raw
  modified_base (198)..(198): a, c, t, g, unknown or other
  misc_feature (198)..(198): n is a, c, g, or t
tcagagctcacgtacacgaccggtgctcgatttagagagcgtcacagagagaagggggaatcagtcccactcaggacatagcatggacatgagggtcccccgctcagctcctggggctcctgctgctctggttcccaggtgccaggtgtgacatccagatgacccagtctccatcctccctgtctgcatctgtagganacagagtcaccatcacttggccgggcagtcaggggcttgcaatgctttggcctggtttcagcagacaccgagggacggcccctaagccgcctgatctagtggtgcatactacgtttgacgaaacggtcggggtacccagtacgtaaggttcaggcggcgtaggtaggtcgtagggacaggtacgttccactctcactatcgacgccggcctcgcacgcctagaacgtattcgtgactaacttacttacttcgtcctacgtagttatagtacgttcgtaccgttacccgttcggtaccgtttccggaaccgtaacgggtaccgaagggtacggaaactaccgaaagtacgtacgtcggtactcgacacctacg

SEQ ID NO: 136269 - DNA, 536 bp, Homo sapiens
  misc_feature: GYAE6OF01DEFVF.47.48.E04.1.454.CMB.1.raw
  modified_base (223)..(223): a, c, t, g, unknown or other
  misc_feature (223)..(223): n is a, c, g, or t
  modified_base (403)..(403): a, c, t, g, unknown or other
  misc_feature (403)..(403): n is a, c, g, or t
tcagagctcacgtacacgaccggtgctcgatttagagagcgtcacagagagaaggggaggaatcagtcccactcaggacacagcatggacatgagggtccccgctcagctcctggggctcctgctgctctggttcccaggtgccaggtgtgacatccagatgacccagtctccatcctcctgtctgcatctgtaggagacagagtcaccatcacttgccgggnagtcagggcgttgcaaatgctttggccttggtttcagcagacaccgagggaacggcccctaagcgcctgatctatggtgcatacactttgacaaaggtcgggtacccagtcgaaggttcagcggcagtaggtcgtgggacagagttcactctcactatcgagcgctgcacgcctagaagnttctgtactaactttattaactcgttctaccgtagtactgtattcgtactttacccgtcggtacctttcgggaccgtaaacggggacctaaagggtacgaaactacgaaacgtacgtagtggactgctaaccg

SEQ ID NO: 136270 - DNA, 865 bp, Homo sapiens
  misc_feature: GYAE6OF01B0L5P.47.48.E04.1.454.CMB.1.raw
tcagagctcacgtacacgaccggtgctcgatttagagagcgtcacagagagaaggggaggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttggccgggcgagtcagggcgttgcaaatgctttggccttggtttcagcagacaccgacgggaacggcccctaagccgcctgatctagtggtgcatactactttgacgtaaacggtcgggtaccctaagtccgtaaacggttcgaaggtccgggtacgtaagggttacgggtacgttacgggggaacgtaaggtacgttaccgtaaccgttccttaccgtaaccgttaacgtccgaacggtcccgggtaccccttaggacccgtacgggtaccccgttagggaaaaccggttacgttttacccgtacggttaccccttaaaacgtttttaaccgttttaacccgtttaccgggtttacccgtttaaccccggttaaaggtttaaacgtttacccgggtaaagttttccccgggttaaccccggtttttaaccccccgttaccccggggtttaaaccccggttttttaacccgggggtaaccccccgggtaaaaacggggggtaaaacccccgggttaaaacggggggtttaaaccgggtaaaaaacccgtttaaaaacccggttaaaaaaccccgggttaaaacccggttacggggttaaacccggggttaacccggtttaacccgggtaacccccgttaaaacccccgg

SEQ ID NO: 136271 - DNA, 563 bp, Homo sapiens
  misc_feature: GYAE6OF01BIWSY.47.48.E04.1.454.CMB.1.raw
  modified_base (315)..(315): a, c, t, g, unknown or other
  misc_feature (315)..(315): n is a, c, g, or t
  modified_base (414)..(414): a, c, t, g, unknown or other
  misc_feature (414)..(414): n is a, c, g, or t
tcagagctcacgtacacgaccggtgctcgatttagagagcgtcacagagagaagggggaggaatcagtcccactcaggacacagcatggacatgagggtccccgctcagctcctggggctcctgctgctctggttcccaggtgccaggtgtgacatccagatgacccagtcctccatccctccctgtctgcatcgtagtaggagacagactcaccatcacgttcggccgggcgagtcgaggggcgttgcaaatgtctttggccttggttcagcagacaccgagggacgacccgtaagcgtcctgatctagtggtncatactactttgacgaaaggtcgggtacctagtacgtaaggttcagcggacgaggtaggtcgtgggacagtacgttcactctcactagcaggcgctgcngctagaagtctctgtactaactttacttactgtacctacgtagtatagtactcgtaccttaccgtaccgttaccgttaccgggaccgtaaacggggtactaacgggtacggaaactacgaaaacgtacgtggtacggcttgccctaacg

SEQ ID NO: 136272 - DNA, 528 bp, Homo sapiens
  misc_feature: GYAE6OF01DXXLJ.47.48.E04.1.454.CMB.1.raw
  modified_base (402)..(402): a, c, t, g, unknown or other
  misc_feature (402)..(402): n is a, c, g, or t
tcagagctcacgtacacgaccggtgctcgatttagagagcgtcacagagagaaggggaggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttggccgggcgagtcgagggcgttgcaaatgtctttggccttggtttcagcagacacgagggaaggcccctaagcgcctgatctatggtgcatacactttgcaaaggtcgggtcccaatcgaaggttcaggcggcagtggtcgtggacagacgttcactctcactatcagcgcctgcacgctgaatnttctagactaacttattactgtcctacctagtattgatcgtacctttacccgtcggtacctttcgggaccgtaagggacctaagggtacgaaaactacgaaacgtactaggtagctacgctaaccg

SEQ ID NO: 136273 - DNA, 581 bp, Homo sapiens
  misc_feature: GYAE6OF01ED7G1.47.48.E04.1.454.CMB.1.raw
  modified_base (199)..(199): a, c, t, g, unknown or other
  misc_feature (199)..(199): n is a, c, g, or t
tcagagctcacgtacacgaccggtgctcgatttagagagcgtcacagagagaagggggaggaatcagtcccactcaggacacagcatggacatgagggtccccgctcagctcctggggctcctgctgctctggttcccaggtgccaggtgtgacatccagatgacccagtctccatcctccctgtctgcatctgtaggnacagagtcaccatcacttgccgggcgagtcgagggtcgttgcaaatgctttggcctggtttcagcagacaccgagggaacgcccctaagccgcctgatctagtggtgctatactctttagacaaaggtcggggtcccaatcgtaaaggttcaaggcggcgaggtacggtcgtggggaactagtaggttcacgtcctacgactatcgagccggtcctgcctacgaccgtagaagtactttcgagtacctaacttacgtttactcgtctccgaagttattgattcgactttacccgtcggttaccttacgggaccgtaacgggacggtaacggtacggtaaacgtaacgtaaaccgacggttacggaggtcgtacgcgtaaccg

SEQ ID NO: 136274 - DNA, 661 bp, Homo sapiens
  misc_feature: GYAE6OF01EER98.47.48.E04.1.454.CMB.1.raw
  modified_base (347)..(347): a, c, t, g, unknown or other
  misc_feature (347)..(347): n is a, c, g, or t
tcagagctcacgtacacgaccggtgctcgatttagagagcgtcacagagagaaggggctcagagaggagccttagccctggactccaaggcctttccacttggtgatcagcactgagcacagaggactcaccatggaattggggctgagctgggttttccttgttgctattttagaaggtgtccagtgtgaggtgcaattggtgcaatcgtgggggaggcttggtccagccgtggggggtccctggagactctcctgtgcagcctctggactcacctttagcaactctgtcagtgggcgtggggtccgccgaggcgtccggggaagggctggagtgggtctcaagtntgatgagaagtggtaggaagcactattctacggtggaactccggtaggaacgggtcccggttacacctatcctacccgagaacgtactaaagtttccgaagggtacgcgtaccgcgttaggttaactacgtaaacaaaagttacggaaacctacggtaccccgttaaggacggtaacggacccggaaggtaaccggaacccgggtacccgttaaagtttaccgttttcgttaggttacggaaccgggttaaaacgttaccgttaaagttacgggaaccctacgggttcccgtcccccccgtacggtacccccgg

SEQ ID NO: 136275 - DNA, 628 bp, Homo sapiens
  misc_feature: GYAE6OF01ARW6I.47.48.E04.1.454.CMB.1.raw
tcagagctcacgtacacgaccggtgctcgatttagagagcgtcacagagagaaggggaggaatcgagtcccactacaggacacagcatggacatgagggtccccgctcagctcctggggctcctgctgctctggttcccaggtgccaggtgtgacatccagatgacccagtctccatcctccctgtctgcatctgtaggagacagagtcaccatcacttcggccgggcgagtcagggcgttgcaatgctttggcctgttcagcagacaccgagggacgccctaagcgcctgatctagtcgtgacagtactacgtttgacgtaaaggtcgggtacccagttacgaacggtttacacggtcggcgaagggttaggtccgttaggggaactaggtacgtttacacgttacctacctacgttataccgaggccggtcctacgcacgtccgtagaacgtacttcagtctaactttacttactcgttaccgtaccgtagttataggtacttaccgtacccttacccgtccggttaaccgttaccgggaccggtaacggggtaacccgtaaagggtacggtaaaacttaacccggaaacgtaaccggttaggtaccggacttcgtacccgtaacc

SEQ ID NO: 136276 - DNA, 924 bp, Homo sapiens
  misc_feature: GYAE6OF01BI291.47.48.E04.1.454.CMB.1.raw
tcagagctcacgtacacgaccggtgctcgatttagagagcgtcacagagagaaggggaggtctcagagaggagccttagccctggactccaaggcctttccacttggtgatcagcactgagcacagaggactcaccatggaagttgggctgagcgttgggttttccttgttgcttattttagaaggtgtcctagtgtgaggtgctaattggtgcaagttcggtggggggaggtcgtttcgggtccgacggtcccgggttcgggggggttcccctcgacgtaccttccgttccgtggtcgcacgtccctcgtggtactttaccttaccgttttacgttcccttcgttggtagttacggtaacggttcggggtccgtaccgtaacggtaccgttaccgggaaggggggtaacggggtcgttacggggtaggggttagggggtttacggaaccgtaaacgtaaagttaaaacgtaccgaaaggtaaggtagggtaaacgtacgaaaacgtaaaaccttaggtacggttacggtaccttacgtacgtagggtaacggggtacccgtactttaacccgaccgtaattccctaacccggaaggtaacccgaaccgaaaacccggacccgtaaaacgttacccttaccgtttaccgttagttttacccgtaagtaaaccgtaaagggtttaccggaaccgtacgtaccgggttaaggtaacggtaaccgggttaaccggtaaacggaacccgggttaccggggttacctttaaacgggttttaccggtttaaaacgttttccggttagggtttaccggttacggttttaccccgttaccgggttacccgggtaacccccgggttaccccggggtttacccggggggtacccccccgggtttaaccgggttttcggggttaacccccggggg

SEQ ID NO: 136277 - DNA, 700 bp, Homo sapiens
  misc_feature: GYAE6OF01AUM1N.47.48.E04.1.454.CMB.1.raw
  modified_base (223)..(223): a, c, t, g, unknown or other
  misc_feature (223)..(223): n is a, c, g, or t
tcagagctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttggccgggngagtcgaggggcttgacaaatcgtcgtttggccttggttcagcagaccaccgacgggaacgcccctaagccgcctgatctagtggtgactatactactttgacgtaaaggtccggggtaccctagtaccgtaagggttccgacgggtccggacgtacggttacgggttcgtaggggacgtaaggtacggttacctaccttactacctacttacgtaccgaggtcccggtccgttcggaccacggtcctaggtaacgtacgttccgtacgtacttaactttacgtttaccgttacgttaccttaccgtagttactacgtacgttcgttaccccgtttaacccgttccgggttaacccgtttaccgggaacccgttaaaccggggtaacccgttaaacggggtaacggtaaaacccgttaaccgaaaaccggtaccgttacgggttcggtaccgtcggtaacccgtaacccggttacgg

SEQ ID NO: 136278 - DNA, 660 bp, Homo sapiens
  misc_feature: GYAE6OF01B0MTL.47.48.E04.1.454.CMB.1.raw
  modified_base (104)..(104): a, c, t, g, unknown or other
  misc_feature (104)..(104): n is a, c, g, or t
  modified_base (242)..(242): a, c, t, g, unknown or other
  misc_feature (242)..(242): n is a, c, g, or t
tcagagctcacgtacacgaccggtgctcgatttagagagcgtcacagagagaagggggaatcagtcccactcaggacacagcatggacatggacgggtccccgntcagctccgtggggcctcctgctgctctcggttcccaggtgccaggtgtgacatccagactcgacccagtcctccactccctccctgtctgcatcgtaggtaggagacagacgtccaacctatcacgttcggccgggngaggtcgacggggtcgttagactaaagtggtcgttcggtccttggtttcaggcagaccgaaccgagggaaccgtacccgtaagccgcctcgactcgtagtggtcactacgtactacgttagacgtaagggttccgggtaccagtacgtaacggttcacggtcgacgtaggtaacggtcgagggactagtacgttccgacttccgtactaccgtatccggacggtccggtacctggacctacgtaccgtagtaagtacttcgtacggaactttaacgttattaccgtagttacctacgtaagtttcgtagtcgttacgtacccgtttaaccgcggtttaccgtacggaaccggtaaacgggaccgtaaggtacgtaacaaaccgtaacgtacgttacgcggacctacgacctaacgtcg

SEQ ID NO: 136279 - DNA, 554 bp, Homo sapiens
  misc_feature: GYAE6OF01BQR28.47.48.E04.1.454.CMB.1.raw
tcagagctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatccctccctgtctgcatctggtaggagacagatcaccatcacttggccgggcgagtcgaggggtcgttgacaaatgtctttggccttggtttcagcagacaccgagggacggccctaagcgctgatctagtggtgcatactactttgacgtaaaggtcggggtacccagtaccgaaggttcgaggcggcgaggtacggtcgtgggacaggtattcactctctactatcgagccgctcgcacgcctagaagtacttctgtacttaactttacttactgtaccaacgagtaccgttaccggtaccctacgttacgttcggaccgtacggtaccaacgtcgacactacgaaacgtacgtgtacggctacgacctactgtcgttcg

SEQ ID NO: 136280 - DNA, 757 bp, Homo sapiens
  misc_feature: GYAE6OF01BHTA1.47.48.E04.1.454.CMB.1.raw
  modified_base (278)..(278): a, c, t, g, unknown or other
  misc_feature (278)..(278): n is a, c, g, or t
tcagagctcacgtacacgaccggtgctcgatttagagagcgtcacagagagaaggggaggaatcagtcccactcaggacacagcatggacatgagggtccccgctcagctcctggggctcctgctgctctggttcccaggtgccaggtgtgacatccagatgacccagtctccatcctccctgtctgcatctgtaggagacagacgtcaccatcacttggcgggcgagtcaggtattagcaatggttagcctggtatcaacagaaaccgagggaaacncccctaacctcctcatctctactgctactcctacttttcggactaaaggtcggggtacccctagtaccgaacggtttcgaacggcgggacctaagggttacgggtacgtcggttacggggaaccgtaaggtacttttaccgaacctttccttacctacttaacttccgtacgccgtaacgcccgttacggaccgaccgtccgtaagtaaacggttacttttttaagggtaaaccttttaagtttaacgtttacgttaacgtaaaccgtaacggggtttaaacctaccgggtttttacccccgtaccgtttacccgtaacccggtttccgggggaacccggggtaacggggtaaaccccggtaaaggggttaacggggtaaacgggtaacgttaaaggggaaaaacggttaacggttacggggttacggtaccggttaaccggacctaacccgtaacgtttccgttacggttttaacccg

SEQ ID NO: 136281 - DNA, 902 bp, Homo sapiens
  misc_feature: GYAE6OF01BXNTC.47.48.E04.1.454.CMB.1.raw
tcagagctcacgtacacgaccggtgctcgatttagagagcgtcacagagagaagggggccttagccctggactccaaggcctttccacttggtgatcagcactgagcacagaggactcaccatggaattggggctgagctgggttttccttgttgctattttagaaggtgtccagtgtgaggtgcaattggtgcaatctgggggagcttggtccagccgtgggggtccctcgagactctcctgtgcagcctcgtggtattcctaccttttacgttccttcgttcggtataggtaagttcgggtacccgccgtagacctaccggaggggaacggggtcgtgggtaggtggggttacggacaacgaagtaaacgtaccgtaagaagttagggaacgtacgaaacgtaaaacctagtacggtacggtaccttacgtacgttacggaacggggtacccgtaagtttaccgaacccgtaacgtacccgttaccgaaggttaaccggaaacccgaaaacccggtaccccgtaaaaacgggttaaaccctttacccgttacgttttacgggtttttaacccgacgggttaaacccttaaaaacgggtttccgggaaacccttaacgggtaccccgtttaggaaccgggttaggtaaaccgaaaccggttaaccggaccggggtttaaccgttagggtttaacggtttaacctttaaccgggttcggttaaacgggtttcggttaaccccgtttacggtaccggggttaacccgtccccggggtttaaacccggggtcccggggtttaaaccccgtttggggttacccccggttttcggggttacccggggggtaaccccggttttacccggggggtaaaacccccgtttccggggtttaaaccccccgg

SEQ ID NO: 136282 - DNA, 738 bp, Homo sapiens
  misc_feature: GYAE6OF01BQVQ6.47.48.E04.1.454.CMB.1.raw
tcagagctcacgtacacgaccggtgctcgatttagagagcgtcacagagagaagggggaatcagtcccactcaggacacagcatggacatgagggtccccgctcagctcctgggctcctgctgctctggttcccaggtgccaggtgtgacatccagatcgacccagtcctccactcctccctgtctcgcatctggtaggagacagacgtcactatctacgtcggccggcgacggtcgagggtcgttagacgtaatgtcgtttcgtccgttggttcagtacacgaccgacgaggggaaccgacccgtaagccgctgtactcgtagtcggtcgtactacttaacttacgttacggaacgtaaacgggtccggggtacctaagttacggtaacgggttacgacgggcggtacggtaacgggttacggtacgggtacgggaacgtaggttacgtcgtaccttccgtacctaacgttacgtaccggtaccggtcccggtaccgtacggaccgtacgcccgtaagtaacgttaaccgttcttaacgtaaccctttaacgtttaccgttacgttccgtaccttacgtacgtttagttacgtacgttaccgttaccgttaccccggttacggttaccgtttaccccgggaaaccgtaacgggtaaaccggtaaagggttaacggtaaaaccgtaaccgtaaaccggttcggtacgtacggttaccgtacgaacgttacgttaaccg

SEQ ID NO: 136283 - DNA, 571 bp, Homo sapiens
  misc_feature: GYAE6OF01DODEA.47.48.E04.1.454.CMB.1.raw
tcagagctcacgtacacgaccggtgctcgatttagagagcgtcacagagagaaggggaggaatcagtcccactcaggacacagcatggacatgagggtccccgctcagctcctggggctcctgctgctctggttcccaggtgccaggtgtgacatccagatgacccagtctccatcctcctgtctgcatctgtaggagacagagtcaccatcacttgccgggcgagtcgagggcgttgacaaatgtctttggcctggttcagcagacaccgagggaacggacccctaagccgccgtgatctagtggtgacatactacgtttgactaaaggtcgggtaccatacgaaggttcacgcggacgtaggtaggtcgtaggacaggtacgttcactactactactatacgacggtccggtctgcacgcctagtaatattctgactacttattacttgtaccttcctagtatgtatcgtaccttacccgtacgtaccgtttccggaaccggtaaagggtacccgtaagggtaacggtaaactacgaaaacgtacgtaggtcgacctgtccgtaacccg

SEQ ID NO: 136284 - DNA, 730 bp, Homo sapiens
  misc_feature: GYAE6OF01AKVNL.47.48.E04.1.454.CMB.1.raw
tcagagctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatcgacccagtctccattccctccctgtcctgcattctgtaggagacagacgtcaccatcacgttggacccgggcgaggtccgaggggtcgttagacctaaagtcgtcgttttcggccttggtttcagtcgacgaccaccggaacggggaacggcccctaacggccgccgtgattctagtggtcgctatactactttagacgtaaacggttcggggtaccctagttacgtaacggttcgaaggcggcgtacggtagggttcgtaggggacaggtaacgttccacttcgtactacgttactacgacggtccggcctcggtccacgtcccgtaagtaacgtcgtttcgacgtaacctttaacgttacgtttaacgttcgttacctaccgtagttaccgtacgtacgttacctacccggtttaaccccgttacggggttaccccgtttaaccgggaacccgggtaaaccggggtaaccggttaaacggggtaaaccggtaaaaccgttaacccggtaaaaacggtaccggtttacgggtaccggtaccgtaccggaacccgtaaccctttaccggg

SEQ ID NO: 136285 - DNA, 803 bp, Homo sapiens
  misc_feature: GYAE6OF01B9OC8.47.48.E04.1.454.CMB.1.raw
tcagagctcacgtacacgaccggtgctcgatttagagagcgtcacagagagaaggggaggtctcagagaggagccttagccctggactccaaggtcctttccacttggtgatcagcactgagcacaggaggactcaccagtggaagttggggctgagtcgttgggttttcttgttgtcttagtttagaaggtgtccagtgtgaggtgctaagttggtgctaagttcgggtggggggacggtcgtttcggtccgaggtccggtcggggggttccctcgacgtacctccgtccgtggtcgcgacgtcctcgtcggtacttccttaccgttttacgttcccgttacgttggtataggtaacgttccgggtcccgtaccgacgtccgtaccgggaaggggtacgggtcggtggggtagggttcggggtacggacctaacgtaactaaacgtccgaagtaagtaggtaaacgacgtaaaacgtaaaccgttggtacggtacggtacgttcggtacgtacgggacggtccgttaatccgtaacctatttcccgaccgaaggtaacccgaaacccggtaaccgtaacctaaaccgtccctttacgtttccttacgttttaaccgactaaaccgtaaggtcgaacccgtacggtacgttacgaaggtacgtaacggacgtaaccggtcgggttattacgggttaagttccgttacggttgggttacccgtttggtacccgtttagggaccccggttacccgggttccccggttaccggggtaaccccggtttcccgggttccggtcccggg

SEQ ID NO: 136286 - DNA, 653 bp, Homo sapiens
  misc_feature: GYAE6OF01EV85S.47.48.E04.1.454.CMB.1.raw
  modified_base (336)..(336): a, c, t, g, unknown or other
  misc_feature (336)..(336): n is a, c, g, or t
tcagagctcacgtacacgaccggtgctcgatttagagagcgtcacagagagaaggggaggaatcagtcccactcaggacacagcatggacatgacgggtccccgctcagctcctggggctcctgctgctctggttcccaggtgccaggtgtgacatccagatgacccagtcctccatccctccctgtctgcatcgtgtaggagacagagtccaccatcacgttcggccgggcgagtcgaggggcgttgacaaagtgtcgtttcggtccgttggtttcagcgaacgaccgaccgacggggaacggccccgtaaggccgccgtgtactcgtagtggtnacgtactactacgtttagacgtaacggtcgggtaccctagtacgtacggttacgacggcggactagggttacggtcgtacgggaacacggtacgttcacgtccttacgacttacgtcgacggtccggcctagcgtacgtccgtagacgttacgttcctacgtaacttaactttagttaccgttacgtacccttacgtagttacgttagtacgttcgtaccctttacccggtaccggttaccgtttaccggaacggtacggtaaccggtaggtaacgaacgtaccgaaacgtacgttaggtacgtacctgacctaacg

SEQ ID NO: 136287 - DNA, 969 bp, Homo sapiens
  misc_feature: GYAE6OF01DPAWV.47.48.E04.1.454.CMB.1.raw
tcagagctcacgtacacgaccggtgctcgatttagagagcgtcacagagagaaggggatcagtcccactcaggacacagcatggacatgagggtccccgctcagctcctgggctcctgctgctctggttcccaggtgccaggtgtgtacatccagtattcggaccctagtctccactccctccctgtctgctatcgtggtaggagacgagtacgtccaccgatccgtacgttcggacccgggtcgacgtccggaggggtccgttacgaccgtaaagttcggtcgttttcgggtccctttacgggttttaccacggtaccgaacgaacccgtaacccggaacgggggtaaaacccggtaccccccggtttaaaacggcccccggtacccgttacggtaaccgtttacccgttaaaggttcggggttacgaccggttaacgtttaacccggttaaccgttttacgggaaacccggttaaaacggggtttcccgggggttaaccccgttaaacggttaaccggggttaaaacggggtttaccggaacgggtcccgggtaacggtaaacggggtttacggggttaaccggttaccggggtaaccgtaagggttaacccggtttacccgtaaccttacccgttaaccgtaaaccgtttaaccgtaccccggtacgggtaccccggtaacctaaccggccgttaaaccggtaccgttaacggtaaacgttacgtttaaccgttacggttaacccttaaaacgtttttaccgttaacgttacccggttaaccgttaccgtaacggtttaactaccgggttacgttacccgttacccggttttaaccccggttacccgggtttaccgttacccgggtaaccgtaaaccggggtaaccggtaaacgggttaacgaaaccgtaaccggtaaaaccgtcgttaacgggtacgaaccgttccgaaccgtaccgttaaccgg

SEQ ID NO: 136288 - DNA, 622 bp, Homo sapiens
  misc_feature: GYAE6OF01EG6JU.47.48.E04.1.454.CMB.1.raw
  modified_base (227)..(227): a, c, t, g, unknown or other
  misc_feature (227)..(227): n is a, c, g, or t
  modified_base (501)..(501): a, c, t, g, unknown or other
  misc_feature (501)..(501): n is a, c, g, or t
tcagagctcacgtacacgaccggtgctcgatttagagagcgtcacagagagaaggggaggaatcagtcccactcaggacacagcatggacatgagggtccccgctcagctcctggggctcctgctgctctggttcccaggtgccaggtgtgacatccagatgacccagtctccatcctccctgtctgcatctggtaggagacagagtccaccatcacttggccgggngagtcgagggcgttgcaaatgtctttggccttggtttcagcagaccaccgagggaacggcccctaagccgcctgatctagtggtcgctaatactactttgacgtaaaggtcgggtacctatcgaaggttcaggcggtacaggtaggtcgtggggaacaggtacgttcaacgtcctacgtacttagtccaggccggtacctggacctacgtccgtagaacgttcttccgtagtaccttaacttaatttacgtacgttacctcgtaagttagttanacgttcgttacccgttacccgttcggttaccgtttacccggaaccggtaaaccgggtaaccgtaaagggttaacgaaaccgtaacgaaaccgtacgtaggtacgtacgtacggacctaccg

SEQ ID NO: 136289 - DNA, 576 bp, Homo sapiens
  misc_feature: GYAE6OF01ANPLW.47.48.E04.1.454.CMB.1.raw
  modified_base (197)..(197): a, c, t, g, unknown or other
  misc_feature (197)..(197): n is a, c, g, or t
  modified_base (303)..(303): a, c, t, g, unknown or other
  misc_feature (303)..(303): n is a, c, g, or t
tcagagctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtagganacagagtcaccatcacgttggccgggcgagtcgaggggtcgttgcaaatgctttggcctggtttcagcagacaccgagggacgcccctaagcgctgatctatggtncatactactttgactaaaggtcggggtacccagtaccgaaggttcacggccggtacgaggttagggtcgtggggaacaggtagttccacttcctcaacttatcacggccggcctgctacgccgtagaagtacttctacgacctaactttattacttcgtacctcctagttatgtacttcgtaccttacccgtcggtacgtttccggaccgtaacgggaccgtaagggtagtaaacctacgaaaacgtacgtcggtacgactcgctaccgtacg

SEQ ID NO: 136290 - DNA, 642 bp, Homo sapiens
  misc_feature: GYAE6OF01A16BW.47.48.E04.1.454.CMB.1.raw
  modified_base (224)..(224): a, c, t, g, unknown or other
  misc_feature (224)..(224): n is a, c, g, or t
tcagagctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatcgacccagtctccatcctccctgtctgcatctgtaggagacagagtcacatcacttcggccgggnagtcgagggtcgttagacaaatgtcgtttggcctggtttcagcagacacgagggaacgcccctaagccgcctgactctagtggtcgactatactacgtttgactaaggtcggggtacctagtacgtaaggttcaggcggacgtaggtacgggtcgtagggacgtaggtacgtttaccacttcgtacctaacttatcgacggtccggacctcggcacggtccgtaagaacgtactttcgacgtacttaacgtttattaccgttcgtacctaccgtaagttagtacgtacgtaccgttacccgttacccgttacggtacccgtttaccgggaacccgtaaacgggtaacccggtaagggtaacggaaaaccttaccgaaaccgtacgtacggtacggtacctcggcccgtaccgttaacg

SEQ ID NO: 136291 - DNA, 698 bp, Homo sapiens
  misc_feature: GYAE6OF01CGJ8X.47.48.E04.1.454.CMB.1.raw
  modified_base (202)..(202): a, c, t, g, unknown or other
  misc_feature (202)..(202): n is a, c, g, or t
tcagagctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatcgacccagtcctccatccctccctgtctgccatctggtagganacagatcacatcacgttcggccgggacagtcgagggtcgttgacaaatgtcgtttggccttggtttcagcagacaccgaagggaacgacccctaagcgcctgactctagtggtcgacacttactacgtttagacgtaaaggtcggggtaccctagtacgtaaacggttcgaggtacggtacgtacggtagggtcgtagggaacgacggtacgttacgtactaccgtacctactacgtacgtaaggtcccggtaccttcggctacggtcccgtaaggtaacgtacgtttacgtcgttaacccgttaacttttaacgttaccgttccgttaaccgttaccgttaacgttaagttacgttacgttaccgtaccgtttaccccgtttccgggttaaccgtttccgggaaacccgtaacggggtaaacccgtaagggtaaaccgttaaacggtaaccctaaacggttaacgtcggtacggtactccggactacccgttacg

SEQ ID NO: 136292 - DNA, 812 bp, Homo sapiens
  misc_feature: GYAE6OF01EQV2Y.47.48.E04.1.454.CMB.1.raw
tcagagctcacgtacacgaccggtgctcgatttagagagcgtcacagagagaaggggctcagagaggagccttagccctggactccaaggcctttccacttggtgatcagcactgagcacagaggactcaccatggaagttgggctgagtcgttgggttttccttgttgcttattttagaaggtgtcagtgtgaggtgctaagttggtgctaagttcggtggggggaggtcgttcggtccgacggtccggttcgggggggtcccctcgacgacttcctccgtgtgcacgtcctcgtggtactttcctaccttttacgttccttcgttggtatggtaagtttcgggtcccgtccgacgaccgtccgaggggagggtcgtgggtaggttgggttgacaactaataaactaccgaagagtaggaacgtacgaaacgtaaaaccgtagtaggtacggtacttcgtacgtacgggaacgggtaccgtactacctaaccctacttacctacccgaaggaaacgaaaccgaaaccgaacccgtaaacgtaacccttcctttccgtttacgttttaccgtacgtaactaaaaggtacgggtaactacgggtacccgttaagggaacggtaaacgggttaaccgaaacggtacccggtaacgggtcgtttacggttaacggtttaaatttacccgggttggtttacggtttacgttcccgttacccgggttaacggtacccccgggttaccccgggttaccccgggggttaacccccgggttttacccggtttccggggttcccggttttaccccgggggg

SEQ ID NO: 136293 - DNA, 627 bp, Homo sapiens
  misc_feature: GYAE6OF01AKAEN.47.48.E04.1.454.CMB.1.raw
  modified_base (174)..(174): a, c, t, g, unknown or other
  misc_feature (174)..(174): n is a, c, g, or t
tcagagctcacgtacacgaccggtgctcgatttagagagcgtcacagagagaaggggaggaatcagtcccactcaggacacagcatggacatggagggtccccgctcagctccgtggggctcctgctgctctggttcccaggtgccaggtgtgacatccagatcgacccagtcnccatcctcctgtctgcatctgtaggagacagagtcaccatcacgttcggccgggcgtagtcgagggtcgttcgacaaatgtcgtttggccttggtttcagcacgacgacgagggaacgcccgtaacgcacctgatactagtggtgctatactacgttcgacgtaaggtcgggtacccagtacgtacgtcagtctgcgtagtacggtcgtggactagtacgtacgtactctactactactcgacgcgtcctgcgacgtcctagacgtctcgtacgtacctaactttactacgttccttaccgtaccgtattacgtgtacgttacgttacccgttaccggttaccgttaccggttacccggtaaccgggtaaaccgggtaaccggtaacgggtaacggtaaaacgttaacccggaaaacgttacggttaagggtaccgtaccggtacgtaacccg

SEQ ID NO: 136294 - DNA, 559 bp, Homo sapiens
  misc_feature: GYAE6OF01CHWIV.47.48.E04.1.454.CMB.1.raw
  modified_base (419)..(419): a, c, t, g, unknown or other
  misc_feature (419)..(419): n is a, c, g, or t
tcagagctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcagtcaggggcttgcaaatgtcttggcctggtttcagtcagacaccgagggaacggcccctaagcgcctgatctatggtgcatacacttgacaaagtcgggtcccatacgaaggttcagcggctaggtaggtcgtagggactaggtacgttacacgtctctactactcgagccggcctgacacgcctagaagtattcngtactaactttacttaacttcgtactccgtagttatgtactcgtcccttaacccgtcggttacctttaccgggacctaaacggggtaccaaagggtacggaaactaacgaaacgtacgtaggtacgactcgaccactacg

SEQ ID NO: 136295 - DNA, 629 bp, Homo sapiens
  misc_feature: GYAE6OF01DA0MR.47.48.E04.1.454.CMB.1.raw
tcagagctcacgtacacgaccggtgctcgatttagagagcgtcacagagagaaggggctcagagaggagccttagccctggactccaaggcctttccacttggtgatcagcactgagcacagaggactcaccatggaattggggctgagctgggttttccttgttgctatttagaaggtgtccagtgtgaggtgcaattggtgcaatcgtggggggaggtcttggtccaggccgtgggggggtccctcagactctcctgtgcagcctctggatttccaccttttagttcccttcttggattgaagtttcgggtccgccagacctccgaggggaagggcgtggaggtgggtgacaacataaactcagataggaatcaaagaaacctatgtggactctcgtagaacgggcctattccacctatcctaccagacgaacaacgacccaaagaaccttctacgttcgttttactacgaacctaaagttcgggaacctacggtacccttagggaacgtaaggttaccgaaacggaccgtaccgggtcttaggtacgtttacttacgttaggttgttcgttcctcggtcgaccgtcccgtaccgggcccggttaccgttcgggtccgtttccgggg

SEQ ID NO: 136296 - DNA, 879 bp, Homo sapiens
  misc_feature: GYAE6OF01DXNYW.47.48.E04.1.454.CMB.1.raw
tcagagctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatcgacccagtcctccatccctcctgtcctgcatctggtaggagacagagtccaccatcacgttggccgggagagtcgaggggtccgttgactaaagtcgtcgttttcggtccgttggtttcacgtacgaacgaaccgtaaccggaacggggtaaccggtacccccgtaaacggcccggtacccgttacggtaactttaccgttaacgttcgggtacgtaccgtaacttaaccgttaccgttttacggaaccggttaaaacgggttccgggggtacccctaaggttaccgtaaacgggtttccgaacgggtccgggtaacgtaacggggttacgggtaccggttaacggggaacgtaaacgggtacggtttaccaaccgtttaccgttaacctaaccgttaacgttacccggaaccgggtaccccgggtacccttacgggtaaccggtaaccggttacccgttaaggtaaacggttaccgttttaccggtacgtaaccctttaaacgttttaaccgtttaacgttccggtttaccctacccgttaagttaacgtacgttaaccgttccggttaccccgtttaaccccgggttccgggttaacccggttttacccgggaaacccggttaaaccgggtaacccggttaagggttaaacggtaaactaaacccggtaaaaggtaccggttacggtacggaacccgttcgaaccctacgttacccg

SEQ ID NO: 136297 - DNA, 589 bp, Homo sapiens
  misc_feature: GYAE6OF01C3Q1R.47.48.E04.1.454.CMB.1.raw
  modified_base (231)..(231): a, c, t, g, unknown or other
  misc_feature (231)..(231): n is a, c, g, or t
  modified_base (299)..(299): a, c, t, g, unknown or other
  misc_feature (299)..(299): n is a, c, g, or t
  modified_base (310)..(310): a, c, t, g, unknown or other
  misc_feature (310)..(310): n is a, c, g, or t
tcagagctcacgtacacgaccggtgctcgatttagagagcgtcacagagagaagggggaggaatcagtcccactcaggacacagcatggacatgagggtccccgctcagctcctggggctcctgctgctctggttcccaggtgccaggtgtgacatccagatcgacccagtctccatcctccctgtctgcatctgtaggagacagacgtcaccatccacgttcggccgggngagtcgaggggtcttgacaaatgtctttggccttggttcagcagacacgaggaacgccctaagcgctnatctagtggtnctatactacgtttgacgtaaacggtcgggtacctagtacgtaacggttcgaacggcggacgtaggtacgggtcgtgggtaacgagtacgttcacgtactctaactatcgagtccggcctagcacgctagaagtacttcgtcgacttaatttacttactcgttactacgagttactagtacgtcttaccgttacccgttacggtaccgtttaccggaccgtaaacgggacgtaaggtaacgaaacgtaaccgaaacggtaacgtggtacgctcgctaccg

SEQ ID NO: 136298 - DNA, 832 bp, Homo sapiens
  misc_feature: GYAE6OF01C6LNM.47.48.E04.1.454.CMB.1.raw
  modified_base (156)..(156): a, c, t, g, unknown or other
  misc_feature (156)..(156): n is a, c, g, or t
  modified_base (202)..(202): a, c, t, g, unknown or other
  misc_feature (202)..(202): n is a, c, g, or t
tcagagctcacgtacacgaccggtgctcgatttagagagcgtcacagagagaaggggaggaatcagtcccactcaggacacagcatggacatgacgggtccccgctcagctccgtggggctcctgctgctctggttcccaggtgccaggtgtgacntccagatcgacccagtctccatcctccctgtctgcatctgtagganacagactcacatcacgttcggccgggcgacgtcgaggggtcgttacgactaaagttcggtcgtttcgggccgttggtttccgaacgtccgaacggaaccgaacccggaacgggggtaaaccgggacccccttaaagggcccgtacccgttaggtaacttacgttaacggttcggggtacgtacctaacgttaacctacgttttacggaaccggttaaacgggttccggggttacccctaaaggttaccggtaaacgggtttccgaacgggtaccgggtacgtaaggggtttaacgggtccggtaaggggaactaacggtacggttcctaacgttccgttaccaaccgttacgtaccgaacgggtccggtcccggtacgtaccgtaccggtaccgttaaggaaacgtttacgttcgtaacgtaccgtttaaactttaacgttaacgttaacgttaaactaaaaacgttacgtaaaacgtcccgttacccggtaccccgtaccttaccggttaaccggttaccggggtaaccgggtaaccgggtaaaaccggtaaggggttaacgggaaacgttaaaccgtaaccggtaaaacggtacggttacgggtacggtacgtacgtacccgtaaccg

SEQ ID NO: 136299 - DNA, 789 bp, Homo sapiens
  misc_feature: GYAE6OF01C70FB.47.48.E04.1.454.CMB.1.raw
  modified_base (239)..(239): a, c, t, g, unknown or other
  misc_feature (239)..(239): n is a, c, g, or t
tcagagctcacgtacacgaccggtgctcgatttagagagcgtcacagagagaaggggaatcagtcccactcaggacacagcatggacatgagggtccccgctcagctcctggggctcctgctgctctcggttcccaggtcgccgaggtgtgacactccagatcgacccagtcctccactccctccctgtcctgccatcgtagtaggagacagacgtcaaccatccgacgttcggccggngtacgtcgagggcgttgacaattcgtcgttcggtcttggttcacgcgagaccgaccggaggggtacccgaccccgtaaggcccgtaccgtagtacgttaccgtaggtcggtacgtactaacgttaccgtacgtttacggaaccggtaaacgggttccggtaacccgtaatacggtaacggtcgacggtacggagtacgggttagtcggtagggactaggtactaccgtactcctacgtacttacgtcgaccgtccgtccgacggtaccacggtaccgtaaggttaacgttacgtttacgaccgtttaaaccttaatttaccgtttaacgttccgttaccgttacccggttaacgtttgtaacgtttacccgttaccgttaccccggtttaccccggttaccggtttaaaccgggtacccccgggtaaaaccgggtaaccgggtaaaccggtaaaggggttaaccctaaaacccgggttaaaccggttaaacccgggttagtacccggggttaacgtcccggttacccgaaaccgttacccggtttacccg

SEQ ID NO: 136300 - DNA, 707 bp, Homo sapiens
  misc_feature: GYAE6OF01DBY1P.47.48.E04.1.454.CMB.1.raw
  modified_base (210)..(210): a, c, t, g, unknown or other
  misc_feature (210)..(210): n is a, c, g, or t
tcagagctcacgtacacgaccggtgctcgatttagagagcgtcacagagagaagggggaatcagtcccactcaggacacagcatggacatggacgggtcccccgctcagctccgtggggcctcctgctgctctcggttcccaggtcgccaggtgtgacatccagatcgacccagtcctccatccctccctgtctgctatcgtggtagganaacaggactccaaccggtatccacgttcgggccggactaagtcaagcgtacaattaaccagtacgtaatttaaagtggtactaccaaccgaagaaaccgaacgggaaaccgtaccccctaacctccgtagtactccttaagtcgcctagcctaattcccgtagtttcgaccgtagtacgggtcgggtccctagtacgtagtcgtagtcgacgaggtcgagtcgtagggaactaggtaacttttcaaccgttctaccaccgataccgacgtactagtacccgtaggtaccctaaacggttagtaaggtttacttttaccggaacctttaactttaaccgttacgtaacgttacctaaacgtacgggtttaacgttaaccccggtaaccccggttattcccgggttaaccgaccgggtaacggaaaccccgtaagtaacgtaacacgttaacaaaccgtacgtaggaccgtacgtacggaccttacacttcggttaccc

SEQ ID NO: 136301 - DNA, 599 bp, Homo sapiens
  misc_feature: GYAE6OF01AFYBH.47.48.E04.1.454.CMB.1.raw
tcagagctcacgtacacgaccggtgctcgatttagagagcgtcacagagagaaggggaggaatcagtcccactcaggacacagcatggacatggagggtccccgctcagctccgtggggctcctgctgctctggttcccaggtgccaggtgtgacatccagatgacccagtcctccactccctcctgtctgcatctgtaggagacagagtccaccatccacttggccgggcgaaggtagggcgttgacaaatgtcgtttggccgttggtttcagcagacacgaggacggccctaagccgctgatctagtggtcgcactactacttgactaaggtcgggtccagtacgaaggtcgagcggtacgaggtggtcgtggacgagtacgtctacgtctcactatcgcgcggtcctgcctacgccgtacgagtacttctagtacttaacttacgttacttcgtactaccgtagttagtacgttctaccgttaccgttacccgttacggtccgtttaccgggaccgtaaacgggtaaccggtaagggtaacggtaaacgtaacgtaaaccgtacggtacgtacgggtactcggtactaccgttacg

SEQ ID NO: 136302 - DNA, 672 bp, Homo sapiens
  misc_feature: GYAE6OF01B0Z4L.47.48.E04.1.454.CMB.1.raw
tcagagctcacgtacacgaccggtgctcgatttagagagcgtcacagagagaaggggaggaatcagtcccactcaggacacagcatggacatggacgggtccccgctcagctccgtggggctcctgctgctctggttcccaggtgccaggtgtgacatccagatcgacccagtctccatcctcctgtctgcatcgtgtagagacagacgtcaccatctacgttcggccgggagacgtcgagggtcgttgactaagtcgtcgttggccgttgttcagcagaccacgagggacgcccgtagccgcctgactcgtagtggtcactacgtactacgtttagaacgtaaacgggtcgggtaccctagttaccgtaaaggttcacgggcggacgtaggtacgggtcgtaggacgtaggtacttcacgttctactactacgcgacggtcgtctagccgacgtccgtaaggaattacgttcctagtaacttaaccgtttaacttccgttagttaccctaccgttaagttacgttacggacttcccgttacccgtttaccccgtaccgggtttacccgttacccggaaaccggtacgggaacccttaaaggggaaccgttaaaacgtaacccggtaaaacggttaccgttacgggtaggtacccgtcgtaaccccgtaccg

SEQ ID NO: 136303 - DNA, 584 bp, Homo sapiens
  misc_feature: GYAE6OF01DNOCP.47.48.E04.1.454.CMB.1.raw
  modified_base (227)..(227): a, c, t, g, unknown or other
  misc_feature (227)..(227): n is a, c, g, or t
  modified_base (565)..(565): a, c, t, g, unknown or other
  misc_feature (565)..(565): n is a, c, g, or t
tcagagctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtcctccatccctcctgtctgcatctggtaggagacagagtccaccatcacgttggccgggngtagtcgaggggtccgttgactaaagtcgtcgtttcggccttggttcagcaacgacaccgagggaacgaccccgtaagcgctgactctagtggtgctactactactttagacgtaaacggtcggggtacccagtacgtaacggtcgaggcggactaggttacggtcgtagggactaggtacgttcactctacctacttactcgacgccggcgtacgacgtacggacctagtaacgttagttttaggtaactttagtttattgtacgaacgtacggtaacttccgttccacttcaccgttcggacggacggacgaggtgagtacgtaagaaagtcgtgngactcgacactagtctgtc

SEQ ID NO: 136304 - DNA, 675 bp, Homo sapiens
  misc_feature: GYAE6OF01C3AWY.47.48.E04.1.454.CMB.1.raw
  modified_base (203)..(203): a, c, t, g, unknown or other
  misc_feature (203)..(203): n is a, c, g, or t
tcagagctcacgtacacgaccggtgctcgatttagagagcgtcacagagagaagggggaatcagtcccactcaggacacagcatggacatgagggtccccgctcagctcctggggctcctgctgctctcggttcccaggtcgccaggtgtgacatccagatcgacccagtctccactccctccctgtctgctatctgtagganacagactccacatctacttcggccgggtcgacgtcgaggggtcgtgactaatgtcgtttggtccttggtttcagcagacacggagggacgacccctaagcgcctagactctagtggtcgactaactacttacgttacgacgtaacgggttcgggtaccaagttacgtaacgggttacgacggacggtacgtaggttacgggtacggttacggggaacgtaggtacgtttaccgtaccgttacctacccgtaaccttacgttacgaccggtacccggtcccgtagaccgtaccggtccgtaaggtaacggtcttaccgtacggtactttaacctttacgttacgttcgttacctacgtaagttatacgtaacgttccgttaccgttacccgtaccgttacgttaccggacgtaacgggaaccgtaggtaacggaaactaccgtaaacgtacgttacgacgtcacgtcacgtac

SEQ ID NO: 136305 - DNA, 736 bp, Homo sapiens
  misc_feature: GYAE6OF01DF6L2.47.48.E04.1.454.CMB.1.raw
  modified_base (140)..(140): a, c, t, g, unknown or other
  misc_feature (140)..(140): n is a, c, g, or t
tcagagctcacgtacacgaccggtgctcgatttagagagcgtcacagagagaagggggaatcagtcccactcaggacacagcatggacatgagggtccccgctcagctccgtggggctcctgctgctctggttccaggtnccaggtgtgacatccgagatcgacccagtcctccattccctccctgtctcgcatcgtaggaggagaacaggacgtccaaccagtctaccgtcggccgggacgaagtcgaggggtccttagactaaagtgtcgtttcggtccgttggtttacagacgaacgaaccgaccgaacgggggaaccggtacccccgttaaacggccggacccttggtaacttaccgtaaggttcggtacgtacgtaacttaacgttaaccgtttaggtaaccggaaaaggttcgggggtacccctaagtaaccggtaaacggttcgaacggtaccgggactagggttacgggtacgttagggaacgtacgtacgttaccgaacttcctaccgtaactacgtcgaacggccgacgtacgacacggtaccgtagaacgtcttctacgtactaactttagttactcgttacctaccgtaagttagtacgtattacgtacccgttacccgttacggttaccgttaccggaacccgggtaaggaaaccgtaaagggtacgtaaaacgttaaccgaaacggttaacgtcggttacgacgtacgacccgtacgtaacg

SEQ ID NO: 136306 - DNA, 596 bp, Homo sapiens
  misc_feature: GYAE6OF01DZVNW.47.48.E04.1.454.CMB.1.raw
  modified_base (235)..(235): a, c, t, g, unknown or other
  misc_feature (235)..(235): n is a, c, g, or t
tcagagctcacgtacacgaccggtgctcgatttagagagcgtcacagagagaaggggaggaatcagtcccactcaggacacagcatggacatgacgggtccccgctcagcctccgtggggctcctgctgctctggttcccaggtgccaggtgtgacatccagatcgacccagtctccatccctccctgtctgctatctgtaggagacagagtccaccatccacgttcggccgggngagtcgagggtcgttgacaaatgtctttggccgttggtttctagcgagaccgaccgaacgggaacggaccccgtaacgcgccgtcgtatctagtggtgacactactacttgacgtaaagtacgggtcccgtatacgaagtcgagcggcgagtacggtgtaggacgagtagtcactctctactactcgacgcgtacgtcgacacgctacgaagtacttctcgactaactttataacttcgtactctagtatgtactcgtaccgttaccgtcgttaccggttccggtaaccgaacgggtaacgtacgggtaaacggtaaacgtacgaaaaccgtacggttacgtaggtacgtgccgtaacccg

SEQ ID NO: 136307 - DNA, 776 bp, Homo sapiens
  misc_feature: GYAE6OF01DJMZ4.47.48.E04.1.454.CMB.1.raw
  modified_base (292)..(292): a, c, t, g, unknown or other
  misc_feature (292)..(292): n is a, c, g, or t
tcagagctcacgtacacgaccggtgctcgatttagagagcgtcacagagagaaggggctcagagaggagccttagccctggactccaaggcctttccacttggtgatcagcactgagcacagaggactcaccatggaattgggctgagctgggttttcctgttgctattttagagtgtccagtgtgaggtgcaattggtgcaatcgtgggggagcgttggtccagccgtcgggggtccctcgagactctcctgtcgcacgcctcgtggtacttctaccttttagttcccctnttggattgtaagtttcgggtccgtccgagacgtccgaggggaagggcgtagggagtggggttgacgtaacataaactcgaagtacgtaggaagtacgaaagaaaaccgtagtacggtaggtacctcgtacgtaggaacgggtccgtaatttcccgaacctattccctaccgaaaggtacgaaacccgtaaacgccctaaaggtaaccctttccgtactttacgttttacctaggaaccctaaaagtcgggaacctagtacccgttagggaacggtaacggttacccggaaaacggaccgtaccggggttacctttaggggtaacgttttaacgtttaccggtttaggggtttaggtttccgggtttaaaccccttccggggtttacggtaaaccccccggggtttccccggtttaaccccccgggggtacccccggggtttttaacccccggtttggggtttacccccggttttccccgggggg

SEQ ID NO: 136308 - DNA, 675 bp, Homo sapiens
  misc_feature: GYAE6OF01BRJKO.47.48.E04.1.454.CMB.1.raw
  modified_base (198)..(198): a, c, t, g, unknown or other
  misc_feature (198)..(198): n is a, c, g, or t
  modified_base (463)..(463): a, c, t, g, unknown or other
  misc_feature (463)..(463): n is a, c, g, or t
tcagagctcacgtacacgaccggtgctcgatttagagagcgtcacagagagaagggggaatcagtcccactcaggacacagcatggacatgaggggtccccgctcagctcctggggctcctgctgctctggttcccaggtgccaggtgtgacatccagatgacccagtctccatcctccctgtctgcatctgtagganacagacgtcacatcacttcggccgggcaagtcagagcaattaacagacgtaattttaaagttggtaactacaccgaagaaaccgaagggaaactaccccctaacctcctagacttcctactactcgtacactacctaactttcggaacgtaaaggttcggggtacccctagtacgtaacggtttccaagggccggtacgaagggttggaacgtcgtaggggaacctaggtactttacgacttcgtacactatcgagacacgtccncgacaacgtccgtaagtagtaacgttttagtaacttttatttacgttacgtaacgaaaccggttagggtaaaccgtaccggttttcccgacctttaccggaaccggtttccggggaaccggggtaacggggaacccgtaaggggtaaggaacggtaagttaaaggaaaacggtgtcggtacggcgtacgaccgtatacgttcgtgtttaccg

SEQ ID NO: 136309 - DNA, 696 bp, Homo sapiens
  misc_feature: GYAE6OF01EADHI.47.48.E04.1.454.CMB.1.raw
  modified_base (226)..(226): a, c, t, g, unknown or other
  misc_feature (226)..(226): n is a, c, g, or t
  modified_base (358)..(358): a, c, t, g, unknown or other
  misc_feature (358)..(358): n is a, c, g, or t
tcagagctcacgtacacgaccggtgctcgatttagagagcgtcacagagagaaggggaggaatcagtcccactcaggacacagcatggacatggacgggtccccgctcagcctccgtggggcctccgtgcgtcgctcgttcgggttcccaggtcgccgagggtgtcgaacatccgagactacgacccagtcctccatccctccgtgtctgctatcgtaggtagganacgagactccacatcgtacgtcggccgggactaggtcgagggtcttagacaagttcgtctttacggctttggtacagactaagaccaacggagggtaaccgcccgaggccgtcctagctactaggtcggtanacgtaactacctaacgtcggaacgtaacggtcggtaactacgtacgtaggtacgaggcggtacagggtacggtcgtaggaactagtacgtactacgtcctacactacgacgacggccgtctcgacgtcgtacgaagtacgtattcgtacgtaactaacccggtttaatcccgttactacgtaccgttaagtacgtagtacgtttccgtaccgttaccgtaacggttacccggtacgaaacccgggtaaggggtaaacccgttaaggtaaacggaaaaaccggtaacctaaaacggggtccgtttaggaacccggttacctacggaaccccttaaacgg

SEQ ID NO: 136310 - DNA, 682 bp, Homo sapiens
  misc_feature: GYAE6OF01DJ3BR.47.48.E04.1.454.CMB.1.raw
tcagagctcacgtacacgaccggtgctcgatttagagagcgtcacagagagaagggggaatcagtcccactcaggacacagcatggacatgagggtccccgctcagcctcctggggctcctgctgctctggttcccaggtgccaggtgtgacatccagatcgacccagtctccatccctcctgtctgctatctgtaggagacagacgtacaccatctacgttcggccgggtcgagtcgaggggtcgttgactaatgtctttggccttggtttacacgtcacgacgaccgacggggaacggcccctaaggccgcctgtacttctagtggtcgtactaactactacgtttacgacgtaacgggttccggggtaccctagttaccgtaaaggttccgaaggccggtacgtaaggtacggtcgtagggtaactaggtacgttactactctaccacttactcgacggcccggtctacggctaccggtccgtaagaacgtacttcctacggttaacctaacgttttctacgttccgttacctaccgtagttaacgtgttaccttacgttacccgtttaacccgtcggttaacccgtttaccggggaaccgtaaaccggggaacgtaaagggtactaaaacgtaaccgaaacggtacgttgggtaccggagtacggtacccacgttacg

SEQ ID NO: 136311 - DNA, 806 bp, Homo sapiens
  misc_feature: GYAE6OF01B0YK2.47.48.E04.1.454.CMB.1.raw
tcagagctcacgtacacgaccggtgctcgatttagagagcgtcacagagagaagggggaggaatcagtcccactcaggacacagcatggacatgagggtccccgctcagctcctggggctcctgctgctctggttcccaggtgccgaggtgtgacatccagatcgacccagtcctccactccctcctgtctgcatcgtgtaggagacagacgtcaccatcacgttcggccgggcgagtcgagggtcgttgactaagtcgtcgtttcgggccgttggttacagacgaacgaccgaaccggacggggaaccggtaccccgtaacggccgtccgtggtacttacgtagtcggtacgtctaactactacgtttcgaacgtaacgggttccgggtacccaagttaccgaacgggttcacgggtcggtacgtaacggggttacgggtccggtacgggtaacagggttacgttacctaccgttacctaaccgtacttaacgtccggacgggtcccggtccgtacggaccgtacggtacccgttaaggaaccgttacgtttccgtaacgtaacccttaacgtttaaccttaccgttaccgttcctacgtaacggtttacgttacggtaccttacggttaccccgtttaccccggttaccggggttaaccccggttttacccggggaaaccccgggttaaaccgggggtaaacccgggtttaaaggggtaaaccggttaaaacccgtaaaccccgggtaaaacggttaccgggtttacgggtaccggggttccctaccggtaacccgttaacccg

SEQ ID NO: 136312 - DNA, 700 bp, Homo sapiens
  misc_feature: GYAE6OF01EF9MR.47.48.E04.1.454.CMB.1.raw
  modified_base (206)..(206): a, c, t, g, unknown or other
  misc_feature (206)..(206): n is a, c, g, or t
  modified_base (237)..(237): a, c, t, g, unknown or other
  misc_feature (237)..(237): n is a, c, g, or t
tcagagctcacgtacacgaccggtgctcgatttagagagcgtcacagagagaaggggagaatcagtcccactcaggacacagcatggacatgacgggtccccgctcagctccgtgggctcctgctgctctggttcccaggtcgccaggtgtgacatccagatcgacccagtcctccactccctcctgtctgctatcgtagtagganacagacgtccacatcgacgttcggcccgggngagtcgagggtcgttgacaatgtctttcggccttggttacagcacgacgaccgacgggaaccggccccgtaagccgaccgtgactacgtagtcgtgtactatacctacgtttacgacgtaaacgggtcggtacccctataccggtaggtcgacggtcggacgtaaggtacggtacgtacgggaatacggtacgttcccgtagttccctaccgtaacttacgcgtacggtcccgcgtcgaccgtacgtaccggtataaacggtacttcgtactacgtttaacctttacgttaacgttccgttaccgtcctaagttacgttacgtagttacccgttacccgtttaaccccgggttcggttaaccccggttcggaaacccgggttaacgggaaccggtaaaggtaaccggaaacggtaaccgtaaacggtacgttaccgggacgtacgtccggtaaccgtaacccg

SEQ ID NO: 136313 - DNA, 807 bp, Homo sapiens
  misc_feature: GYAE6OF01DKOLX.47.48.E04.1.454.CMB.1.raw
  modified_base (201)..(201): a, c, t, g, unknown or other
  misc_feature (201)..(201): n is a, c, g, or t
  modified_base (232)..(232): a, c, t, g, unknown or other
  misc_feature (232)..(232): n is a, c, g, or t
tcagagctcacgtacacgaccggtgctcgatttagagagcgtcacagagagaaggggaggaatcagtcccactcaggacacagcatggacatgagggtccccgctcagctccctggggctcctgctgctctggttcccaggtgccaggtgtgacatccagatcgacccagtctccatcctccctgtctgcatctgtagganacagacgtccacctatccacgttggccgggngagtcgagggtcgttagacgtaaatcgtctttcggccgttggtttacaggtaccaagaaccaccgaagggaaccggcccctaagccgtaccgtgactcgtagtcggtagtaccgtattactacgttgaacgtaaacggtcgggtacccctagtaccgtaacggtttcgaaggtcgggtactacggtacgggtcgtacgggtaacgtaggtacgttacctaactccttaccgtaacgttagtaccgacggtccggacccgttcggacccggtaacggtccccgtttaaggaaacgttaccgttttacccggttaggtaaccctttaaacttttaacgttacccggttacgggtttaacccctaccgtttaaacggttcgttagtttaaccgttcccggttaaccgttttaccccccggttagggtttaaccccgtttacccggggaaccccggttaaaaccggggggaaccccgttaaaacggggttaaacccgggtaaaaccgttaacccggtaaaaaccgggttacccggttaacggtaacccgggtaccgtacggtaaccccgtaaaaccccg

SEQ ID NO: 136314 - DNA, 760 bp, Homo sapiens
  misc_feature: GYAE6OF01CSVFV.47.48.E04.1.454.CMB.1.raw
  modified_base (220)..(220): a, c, t, g, unknown or other
  misc_feature (220)..(220): n is a, c, g, or t
tcagagctcacgtacacgaccggtgctcgatttagagagcgtcacagagagaaggggaggaatcagtcccactcaggacacagcatggacatgagggtccccgctcagctccgtggggctcctgctgctctggttcccaggtgccaggtgtagacatccagatcgacccagtcctccactccctccctgtctgcatctggtaggagacagagtccaaccnctaccgacgttcggcccggggcgacggtacggaggggtcgtcgacgtaaatcgtcgtttcggtaccgtttcggtttacgacgccaacggaccgaacccggaacggggaaccgggacccccgtaacggcccgtaccgtacgtacgttccgttaagttcgggtacgtactaacgttaacgttaccgttttacggaaccggtaaaccggggttccggttacccgaacgttaacggtaaccgggttaccgacgggtaccggacgtagggtacgggttacggtacgggacgtacggtacgttactaccgttctacttacctacgtacgcggtccggctacggcacgtcgtaacgtaagtacgttcacgtacttaactttacgttccgtacgttaccgtacgtagttactacgtacgtccgttaccccgttacccgtccggttaacccggttaccggaaccgggtaaaccgggtaaccggtaaaggtacggtaaaccctaaacggaaaccgttaacgtacggtacggaccgtacgaccgttaaccg

SEQ ID NO: 136315 - DNA, 810 bp, Homo sapiens
  misc_feature: GYAE6OF01BRYYL.47.48.E04.1.454.CMB.1.raw
  modified_base (146)..(146): a, c, t, g, unknown or other
  misc_feature (146)..(146): n is a, c, g, or t
  modified_base (209)..(209): a, c, t, g, unknown or other
  misc_feature (209)..(209): n is a, c, g, or t
  modified_base (214)..(214): a, c, t, g, unknown or other
  misc_feature (214)..(214): n is a, c, g, or t
tcagagctcacgtacacgaccggtgctcgatttagagagcgtcacagagagaaggggaggaatcagtcccactcaggacacagcatggacatggagggtccccgctcagctccgtggggctcctgctgctctaggttcccaggtcnccaggtgtgacatccagactgacccagtcctaccgatccctcctgtctgcatcgtgtacgganacagngtccactatccacgttcggcccgggagacgtccgaggggcgttcgactaaacgtcgtcgtttcggccttcggttcagtcacgaccgaccgagggaccgtcccgtaagccgacctggactcgtagtcggtgacctacgtctacgttgaccgtaaaggtcggtccaagtacgaacgggttcacggccgtacgaaggtacggtcggtacggaccgtacgggtaacgttccgtacgtccgtaccgtacgtaacgtaccgaccggtccggtccgtacggtacccgtaccgtacccggtaacggtaaccgttacgttaccggtacgtaacgttaaaccgttttacgtaacccgtttaccggttaccccgttaacggtaaccggttaaccggttacgtaaccgttacccggttaacccgtttaccccgggtaaccgggttaccccggttttaaccggggaacccccgggtttaaaccggggtaaaccccggggttaacggggtaaacccgggttaaaacccggtaaaacccggtaaacccgggttaaccggtttaaccgggggtaccggtaacccggttaccgggtaaaccccttaacccggg

SEQ ID NO: 136316 - DNA, 740 bp, Homo sapiens
  misc_feature: GYAE6OF01CQWRX.47.48.E04.1.454.CMB.1.raw
  modified_base (204)..(204): a, c, t, g, unknown or other
  misc_feature (204)..(204): n is a, c, g, or t
  modified_base (730)..(730): a, c, t, g, unknown or other
  misc_feature (730)..(730): n is a, c, g, or t
tcagagctcacgtacacgaccggtgctcgatttagagagcgtcacagagagaaggggagaatcagtcccactcaggacacagcatggacatgacgggtccccgctcagctccgtggggctcctgctgctctggttcccaggtcgccaggtgtgacatccagatcgacccagtctccatccctcctgtctgctatcgtgtagganacagtacgtccacctatccgtacgttcggccgggcgtaaggtcgaggggtcgttgactaaagttcgtcgtttcggtccgttggtttacagacgacgaaccgaacggaacgggaaccggaccccgtaaggccgtacccgtagtacttacgtacggttggtacgtacctaacttaccttaccggtttaacggaaccggttaaaaccgggttccggggtaacccctaacggtttaccgggtaaacggtttaccggaacggtaccgggtacgtaacgggttacgggttacggtaggaccgttaggtaacggttcctaaccgttactactaacttccgacgacgggtccggtaccgtacgtccgaacgtaccgtaagtaaacgtctttacggacgtacttaaacgtttcgttaaacttcgtaccttacgtagtattacgtacgttcgtacccgttacccgtacggttaccgttccgggaacgtaaacgggacgtaagggtaacaaacgtacgaaacgtacgtgacgtacgngtacctaacg

SEQ ID NO: 136317 - DNA, 570 bp, Homo sapiens
  misc_feature: GYAE6OF01CB2XJ.47.48.E04.1.454.CMB.1.raw
tcagagctcacgtacacgaccggtgctcgatttagagagcgtcacagagagaagggggaggtctcagagaggagccttagccctggactccaaggcctttccacttggtgatcagcactgagcacagaggactcaccatggaattggggctgagctgggttttccttgttgcttattttagaaggtgtccagtgtgaggtgcaattggtgcaatcgtggggggaggcttggtccagccgtggggggtccctcagactctcctgtgcagcctctggattcctaccttttacgttccttcgttggattaggaagtttcggggtccgccagacgtccgaggggaaggggctggggaggtggggttggacaacaataaatccaagataggaagtcaaagaaaacctatagtaggactctacgtggaagggccgtattccacctactctaccaaggacgaacaccgaccaaagtactctacttattctagacaagtgacagcctgagagtacgaagcgacgctgtagtattcgtgtagtctcgtctgtccgccgtcgggtcccgcgttcggtccg

SEQ ID NO: 136318 - DNA, 671 bp, Homo sapiens
  misc_feature: GYAE6OF01D5U35.47.48.E04.1.454.CMB.1.raw
  modified_base (201)..(201): a, c, t, g, unknown or other
  misc_feature (201)..(201): n is a, c, g, or t
  modified_base (226)..(226): a, c, t, g, unknown or other
  misc_feature (226)..(226): n is a, c, g, or t
  modified_base (299)..(299): a, c, t, g, unknown or other
  misc_feature (299)..(299): n is a, c, g, or t
  modified_base (500)..(500): a, c, t, g, unknown or other
  misc_feature (500)..(500): n is a, c, g, or t
tcagagctcacgtacacgaccggtgctcgatttagagagcgtcacagagagaaggggaggatcagtcccactcaggacacagcatggacatggacgggtccccgctcagctcctggggctcctgctgctctgggttcccaggtgccaggtgtgacatccagatgacccagtctccatcctccctgtctgcatctgtagganacagagtcaccatcacttgccgggnagtcaggcgttgcaaatgcttggcctggttcagcagacacagggaacgccctaagcgcctgactctagtggtnacatactacgtttcgacgaaaaggtcggggtacccctaagtacgtaaaggttcgaacggcggacgagggtacgggtacgtaggggaaactaaggaacgtttaccaacctactcctaaactacgtacgaacggcggtaccctaggccgtacgggtaccgttagaagtacgttacgtagtaccgtaaatttacttaaccgttnttacccgtaaccctaggttaacgttagaacgttcgtacccgtttaaaccccgtacgggtaacttttaccgggaacccggtaaaacgggtaaccgtaaacgggggttaaagaaaaccggttaacgaaaaaccggtaacgttaacgggtaggtactcgggtaacgtaaacccc

SEQ ID NO: 136319 - DNA, 764 bp, Homo sapiens
  misc_feature: GYAE6OF01EQG7M.47.48.E04.1.454.CMB.1.raw
tcagagctcacgtacacgaccggtgctcgatttagagagcgtcacagagagaagggggaatcagtcccactcaggacacagcatggacatgagggtcccccgctcagctcctggggctcctgctgctctggttcccaggtgccaggtgtgacatccagatgacccagtctccactcctccctgtctgcactctgtaggagacagatcaccatcacttcgccggcgagtcgaggggtccgttggacaaagtgtacgtttcggtccgttggtttaccagacgaacgaccgaaccgaacgggggtaaccggtacccccgtaacggcccgtaccgttacgattaccgtaatcgggtacgtcctaagtacttaccgtttaggacgtaaacggtcggggtaccctaagttacggaagtttaccgaggtacccggtacggtaacggttaggtaccgggttggggaaccgtaggtacgtttaccgttaaccgtacgtaccgtaacgttaacgtacggtaaccggtacggttcccgtaacgggttacgtaccgttaaggtaagttactttaggtaccgtaactaaacgttttacttaaccgttcggtaccctacgttaacggtacttagtaaccgttctacccgtttaccggttacccggtttacggttaacccggtaccgggtaaagtacccggtaaacggtaaggtaaaacggtaccctaaaacgggtatttaccgggcggtaactccggtaacctcccgtagttaacccg

SEQ ID NO: 136320 - DNA, 626 bp, Homo sapiens
  misc_feature: GYAE6OF01C486K.47.48.E04.1.454.CMB.1.raw
  modified_base (207)..(207): a, c, t, g, unknown or other
  misc_feature (207)..(207): n is a, c, g, or t
  modified_base (238)..(238): a, c, t, g, unknown or other
  misc_feature (238)..(238): n is a, c, g, or t
  modified_base (271)..(271): a, c, t, g, unknown or other
  misc_feature (271)..(271): n is a, c, g, or t
  modified_base (273)..(273): a, c, t, g, unknown or other
  misc_feature (273)..(273): n is a, c, g, or t
  modified_base (300)..(300): a, c, t, g, unknown or other
  misc_feature (300)..(300): n is a, c, g, or t
  modified_base (311)..(311): a, c, t, g, unknown or other
  misc_feature (311)..(311): n is a, c, g, or t
  modified_base (597)..(597): a, c, t, g, unknown or other
  misc_feature (597)..(597): n is a, c, g, or t
  modified_base (616)..(616): a, c, t, g, unknown or other
  misc_feature (616)..(616): n is a, c, g, or t
tcagagctcacgtacacgaccggtgctcgatttagagagcgtcacagagagaaggggagaatcagtcccactcaggacacagcatggacatgagggtccccgctcagcctccgtggggctcctgctgctctcggttcccaggtgccaggtgtgacatcccagatcgacccagtctccactccctccctgtctgcatcgtggtagganaccagtagtccaccatctaccgtttccgggntagtcgaggtctgacaagtgtcttgccttgttnancagacacgaggacgcccgtagcgcctnactcgtagtgngctactactcttagacgtaacggtcggtacctagtaccgtaggtcacggcgtacgtagtacggtcgtaggacgtagtacgtactaccgtcctactactacgtcgacggtcgtcctacgctacgcctaagtaacgtgttactcgtaacctaacgtttacttacgtcccgttactaccgttacgttagtacttaacgttacccgtaccgtttacccggtccggtttaccggtaccggtaaccggtaaccgggttaccgaaagggttacgaaaaccttacgtaaaccgngttacggtcgacgttaccncgtacctacg

SEQ ID NO: 136321 - DNA, 729 bp, Homo sapiens
  misc_feature: GYAE6OF01ERWFR.47.48.E04.1.454.CMB.1.raw
  modified_base (486)..(486): a, c, t, g, unknown or other
  misc_feature (486)..(486): n is a, c, g, or t
tcagagctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatccctccctgtcctgctatcgtggtaggagacgagactaccaccatctacgttcggccgggcgaggtcgagggtcgttacgacaaatcgtcgttcggtccgttggttacacgacgacgaaccgaccgggaacgggaaccggtaccccgtaacggcccgtaccgtcgtaaacttccggtaaggtttcgggtacgtactaacgtttaccttacgttacgaacggttaaaaccgggtccgggtacccagtaacgtaagggtacgacggtaccggacgtacggtacgggtcggtagggtaacgtagtaccgtttaccnttaccgtccttacctacgtacgtacggaccggtcccggtccgcgtaccgtaccgtaacgtaacgttaactccggtttacgtacttaacgttaactttacgttacgttaccgttacctacgtaagttacgtacgttacgtaccgttacccgttccgtaccgttaccggtaccgacggtacggaaaggtacggtaaacggtaacgtaaacgtaacgtaacggttcggacgtacgtcgtacctacg

SEQ ID NO: 136322 - DNA, 659 bp, Homo sapiens
  misc_feature: GYAE6OF01B13ID.47.48.E04.1.454.CMB.1.raw
  modified_base (202)..(202): a, c, t, g, unknown or other
  misc_feature (202)..(202): n is a, c, g, or t
  modified_base (230)..(230): a, c, t, g, unknown or other
  misc_feature (230)..(230): n is a, c, g, or t
  modified_base (311)..(311): a, c, t, g, unknown or other
  misc_feature (311)..(311): n is a, c, g, or t
tcagagctcacgtacacgaccggtgctcgatttagagagcgtcacagagagaaggggaggaatcagtcccactcaggacacagcatggacatgagggtccccgctcagctcctggggctcctgctgctctggttcccaggtgccagggtgtgacatccagatgacccagtcctccatccctccctgtctgcatctgtagganacagagtcaccatccacgttggccgggngagtcgaggggcgttgcaaatgtctttggccttggttcagcagacacgagggacgcccctaagccgcctgatctagtggtncatactacgtttgacgtaaaggtcgggtaccagtacgaaggttcaggcggacgtaggtacggtcgtagggacaggtacgttcacttctactacgtatccgacggtccggcctgccgacgtccgtaggaacgttacttccgtacgtaaccttaaaccgttttacttaccggttcgttacccgttaccgttaagttacgttacgtacgttacggttaccccgtttaccccggttacgggttacccgtttacccggggaacccggttaaacggggtacccggtaaaggggtaccggtaaaactaccgtaaaacggtaccggttacggtagggcccttagcccgttaacccg

SEQ ID NO: 136323 - DNA, 728 bp, Homo sapiens
  misc_feature: GYAE6OF01BF52T.47.48.E04.1.454.CMB.1.raw
tcagagctcacgtacacgaccggtgctcgatttagagagcgtcacagagagaaggggaggaatcagtcccactcaggacacagcatggacatggacgggtccccgctcagcctccgtggggctcctgctgctctggttcccaggtgccaggtgtgacatccagactcgaccctagtcctccactcccttcccgtgtcctgccatctaggtaggacgacaggacgtcaccatccgacgttcggccgggacgacgtcgacggggtcgttacgactaagtcgtcgtttcggtccgttcggttacacgtaccgaacgaaccgaccgggaaacggggaaccgaccccgtaaggccgtaccgtaggacttacgtaacggttcggtacactaacttaccgttacgtttacggaacgttaaacggggtcgggttacccaagttacgtaacggttcgaggtacggacggtaggttaccgggtagtacgggaactaggacgttaccacttcgtaacacgtagacgacggccgtctacgcgacgtccgtaggatcgttacgtctaacttacctttacttacgtacgttcctaacgtagtacgttacgacgtttacgacccctttaccgggaccgttaaccggttacccggaacgggtaaccggtaacgggttaacggtaaacggtaaccgttaaaccgaaacgggttacttacgggaccggctaacccggtacctaacg

SEQ ID NO: 136324 - DNA, 634 bp, Homo sapiens
  misc_feature: GYAE6OF01ANIO2.47.48.E04.1.454.CMB.1.raw
  modified_base (313)..(313): a, c, t, g, unknown or other
  misc_feature (313)..(313): n is a, c, g, or t
tcagagctcacgtacacgaccggtgctcgatttagagagcgtcacagagagaaggggaggaatcagtcccactcaggacacagcatggacatgagggtccccgctcagctcctggggctcctgctgctctggttcccaggtgccaggtgtgacatccagatgacccagtctccatcctcctgtctgcatctagtagagacagatcaccatcacgttggccgggcgagtcgagggtcgttgcaaatggctttggccgttggtttcagtcagacaccgagggaacgcccctaagccgcctgactctagtggtacncatactacttttagacgtaaacggtcggggtcccaagttcgtaaacggttccgaagggtcgggtacgtaagggttacgggttccggtaggggtaacaggtaacgttctaaccgtctcctaactacttcgaacggccggtcgtcggaccacgtcctaggaagtcgttactgtacctaacgtttattacccgttgtaccttccagttacgtagtacgtacgtccctttacccggtacggtaccgttacgggaccgtaacgggtacccgaaagggtcggtaaaacgtaccgtaaacgtacgttggacggtctacggcgtaaccg

SEQ ID NO: 136325 - DNA, 530 bp, Homo sapiens
  misc_feature: GYAE6OF01EDNPO.47.48.E04.1.454.CMB.1.raw
  modified_base (301)..(301): a, c, t, g, unknown or other
  misc_feature (301)..(301): n is a, c, g, or t
  modified_base (405)..(405): a, c, t, g, unknown or other
  misc_feature (405)..(405): n is a, c, g, or t
tcagagctcacgtacacgaccggtgctcgatttagagagcgtcacagagagaagggggaatcagtcccactcaggacacagcatggacatgagggtcccccgctcagctcctggggctcctgctgctctggttcccaggtgccaggtgtgacatccagatgacccagtctccatcctccctgtctgcatctgtagagacagagtcaccatcacttgccgggcgagtcaggggcgttgcaaatgctttggcctggtttcagcagacaccagggaacgcccctaagcgcctgatctagtggtncatacactttgacaaagtcggggtcccatcaaaggttcagcgctagtaggtctgggacagtagttcactctcactatcgagcggctggcagcctagagtattcngactaacttattactgttactccgtagtatagtattcgtaccttacccgtcggtacgtttccgggaccaaggggaccctaaggtacggaaactacgaaacgacgttgtaggcttacggcacgtac

SEQ ID NO: 136326 - DNA, 748 bp, Homo sapiens
  misc_feature: GYAE6OF01AMZ2S.47.48.E04.1.454.CMB.1.raw
tcagagctcacgtacacgaccggtgctcgatttagagagcgtcacagagagaaggggaggtctcagagaggagccttagccctggactccaaggcctttccacttggtgatcagcactgagcacagaggactcaccatggaattggggctgagctgggttttccttgttgctatttagaaggtgtccagtgtgaggtgcaactggttggagtcgtgggggagacttagtaccacccgtgggggggtccctggagactctcctgtcgcagcctcgtggactcgacctttagcaactctgtcagtgggctcgggtccgccgaggcgtaccgggggaaggggtcgtgggaggtggggtcctacgtaaagtattgagtggaagtaagtgggtaggaacgcaacgtatttaccgtacggtcggaccgttcccggtagggaaaccggggtcccggttaccaacccgtacttacctacccgaagtaacggtaacctaacttttaccgaagggtaacgaccgtaaccggaccgttaggttaaacttaccgttaaaacctaaaacgttacggtaaaccgtaacgggtaaccgttacggaaagggaaccggtacccgggtaacgggaacccggtaacccggggtacccgtttaagtttaaccgttttacgttcggttacggtaaccggtaaagttaccttaagtaacggaccgtaccggttacccgtacccccccgttaaccggtcccgttaaccccg

SEQ ID NO: 136327 - DNA, 678 bp, Homo sapiens
  misc_feature: GYAE6OF01BOMKW.47.48.E04.1.454.CMB.1.raw
  modified_base (222)..(222): a, c, t, g, unknown or other
  misc_feature (222)..(222): n is a, c, g, or t
  modified_base (266)..(266): a, c, t, g, unknown or other
  misc_feature (266)..(266): n is a, c, g, or t
tcagagctcacgtacacgaccggtgctcgatttagagagcgtcacagagagaaggggaggtctcagagaggagccttacgtccctcggactccaaacggccttttccctacttggttggatcagcactgagcacaggaggactcaccatggaattggggctgagcttgggtttttccttgttgcttattttagaggtgtccagtgtgaggtgcaattgggtncaattcgtggggggagctttggccaggcccgtggggggtccccnagacttctcctgtgcacgcctctggtacttcctacctttacgttcctcgttggatagtaacgttcgggtcccgcctagaccgtccgaggggaacggggtctgggaggttggggttagacaaacataaactccgagaagtggaagtacaaagtaaacctagtcggtaggtactcgtcggttaggaacgggccttattccaaccgtattcccgtaccgaaggtaacgaaccgaaccgtaccgaacgtaacctcgtttaccgtagttttccgacgacgtaaactggaccaccggttcaggtaacgagtacgtaaacgacgtacggtccttaggtctttaacgtattggtacggtttcgttcccgtagttacccgccggtaccccgttccggaccgggttacccgttcgggtccgg

SEQ ID NO: 136328 - DNA, 567 bp, Homo sapiens
  misc_feature: GYAE6OF01ALHU7.47.48.E04.1.454.CMB.1.raw
  modified_base (315)..(315): a, c, t, g, unknown or other
  misc_feature (315)..(315): n is a, c, g, or t
  modified_base (431)..(431): a, c, t, g, unknown or other
  misc_feature (431)..(431): n is a, c, g, or t
  modified_base (550)..(550): a, c, t, g, unknown or other
  misc_feature (550)..(550): n is a, c, g, or t
tcagagctcacgtacacgaccggtgctcgatttagagagcgtcacagagagaaggggaggaatcagtcccactcaggacacagcatggacatgagggtccccgctcagctcctggggctcctgctgctctggttcccaggtgccaggtgtgacatccagatgacccagtctccatccctccctgtcctgcatctgtaggagacaggagtccaccatcacttggccgggcgagtcgagggtcgttgacaaatgtcttggccttggtttcagcagacaccgagggacgccctaagcgcctgatctatggtgcatacnctttagacaaggtcgggtccatcgaaggttcagcggcgtaggtacgtcgagggacaggtacttacactctactactacgtcacggccgtcctgcgagtcccgtagaacgtcgttcngtacctaactttattaacctggttcctacgtagttaactgtatccgtacccttaccgtcggttaccgttccggaacgtaacgggtacctaagggtagtaaaccgtaacgaaactacggngtaggctcggcctaacg

SEQ ID NO: 136329 - DNA, 794 bp, Homo sapiens
  misc_feature: GYAE6OF01E3QXW.47.48.E04.1.454.CMB.1.raw
tcagagctcacgtacacgaccggtgctcgatttagagagcgtcacagagagaaggggaggaatcagtcccactcaggacacagcatggacatggacgggtccccgctcagctccgtggggctcctgctactctggctccggagtcgccagatgtacgacactaccgagactcgacccagtcctaccacttccctcctgtctgctagtcgtaggtacggagacgacgactaccacctactaccgtacgttaccgggccgggaactaacggtacgaagtacgaacttaaacgttaaacgtacgttaaacgttaaacgttttaacgttacgtaacgtaacccgaaccggaaaacggtaaaacccggtaaccgggtaaccccttacccttaacgtaccgtaatactttacgacgttccgacgttactactacgtttacgtgtacgtaggtacggttacggtccgtacttagggttcgtaggttcggacgtaggtacgtacggtcgtacggacgttacggacttacgtactacctactaccgtaacgacctagtacgtacgtactacgtccgtaaacgtactaacgtaacgttttacgtaacttaaccgtaaccttaacgttaccgtaaccgtaacgtaaccggttaaaccggttacccggttaaaccccgttaaccgttaccgttaccgggtaacggtacccgggaaaccgtaaacggtaacgtaaccgtaacgtaaacccgtaacttacccgtaaggttcggtacgtacgtacccgtacccgttacctcgtttaccg

SEQ ID NO: 136330 - DNA, 734 bp, Homo sapiens
  misc_feature: GYAE6OF01B5EU0.47.48.E04.1.454.CMB.1.raw
  modified_base (120)..(120): a, c, t, g, unknown or other
  misc_feature (120)..(120): n is a, c, g, or t
  modified_base (159)..(159): a, c, t, g, unknown or other
  misc_feature (159)..(159): n is a, c, g, or t
tcagagctcacgtacacgaccggtgctcgatttagagagcgtcacagagagaagggggaatcagtcccactcaggacacagcatggacatgagggtccccgctcagctcctggggctccngctgctctcggttcccaggtgacaggtgtgacatccagntgacccagtctccactccctcctgtctgcatctgtaggagacagagtccaccattccacgttcggccgggacgacggtcgaggggtcgttggaccaaagtcgtcgtttcggccgttggtttcgagcagaccacggacgggaccgtcccgaagccgctagactctagtggtcactagtacgttacgtttgaaccggtaggtccggggtccagttaccgtaagggttccgacgggtaccggtacgtacggtacgggttccggtacgggacgttaacggtacgttacctaacgttaccttaccgtaacgttaccgacggacggtccccggtaccgttacggaccgtaaccggtcgttaacggtaaccgttacgtttaccgtacgtacctttaacgttactttaaccggttccgttacctccggtaagttacgttacggttaacgtccgttacccgttacccggttcggttaacccggttccgggaacccgggtaacgggtaaccggtaagggtaacggttaaacgtaaccgtaaaccggtacggttacggtacggtccgtacgtaccgtaccttacgg

SEQ ID NO: 136331 - DNA, 790 bp, Homo sapiens
  misc_feature: GYAE6OF01AY5N4.47.48.E04.1.454.CMB.1.raw
  modified_base (538)..(538): a, c, t, g, unknown or other
  misc_feature (538)..(538): n is a, c, g, or t
tcagagctcacgtacacgaccggtgctcgatttagagagcgtcacagagagaaggggagaatcagtcccactcaggacacagcatggacatggacgggtcccccgcttcagtcctcccgtgggcctcctgctgctcgtggttcccaggtgccaggtgtgacatccagatcgacccagtcctccactccctccctgtctgaccatccgtgtaggagacgagatccacctagtccaccgttcggccgggtgacggttcgacggggtcgttagacgtaaattcggtaccgtttcggtccgttcggtttccgagtaccgaacggtaccgaaccggtaacgggacccggtaccccgtaacgcccgtccgtacggtactccttaaggtcggtacgtactaaccgttaccgttaactttcggaacgtaacgggtccgggtaccctacgtacggttaaggttaccgacggtccggaggtacggtacggtacggtacggacgtaggtacgttacacctctaccgactacgtacgcgtcccggtcgtntaccggaccgtaccgtaggtaacgttccgttacgtaccggtaactttaaactttactaccggttaccttaccgttacctaagttacgttacgtacgttaccgtacccgttttacccgggttaccccgttacgggttaccccggtaaccgggtaaaccgggttacggtaaaaccggggttacggtaaaacccgttaaccgggaacggtttaaaccggtccggttaaaccggcgtaaccgttacgtaaccccgg

SEQ ID NO: 136332 - DNA, 927 bp, Homo sapiens
  misc_feature: GYAE6OF01CCSHZ.47.48.E04.1.454.CMB.1.raw
  modified_base (200)..(200): a, c, t, g, unknown or other
  misc_feature (200)..(200): n is a, c, g, or t
tcagagctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtcctccatccctccctgtctgcatctggtagganacagacgtccaccatcacgttcggccgggcgagtcggacggggtcgttagacgtaaattcggtcgttttcgggtcccgtttgggttttaccacggtaccgaacggaacccgaacccgggaaacgggggaacccggggtaccccccgttaaacggggacccggtcccgttacgggtaactttaccgttaagggttcgggttacggtaccttaaacgttaacccgtttaaccggtttttacgggaaacccggttaaaaacggggttcccgggggggtttaacccctaacggtttaaccgggttaaacggggttttcccgaacggggtcccggggaccgttaacgggttacggggttaccggtacggggtaacgtaacggttacggtttaccctacttccgtacctaaccgttcgtaccggacgggtcccggtacccgtggacccgtacggtacccgtaagtaacggtacctttacgtaccgtaaccttaaacgtttttaactaccctttcggttaccccttaccgttaaggttacgttaccgttaacgttacccggttacccgtttaacccccgggttccggttaaccgggtttaccccgggaaacccgggtaaaacggggtaaccccgttaaaggggtaaaccggttaaacgtaaaccccggtaaaacggttaaaccgggttcgggttaacccggtaccgttaccggacccgttaacccgttaaccgg

SEQ ID NO: 136333 - DNA, 721 bp, Homo sapiens
  misc_feature: GYAE6OF01B7BDJ.47.48.E04.1.454.CMB.1.raw
tcagagctcacgtacacgaccggtgctcgatttagagagcgtcacagagagaaggggaggaatcagtcccactcaggacacagcatggacatggacgggtccccgctcagctccgtggggctcctgctgctctggttcccaggtgccaggtgtgacatccagatcgacccagtctccatccctccctgtctgctatctaggtaggagacaggactcaccatccacgttggccgggacgagtcgaggggtcgttagactaaagtggtacgtttcggtccgttggtttcacgacgacgaaccgaccggaagggaaccggaccccgtaaggccgtacctagtacttcgttagtcgggtacgactaacgttactacgtttacgaacggtaaaggtccggggtaccctaaggtacgtaacggttcgaacggcggtacgagggttaggtcggtagggactaggtacgttaccgtaccttacctaccgtacgttacgtaccggtacggacccggttccgtaggtcccgtaacggtacccgttaagggtaacgtttacgtttacgtaaccttaacgtttaacctacgttacgtaacctaaacggtacgttaacccggttaacccgggttacccgttacgttacggtttccggaaccggtaacggtaaccgtaacgtacggtaactactaaacgaaacgtaccgtagtcggcacgaccactcgtgttacg

SEQ ID NO: 136334 - DNA, 803 bp, Homo sapiens
  misc_feature: GYAE6OF01AJJQ7.47.48.E04.1.454.CMB.1.raw
tcagagctcacgtacacgaccggtgctcgatttagagagcgtcacagagagaagggggaatcagtcccactcaggacacagcatggacatgacgggtccccgctcagctcctggggctcctgctgctctggttcccaggtcgccaggtgtgacatccagatcgacccagtctccactccctccctgtctgctatctggtaggagacagacgtccacctactctacgttcggccgggcgaggtcggagggtcgttagactaagtcggtcgtttcggtccgttggttacagcaacgaccgaaccgggtaacgggaacccggaccccgtaacggcccgtaccgtgtaactacgttaaggtcggtacgactaacttaaccgttaccgtttacggaaccggtaaacgggttccggggtaccctaagtaccgtaacgggttccgacggtcgggacgtaaggtcgggtacggtacgggtaacgtacggttacgttacgtaacttccgtaactacgttacgtaccggtaccggtcccgggtccgtacggaccgtaccggtacccgttaaggtaacggttacgttacccgtacgttaacctttaaccgttttaaccgtttaccgttacgttaccccgttaacggtaacgtttacgttacgtaaccgtttccggttaaccccgtttaacccggttccggttaacccggtttacccgggaaacccgggttaaacggggtaaccggtaagggtaaccggtaaaccgttaacggaaacgtacggtcggttacggaccgtacgaccgtacgttaccg

SEQ ID NO: 136335 - DNA, 742 bp, Homo sapiens
  misc_feature: GYAE6OF01C7CBR.47.48.E04.1.454.CMB.1.raw
  modified_base (369)..(369): a, c, t, g, unknown or other
  misc_feature (369)..(369): n is a, c, g, or t
tcagagctcacgtacacgaccggtgctcgatttagagagcgtcacagagagaaggggaggtctcagagaggagccttagccctggactccaaggccctttccacttggtgatcagcactgagcacagaggactcaccatggaattggggctgagcttgggtttccttgttgctattttagaaggtgtccagtgtgaggtgcaattggtgcaatcggtgggggaggtcttggtcccaggcccgttggggggtcccctcgagaccgtctcctgtggcacgcctcgtggacttcctaccgtttagtagttatcgcctatgtacgttcgggtccgccgaggcctacgaggggaagggtcgtgggagtgggtcngagcgtagttggtaggtaggtggtcgaccgaggtacacgttaacgttaacggtaaacgtcccgtagcggtaacgggtccgttacgttttaccttttaacgcccgttaacccgaaggtaacgtaaacccgtaaccgtttacccgaaaggtaaaccctaagttacccgttagtaaccttttccgtaggtacgttaagtttaccgaaccgtaacgttcgtaggacgtaaacgggtcggtaacggaacccggtacggtaaccgtttaaagttacttttaacggttaggtttaaacggtttaaggtaggggttaacgtgggttacggtaccgttaaccggttaccggttcggggttccgggggggtaaccccccgggg

SEQ ID NO: 136336 - DNA, 744 bp, Homo sapiens
  misc_feature: GYAE6OF01AQ0U6.47.48.E04.1.454.CMB.1.raw
  modified_base (242)..(242): a, c, t, g, unknown or other
  misc_feature (242)..(242): n is a, c, g, or t
tcagagctcacgtacacgaccggtgctcgatttagagagcgtcacagagagaaggggaggaatcagtcccactcaggacacagcatggacatgagggtccctgctcagctcctgggactcctgctgctctggctcccagactaccagatgtgacatccaagatcgaacccagtcctccatccctccctgtctgctatctaggtacggagacacacgtccaaccatccacgttcgggccgggngtagtacgaaggactaagtttacgacttaatttattacggccttaggtaactcgaagacaaacggtaaaccgaagggtaaacttacctaaacgtcttaccgtagtactacttagtacgtttaacaacgttcctagtttgaacctaacggtttcccgggtacccagttccgttcggttacgaggttacggactagggttacggacttacggtacgggtaacctagttaccgtttaaccactttaccgtacctacctaacttcgaacgtccaaggtcccgtagaccgtacgtaccgtaaggtaagttacgttacgtacgtaaccgtttaaactttaacgttaaccgttaaagaaaacccttaaaagtaacctaacgtaccggtcccgtaccccttacgttaccccggtttaacggtcccggggtaacgggtaaacccggggtaacgtaaacggggtcggtaaacgtaacttaaaccgggaaaaccgttggttacggtaaccggg

SEQ ID NO: 136337 - DNA, 736 bp, Homo sapiens
  misc_feature: GYAE6OF01ECOA5.47.48.E04.1.454.CMB.1.raw
tcagagctcacgtacacgaccggtgctcgatttagagagcgtcacagagagaaggggaggaatcagtcccactcaggacacagcatggacatgagggtccccgctcagctcctggggctcctgctgctctggttcccaggtgccaggtgtgacatccagatcgacccagtcctccactccctccgtgtctgctactcgtaggtaaggacgaacgacgtacgtaccacctactaccgtaccggttccgggcccggggacgtacggtacggacggggttcgttacgaactaagttcggttcgtttacggtccgtttggttcacgacaacgaccgaaccgggaacggggtaaccccgtacccgtaggccgtaccgtagtacgttacgtacgtcggtacactaacttaccttacgttcgaacgtacgggtccggtactagtacgtacggtcgcggacgtagtacggtacggtcggtaggaacgtacggttcctacctactccgtaacctactcgacggtaccgccgtactcgaccacggtactaagtacttcgttacgacttaacttaactttacttcgtacgttacctagtagttacgtagttaccgttaccgttaccccgttaccggttaccggttaccggttaccggaaccgggttaaaccggtaacgtaacgggttaaaccgtaaacgtaaacccggtaaacgttggtaccgggtaccaacgtccgaaccgttccg

SEQ ID NO: 136338 - DNA, 870 bp, Homo sapiens
  misc_feature: GYAE6OF01BO43W.47.48.E04.1.454.CMB.1.raw
tcagagctcacgtacacgaccggtgctcgatttagagagcgtcacagagagaaggggaggtctcagagaggagccttagccctggactccaaggcctttccacttggtgatcagcactgagcacagaggactcaccatggaattgggctgagcttgggttttccttgttgcttattttagaaggtgtccagtgtgaggtgcaattggtgcaatcgtgggggagtcttaggtccagccggtcgggggtccctcgagactctcctgtgcacgcctcgtggtacttcctaccttttagttccttacgttggattaggtaagtttcgggtccgccaaggtaccgtccggaagggggaacggggtctaggggtaaggttgggggttacgaaccgtaaaactaacgttaaaactccgaaagtaagtagggtaaaacgtacgaaaaacgtaaaaaccctagttacggtacggtaaccgttccttacggtaagggtaaaccggggtacctaacgtttacccgaaaccgtacttacccgttaacccgaaaggtaaaccggtaaaccgaaacccgaacccgtaaaacggtaaaccctttaaccgttacctttacggttttaaccgttacggtaaaaccgtaaaacggttcggggtaaacctaaacggttaccccgttaagggaaacggtaaacgggtttaacccggaaaacggtaaacccgggtaacgggttacccgtttagggtttaaacggtttaacggtttaaacgtttcggttacggtttacggttacccgtttaaccgtacgggtaaaccccggttcccccgggttaacccgggggtccccggtttaaaccccggtttggggtttacccccgggg

SEQ ID NO: 136339 - DNA, 568 bp, Homo sapiens
  misc_feature: GYAE6OF01BQCB1.47.48.E04.1.454.CMB.1.raw
  modified_base (234)..(234): a, c, t, g, unknown or other
  misc_feature (234)..(234): n is a, c, g, or t
  modified_base (308)..(308): a, c, t, g, unknown or other
  misc_feature (308)..(308): n is a, c, g, or t
  modified_base (425)..(425): a, c, t, g, unknown or other
  misc_feature (425)..(425): n is a, c, g, or t
  modified_base (491)..(491): a, c, t, g, unknown or other
  misc_feature (491)..(491): n is a, c, g, or t
  modified_base (552)..(552): a, c, t, g, unknown or other
  misc_feature (552)..(552): n is a, c, g, or t
  modified_base (558)..(558): a, c, t, g, unknown or other
  misc_feature (558)..(558): n is a, c, g, or t
tcagagctcacgtacacgaccggtgctcgatttagagagcgtcacagagagaaggggaggaatcagtcccactcaggacacagcatggacatgacgggtcccccgctcagctcctggggctcctgctgctctggttcccaggtgccaggtgtgacatccagatgacccagtctccatccctccctgtctgcatctggtaggagacaggactccaccatccacgttcggccgggngagtcgagggtcgtgactaaagtgtcttggtcctggttcagcacgacacgtacgggacgaccccgtagccgccngtatctagtggtagactatacgtacgttacgacgtaagggtcggtacctacgtacgtaggtcgagccggagtacggtaggtcgtagggaacgagttactactactctacgtactacncgaggtaccgctcgacgcgtactacgtatactcgtactacttaacttacttcgtctcgtactagtntagactccgtactccgtacgtcgtacgacgtaaggacgtaaggacgtaactagaactacgngtacgntccgctaacg

SEQ ID NO: 136340 - DNA, 743 bp, Homo sapiens
  misc_feature: GYAE6OF01DBWSF.47.48.E04.1.454.CMB.1.raw
tcagagctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatcgacccagtcctccatccctccctgtctgcatctgtaggagacagacgtccaacccatcctacgttcggcccgggcgtaggtcgaggggtcgtagaactaaagtcgtcgtttcggtccgttggtttccacgaccgaacgaaccgaaccggaacggggaaccggtacccccgtaagccgtccgtgtacttaccgtagttggtcgtacctaattaaccgtacgtttacgaacgtaaacgggttccggggtaccctaagtacgtaaacggttacgacggtcggtacgtaggtacggtcgtagggaactaggtactacctacgttactaccactacgtcgacggtccggacctcgacgtcgtacccgtaaggtaagttaccgttacgtaccgttaacgttaaccttttacgtttacccgttcttaccgttaccgttaacgttagttacgtaactttacccggtaccctttacccggttacccggttaccgttacccgggacccggtaaacgggaaccggttaagggtaacgtaaaacgtaacccggtaaacgtacgttacggtaacgtctaaccgtcctaccgttacg

SEQ ID NO: 136341 - DNA, 663 bp, Homo sapiens
  misc_feature: GYAE6OF01EDEJR.47.48.E04.1.454.CMB.1.raw
  modified_base (200)..(200): a, c, t, g, unknown or other
  misc_feature (200)..(200): n is a, c, g, or t
  modified_base (228)..(228): a, c, t, g, unknown or other
  misc_feature (228)..(228): n is a, c, g, or t
tcagagctcacgtacacgaccggtgctcgatttagagagcgtcacagagagaaggggaggaatcagtcccactcaggacacagcatggacatgagggtccccgctcagctccgtgggctcctgctgctctggttcccaggtgccaggtgtgacatccagatgacccagtctccatcctccctgtctgcatcgtgtagganacagacgtcaccatcacgttcggccggnagtcgagggtcgttgactaaagtgtcgtttcggtccgttgtttacagtcaagaccaccggtagggaaccgaccctaaggccgactcggacttacgtagtggacgactaataacctacgtttcgaaccgtaaacggggttcggtaccctagtaccgtaacggttcgacgggcggtacgtaggttacggtcggtacgggtaactaggttacgttccaacgttacctaccgtaacgttactaccgacggtccgtaccgtacgaccgtacgtccgtaagtaacgttacgttcgtacgtaaccgttaactttacgttaccgtgttaccgtactagttatgtactccgtaccttccgtacgtttaccgttaccgaccggtaaacggacgtaaggtaacgaaacttaaccgaaaacggttcgtagtaggtctcgacctaacg

SEQ ID NO: 136342 - DNA, 838 bp, Homo sapiens
  misc_feature: GYAE6OF01EIA48.47.48.E04.1.454.CMB.1.raw
tcagagctcacgtacacgaccggtgctcgatttagagagcgtcacagagagaaggggctcagagaggagccttagccctggactccaaggcctttccacttggtgatcagcactgagcacagaggactcaccatggaagttggggctgagtcgttgggttttccttgttgcttattttagaggtgtccagtgtgaggtgctaagttggtgcaagtcggtgggggaggtcgtttgggtcccgacggtccggttccggggggtcccctcgacggtaccttcctccgttggtcgcgacgtcccgttcgtggtactttccttacctttttacgttcccttcgttggtagttggtaaggtttcgggtcccgtccgtacggtaccgtacggacgggggaacggggtcgtaggggtagggttggggttacggaccgtaaacgtaataaacgtacgaagtacgtagggaaacgtacgaaagtaaaaccgttagttacggtacggtacttcgtacgtaggaaccgggtacctacttaccgactacgttccgtaacgaacggtaacgaaacccgaaccggaaccctaaacgtaaacccgtttccttaccgttttacggttttaccgtaacgtaaccgtaacggtaacgtaacggtacgtaccgttagggaaacggtaccggtaaccgggaaacgtacccggtaccggttacgttcggttacgtttaacggtttaacggttggtttacggttacggttccttaccggttcccggtaccccggttcccggggttacccccgggtacccggtttaccccgggttttccggttcccgggtttaccccggggg

SEQ ID NO: 136343 - DNA, 875 bp, Homo sapiens
  misc_feature: GYAE6OF01ALOIE.47.48.E04.1.454.CMB.1.raw
tcagagctcacgtacacgaccggtgctcgatttagagagcgtcacagagagaagggggaatcagtcccactcaggacacagcatggacatgagggtccccgctcagctcctgggctcctgctgctctggttcccaggtgccaggttgtgacatccagatcgacccagtcctccactccctcctgtctgctactctgtaggagacagacgtcaaccatcctaccgttcgggccgggcgtacggtaccggaggggtcgttacgactaagtcgtaccgtttcggtccgtttggtttaccgacgtaccgaagaacccgaacccgggtaacgggaaacccggtacccccgtaacggtcccgtacccgttagtaccgttcttacggttgggtaccgtactaacgttaccttacggtttacggtaacggtaaacggggttccgggtaaccctaacgttaaccggtaacgggttccgaacgggtaccgggtacgtaacgggttacgggtccggtacggggtaaccgtaaggttaccgttaccgtaaccgtttcctaacgttaaccgtaacgtacccgagggttccccgtcggtaacgacccgttaacgtacccggttaagtaaacgttcttacccggtaactaacccttttaacgtttacccgttaacttcccgttaccgtaccgtaacgtttaacgtaccgttaccgttaccggtttaacccttaccccgggttaccgggtttaacccggtttaccggggaaaacccggttaaacccggggttaccgggaaaaacgggttttaacggaaaaccttaaccccggtaaaacgggttaccggtttacggggttaccgaacgttaccgtaaccgtacccgtttacg

SEQ ID NO: 136344 - DNA, 751 bp, Homo sapiens
  misc_feature: GYAE6OF01BC10R.47.48.E04.1.454.CMB.1.raw
tcagagctcacgtacacgaccggtgctcgatttagagagcgtcacagagagaaggggaggaatcagtcccactcaggacacagcatggacatgagggtccccgctcagctcctggggctcctgctgctctggttcccaggtgccaggtgtgacatccagatcgacccagtctccatccctccctgtctgcatctggtaggagacagagtcaccatctacttcggccgggcgagtcgagggtcgttgactaaatcgtctttggccgttggtttcagcagaccgaccgacgggacggccctaagccgcctgactctagtggtcgctaagtactacgttacggacgtaaacggttcgggtaccctagtacgtaaaggttcacggtcggaccgtagggtacgggtcgtaggggaacgtacggtaacgtttccacttctaccgtactacgtacgacggttccgggacctacggaccgtacgggtacccgtacggtaaacgttaccgtttccgaacggttaacccttaaacttttaaccgtttaccgtttcgttaaccccgttccgttaagtttaacgtaacgttagtttacccggttacccgtttaccccgttaccgggtttaccccgtttaacccgggaaacccgggtaaaccggggttaacccggttaaagggggttaaacggtaaaacccgtaaaccggttaaacccggtaacgggtttcggttaacgggaccttaccggacccgttaaaccg

SEQ ID NO: 136345 - DNA, 868 bp, Homo sapiens
  misc_feature: GYAE6OF01E0KA4.47.48.E04.1.454.CMB.1.raw
tcagagctcacgtacacgaccggtgctcgatttagagagcgtcacagagagaagggggaatcagtccccactcaggacacagcatggacatgagggtccccgctcagctcctggggctcctgctgctctggttcccaggtgccaggtgtgacatccagatcgacccagtcctccactccctccctgtctgcatctggtaggagacagagtccaccatcacgttggccggcgagtcgaggggtcgttcgactaaagtgtcgtttcggccgttggtttcgagcacgaccgaccggaacggggaaccggaccccgtaaacggccgtacccgtcgtacgttaccgttaaggttcgggttcgtactaacgttaaccgttaacctttttacggaaccgttaaaacgggttccgggggttacccctaacgttacgtaaacggggtttaccgacgggtaccgggaccgtaacgggtttacgggttaccgggtacgggtaacgtaacggttacgtttacccgtaccgttacctaccgtaaccgttacgtaccgtaaccgggtcccggttccgtacggtaccgtacccggtaccgttaacggtaaacgttaaccgttttccgtaacggttaacccgtttaaccgttttaacctttaaccgtttaccgtttaccgttaacccgttacgtttaacgttacgttaacggttaccgttaccccggtttaaccccggttaccgggttacccggttttacccgggaacccgggttaaaccgggtaacccggttaaacggggttaaacggtaaacgttaaacccggtaaaacgttaaccggttacgggttacggtaaccggttcgtacccgtaacccgttaccgg

SEQ ID NO: 136346 - DNA, 930 bp, Homo sapiens
  misc_feature: GYAE6OF01ELWJ1.47.48.E04.1.454.CMB.1.raw
  modified_base (143)..(143): a, c, t, g, unknown or other
  misc_feature (143)..(143): n is a, c, g, or t
  modified_base (152)..(152): a, c, t, g, unknown or other
  misc_feature (152)..(152): n is a, c, g, or t
tcagagctcacgtacacgaccggtgctcgatttagagagcgtcacagagagaagggggaatcagtcccactcaggacacagcatggacatgagggtcccccgctcagcctccgtggggctcctgctgctctggttcccaggtnccaggtgtnacatccagatcgacccagtcctccatccctcctgtctgctatcgtaggtaggactacgagacgtaccacctatcctacgttcggccgggcgaggtcggaggggtcgttacgacgtaagtcgtacgttttcggaccgttggtttcgagtacaacgaccgaaccggaacggggaaccggtaccccgtaacggccgtcgtacggtaacttcgtacggtcggtacgtactacttaccttacgtttacgaacggtaaacgggttccgggttacctaacgtaaccgtaacgggttaccgacgggtacgggtacggtacggttacgggtacggtacgggtaacggttaacggttaccgttttacccgttaaccgttacccgttacccgttaaacgttaccggttaccggaaacccggggttccccgggtaccgttaccggacccggtaacccggtaccgttaacggggtaaacccttttacgtttaccgttaaccgggttaaaccctttttaaccgttttaaccgtttaccgtttacccggtttaccctacgtttaacggttacgtttacggttacgtttacccgtttaccccggttttaccccgggtttaccggtttaaacccgggttttaccccggggaaacccggttaaacccggggggtaaccgttaaacccgggggtttaaacgggtaaaccccgtttaaaaccgggtaaacccggggttaaccgtttaccggggtacggttacccgtaaccggttaaccccggtaaccgtttaacccgg

SEQ ID NO: 136347 - DNA, 881 bp, Homo sapiens
  misc_feature: GYAE6OF01EWMMN.47.48.E04.1.454.CMB.1.raw
tcagagctcacgtacacgaccggtgctcgatttagagagcgtcacagagagaagggggaatcagtcccactcaggacacagcatggacatgagggtccccgctcagctcctgggctcctgctgctctggttcccaggtgccaggtgtgacatccagatcgacccagtcctccatcctcctgtctgcatctgtaggagacagagtcaccatccacgttcggccgggcgaggtccgaggggtccgttagacctaaagtcggtcgtttacggccgtttggtttaccgacgtacaacggtaaccgaaccggaaacgggggtaaaccggtaccccccgtaaacggtcccggtacccggttaccggtaacgttaccgttaacggttcggggttacgtaaccgtaaaccgtttaaccgttaaccgtttttacgggaaaccggttaaaaccgggttaccggggggttaccccctaaggttaccggtaaaacgggtttccgaacgggacccgggtaccgtaacgggttaacgggttaccggtacggggtaaacgtacggttacgttaccgtaccgttaccgtaccgttaaccgttaacgtaccgtaccgggtacccgggtaccgtacggtaccgtaaccggtacccgttaacgggtaaacgttaccgtttacggtaccgttaaccggtttaaaccttttacgtttaaccgttccggtttacccttaccggtaacgttacgtacgttacgttccgtacccgtttacccggtacggtttacccgttaccgggaacccggtaaacggggtaaccgtaagggtaacggtaaacgtaaacccggtaaagttaaccggttcgggttaacgtacgtaccgtccgtaaccgttaccgg

SEQ ID NO: 136348 - DNA, 732 bp, Homo sapiens
  misc_feature: GYAE6OF01DEL4E.47.48.E04.1.454.CMB.1.raw
  modified_base (175)..(175): a, c, t, g, unknown or other
  misc_feature (175)..(175): n is a, c, g, or t
  modified_base (205)..(205): a, c, t, g, unknown or other
  misc_feature (205)..(205): n is a, c, g, or t
  modified_base (235)..(235): a, c, t, g, unknown or other
  misc_feature (235)..(235): n is a, c, g, or t
tcagagctcacgtacacgaccggtgctcgatttagagagcgtcacagagagaaggggaggaatcagtcccactcaggacacagcatggacatgacgggtccccgctcagctccgtggggctcctgctgctctggttcccaggtgccaggtgtgacatccagatcgacccagtccncctatccctcctgtctgcatctggtagganacgagactccacatcgacgttcggccgganaacgtcagacacaattaacgcgtagttaatttaaagttggtaactaccgaacgtaaacgaaaccggaacgggtaaccctaccccctaacctccgtagtacttacgtatcgtactcgtactactacgttagtcgactaacggttacggggtccgggtaccctaaggttccggttacggttacgaacgggtcggtacgtagggtacggttaacctcggggtaacggaccgttagttacctttaccgtacctacctaccgtaacctacgtacgtaacgtacgttacgtccgtacggtaaccgtaaccgtagtaacgtttagtttaccgaacttaaccgttacgtaccgttataaccgaacgttacgttaccggttaacccggttaccctacgtttaccggttaccggaaccggtaaccggtaacccgtaacggtactacgtaaacgtaaccgaaccggttacgtacgggtacgtccgtaccgtacctaccgtcgttaccg

SEQ ID NO: 136349 - DNA, 865 bp, Homo sapiens
  misc_feature: GYAE6OF01BGSUT.47.48.E04.1.454.CMB.1.raw
tcagagctcacgtacacgaccggtgctcgatttagagagcgtcacagagagaagggggaatcagtcccactcaggacacagcatggacatgacgggtccccgctcagcctccgtgggcctcctgctgctcgtcggttcccaggtcgccgtaggtgtacgactacgtaccgaagtacgtaccgaacccgtacgttccctaccctaccttcccccgttcccgttcgtcctacgtacctaacgttccggtagggtaacggaacgaacgtaggtacctacccaacctactaccgtaccggttccggggacccgggtacgtacgggtacggtacggggtacgttacgaacgtaacgttcggttccggtttccggtccgtttacggttaccgacgaccgaacgtaacccggaaccgggtaacgggaaccccgtaccccgtaacggcccgttacgtacgtacgttaccgttaggacggtactaactacgttaacgttaccggttaagaacggttaaccgggtccgaaccttagtacggtaacgtcgacgggtcggacgttacggtaggtacggtacgtaacgtagttacccttacgtacctcgtaaccgtacgtaaccgccgtaacgtacccgaccgttccgtaacgtaccggtaccgtaccggttaagttaacgttttcttaccgtaaaccgttttaagtttccttaccggtcctttacgacgttaagttacgtaccgttcgttaccccgttaacccgttccggtacggtttacccggtaaccggtaaaccggtaaccggtacgtaaacggtaactaaaccgtaacccgtaaagtcggtacggcccgtaactcccggtaacttccgttacg

SEQ ID NO: 136350 - DNA, 748 bp, Homo sapiens
  misc_feature: GYAE6OF01EZIOP.47.48.E04.1.454.CMB.1.raw
  modified_base (228)..(228): a, c, t, g, unknown or other
  misc_feature (228)..(228): n is a, c, g, or t
tcagagctcacgtacacgaccggtgctcgatttagagagcgtcacagagagaaggggaatcagtcccactcaggacacagcatggacatgagggtccccgctcagctcctggggcctcctgctgctctggctcccagataccagatgtgacatccagatcgacccagtcctccactcctccctgtctgcatctgtaggacacacagtcaccatccacttcggccgggngtacgtcgacggactagttacgactaatttagttagccttggtactcgagacgaacgaaaccgtagggtaaacgttacctaagtcctaccgtagacttcttacttcgttactacttacctacgtttcgacgtaacggttccgggtacctacgttcgttcggttctacggtcggcgtaaggtcggtacgttcgtacgggtactaggttacttttccaacgttcctacctaaccgtacgttacgaacgtaccgtacggtcccgtacggaccgtacggtacccgtaaggtacggttaacgtttcggtttaccgtaacctttaaacgtttttaaccgttaaccgtttaaggttaaaaccttaaaaacgtttaacgttaaacccggtacggttacccgtacccccggttacgttacccggttaacccgggtttaccggggaaccgggtaaacggggaaccgtaacggggtacggtaaacgtaacgtaaaccgtaaaccggtaacgttcggtaccggtcgtaaccg

SEQ ID NO: 136351 - DNA, 827 bp, Homo sapiens
  misc_feature: GYAE6OF01BSEYS.47.48.E04.1.454.CMB.1.raw
tcagagctcacgtacacgaccggtgctcgatttagagagcgtcacagagagaaggggctcagagaggagccttagccctggactccaaggcctttccacttggtgatcagcactgagcacagaggactcaccatggaattggggctgagctgggttttccttgttgctattttagaaggtgtccagtgtgaggtgcaattggtgcaatcgtgggggaggcgttggtccaggccgtcggggggtccctcgacgacctctccgtgtgcacgcctcgtggtacttctaccttttacgttccttcttggatgtaagttcgggtcccgccgagcctccggaggggaacggggcgtgggaggttggggttggactaaacaagtaaacgtccgaaggtaagtagggaacgtacgaaacgtaaaaaccctagttacggtagggtacttccgtacgtaggaacggggtcctaacgttccaacccgtattccctaccgaagtaacgaacccgaaaccgtaccgaaaacggtaaccttccgttacccgtttacgttttacctacggtaaacccgtaaacggttaggggaacccctaaggtacccccggttaagggtaaacgggttaaccggttaaaccggggaaaaccgggtaacccggaacccgggtttacggttagggtttaacggtttaaaccgttttaaccggttgggtttacggttttaccgttccggtttaccccggttaccggggttaacccgttccccccggggttacccgggggttaaccccccgggttcccggttttacccgggggtccgtttttacccccggggggg

SEQ ID NO: 136352 - DNA, 650 bp, Homo sapiens
  misc_feature: GYAE6OF01EH13T.47.48.E04.1.454.CMB.1.raw
  modified_base (232)..(232): a, c, t, g, unknown or other
  misc_feature (232)..(232): n is a, c, g, or t
tcagagctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatcgacccagtcctccatccctccctgtcctgctatcgtgtaggagacagagtccaccatcacttcggaccgggngacgttcgagggtcgttgactaagtgtcgtttcggccgttggttcagtcgagaccaccgacgggaacgaccccgtaaggccgtaccgtcgtacttcgtagtggtcgtactaactactacgttttagacgtaacggtcggggtacccagttacgaagttcgaacgtcggacgtaggttcggtacgtagggacgaagtacgttacacgtctacgtactagtcgacggcgtactcgacgaccgtacgtaggtaacgttcttcgtacgtaccttaacgtttacttaacgttcgtaccttacgtacgttagtacgttactcgttacccgttaccgttacggttaccggtttaccggaccgtaacgggtaaccgtagggtaacgaaactacgaaacgtaccgtggtacggactcgcctcgtacg

SEQ ID NO: 136353 - DNA, 818 bp, Homo sapiens
  misc_feature: GYAE6OF01C0XMG.47.48.E04.1.454.CMB.1.raw
  modified_base (243)..(243): a, c, t, g, unknown or other
  misc_feature (243)..(243): n is a, c, g, or t
tcagagctcacgtacacgaccggtgctcgatttagagagcgtcacagagagaagggggaatcagtcccactcaggacacagcatggacatgagggtccccgctcagctcctggggctcctgctgctctcggttcccaggtgccaggtgtgacatccagatcgacccagtctccactcccgtccctgtctagctatcgtaggtaggacgacaggtactccaacctatcctacgttcggccgggngaggtcgagggtcgttagataagtgtcgtttcggtccgttggttaccagtcaacgaccgacggaacggggaacccgacccctaaggccggacctgacgttcgtagtggtcgactaatacttacgttacgagtaacggttcgggtaccctaagtaccgtaacggttcgaacggtcggtacggtacggttaacgggtcggtaacggggtaacctaagggttaccgttaccgtaaccttccttacccgaacgttaccgttaccgacgggtccccggtacccgtaggacccgtacggtcccttaaggtaacggttaccttacggttacttaaaccgtttaacttttaaccgttacgttacgtttaccctaaccggttacgttacgttacgtaacgttccccggttaccgtttacccccgggttaacgggttacccgttaacccgggtaaacgggaaaaccggggttaacccggttaaagggggttaaaccgttaaaaaccggtaaaccggttaaaaaccgggttacccggtttcgggtaacccgggttacgtaacccgtacccgtaaccgtttaaccgg

SEQ ID NO: 136354 - DNA, 759 bp, Homo sapiens
  misc_feature: GYAE6OF01B6861.47.48.E04.1.454.CMB.1.raw
  modified_base (189)..(189): a, c, t, g, unknown or other
  misc_feature (189)..(189): n is a, c, g, or t
  modified_base (203)..(203): a, c, t, g, unknown or other
  misc_feature (203)..(203): n is a, c, g, or t
  modified_base (519)..(519): a, c, t, g, unknown or other
  misc_feature (519)..(519): n is a, c, g, or t
tcagagctcacgtacacgaccggtgctcgatttagagagcgtcacagagagaaggggaggaatcagtcccactcaggacacagcatggacatgaggtccccgctcagcctccgtgggctcctgctgctctggttcccaggtgccaggtgtgacatccagactgacccagtcctccactcctccctgtcngcatcgtggtaganacgagtagccacgatcgacgttcggccggagtagtcggagggtcgtagacaagttcgtcgttcggccgttggtttacgacgacgtacgacccgaccggaacgggggtaaccgtacccccgtaaaggcccgttccgttacggacgttaccgttaaggttcgggtacgtaccgtaactttaacccgttaccgtttacgggaaccgttaaacggggttccggtaacccctagtaaccgtaacggttcgaaccggtcggactaagggtcggtccggtaaggaccgtaggtcgtaccgtacttcgtactaacgtagtaccnggtaccgacgtccgtagacgttgttaacgtagtaagttacttttaggaaccttaagtttacttaacgtcgttaacgtacgtaacgttaacgttaagttaaccgtaccggtaccgttcccgtaccgggttaccgttaccgggaaccggtaccgggttacgtaaacccggtaggttaacgtaaacccgggtttaaacgtaaaccggttagggtacggtacccgttaaccggtcgtaaacccg

SEQ ID NO: 136355 - DNA, 662 bp, Homo sapiens
  misc_feature: GYAE6OF01DXHNN.47.48.E04.1.454.CMB.1.raw
  modified_base (227)..(227): a, c, t, g, unknown or other
  misc_feature (227)..(227): n is a, c, g, or t
tcagagctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatcgacccagtcctccatccctcctgtctgcatctgtaggagacagagtcaccatcacgttcggccgggngagtcgaggggtcgttgactaatgtctttcggccgttggtttcagcacgaccgaccgaagggacggacccctaagccgccgtagacgtctagtcggtgactactactactttagacgtaaggtcgggtaccagtacgtaaggtcaggcggtacgtaggtacggtacgtaggacgtagtacgttacgtaccttacgtactacgttactacgtacggccggtccgcgacgacgcctagtacgtacttacgtcgtacttaactttacttacgttacgttacttaccgtaagttacttacgtacgtttaccgttacccgttacccggtaggttacccggttaccggtaaccggaacggggtaaaccgtaacggggtaacggtaaacgtaaaccggtaaacgtaacggtacggtacggaccttacggaccgtaccgtacg

SEQ ID NO: 136356 - DNA, 655 bp, Homo sapiens
  misc_feature: GYAE6OF01C74LP.47.48.E04.1.454.CMB.1.raw
  modified_base (342)..(342): a, c, t, g, unknown or other
  misc_feature (342)..(342): n is a, c, g, or t
  modified_base (367)..(367): a, c, t, g, unknown or other
  misc_feature (367)..(367): n is a, c, g, or t
tcagagctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatcgacccagtctccatccctccctgtctgcatctggtaggagacagagtcaccatcacttggccgggcgagtcgaggggtcgttgacaaagttgtcgttttggccctttgggtttcaaggcaacggaccaaccgacggggaacggccccgtaaacgccgcctggactctagtggtgactatacncttacgactaaaggtcgggtacccngtacgtaacggttcgacggcggtcgtacggtagggtccgtaggggaacctaggtacgtttacctacgttcctacgtaccttagtaccgacggccggtcctgtacgacgtcctaggtaacttacttccgtagtacttaaccgtttaattacgttcgttacccttaccttaaggtacttagtacgttaccgttcctttaacccggtcgttaccgttccggaccgtaacgggacgtaaagggtacggaaactaacgaaacggtacgtcggtagtccgtacgacctacgtac

SEQ ID NO: 136357 - DNA, 746 bp, Homo sapiens
  misc_feature: GYAE6OF01CQB41.47.48.E04.1.454.CMB.1.raw
tcagagctcacgtacacgaccggtgctcgatttagagagcgtcacagagagaagggggaatcagtcccactcaggacacagcatggacatgagggtccccgctcagctcctggggctctgctgctctcggttcccaggtcgccaggtgtgacatccagatcgacccagtcctccactcctccctgtctgctatcgtagaggacgacagacgtcaccagtctacgttcggccgggcgagtcgaggggtcgtagactaagtcgttcgttcggtaccgttggttacagaccgagaaccgtaccggacgggtaaccggtaccccgacggtaccgccgtagtactcgtaggtggacgtactaacttactacgttagaacgtaacgggtccggttacccaagttacggtaacggtcggacggtaccggtgtaagggttcgtacgggtacggtactaggttaccttccgacttaccgaactccgttacgtaccggaaccgggcgttacctcgaacgttacaccggtataacggtcctcgtacttaacccgtaacgttttacgtacgttcccgttaacgacgtttacgtagttaccgtactttcccgttacccggttaccgttacccgggggttaacccgtaaccgggtacccgggaaaggggtaaacccgttacggaaaaccggggttaaacctacccggtaaaacggtttggaccggggtacgtaccggtaacccgtacccgttacttcggg

SEQ ID NO: 136358 - DNA, 865 bp, Homo sapiens
  misc_feature: GYAE6OF01DF0RL.47.48.E04.1.454.CMB.1.raw
tcagagctcacgtacacgaccggtgctcgatttagagagcgtcacagagagaaggggaggtctcagagaggagccttagccctggactccaaggcctttccacttggtgatcagcactgagcacagaggactcaccatggaagttggggctgagtcgttgggttttccttgttgtcttattttagtaaggttgtctaggtgtgaggtgactaagttggtgtacaagtcggtggggggacggtcgttggtccgacggtcccggtcgggggggttcccctacgacgtaccttcccgttccgttggtcgactaccggcccttcgtacggtactttaccgttacccgtttttacggtttcccttacgtttcggtagtttacgggtaaacggtttccgggggtccccgtaaccggtaacggtaccgtaccgggaaggggggtaacggggtcggttaggggaggtttcggggtacggtaacgtaaactaagtaaaccttaccggaagtaacggtaaggtaaacggtaaccgaaacggtaaaaaccgttagttacgggtaacggtaccgtttaccgttacggtacgggtaaccgggtacccgtaacgttacccaacccttaatcccgtaacgtaacggaaacgtaacccgaaccgtaacccgaaaggttaacccctttcgtaccgttttccgtttacgtaagtaaacgtaacggttaacgaccgtaacgtccgtaaggtacggaaacggttaccgaaacgtaaccggtacgggttattccggttaagtttctttaacgggttgttcggtttacgtcgttaccgccggttacctacggggtcccggttaccggtccggtttcggttacccggg

SEQ ID NO: 136359 - DNA, 841 bp, Homo sapiens
  misc_feature: GYAE6OF01ET5X1.47.48.E04.1.454.CMB.1.raw
tcagagctcacgtacacgaccggtgctcgatttagagagcgtcacagagagaaggggaggtctcagagaggagccttagccctggactccaaggcctttccacttggtgatcagcactgagcacagaggactcaccatggaagttggggctgagcgttgggtttttccttgttgtacttattttaggaaggtgtccagtgtgaggtgctaagttggtgactaagttcggtagggggacgtcgttggtccgacggtcccggttggggggtcccctacgacgtacctacttccgtgtcgcacgtcctcgttggtacttccttacttttacgttccttggttaggtaagtacgtaaaggttccgggttcccgaccgtacggtaccggttaccggaacggggggtaaggggtccgttaagggggtacgggtttacggggttacggaaccgtaaaacgtaaacgtttaaaacgtaccgaaaggtaaggttaacgggtaaaacggtaaccgtaaaaaccgtaaaaaccgttaggtttaacgggtaacggttaacccgttaccgttacggtaacggggtaaacggggtcccttaacttttaccccggaaatacccgtttacccgtaacgaaacgggaaccaaacggtaaacccccgtaactaaaacgggttacccttccggttacgtttacggtttaaccgacgtaacgttaaacgcgggtaaccacggtacccgtaaggtaacgtacgtaaccggaacgaccgcggttactggttaactttaggtacttgggtcacgttcccgttggacgtaccggtccgtaacccggccgttcggttcggtcccgg

SEQ ID NO: 136360 - DNA, 765 bp, Homo sapiens
  misc_feature: GYAE6OF01AT8OQ.47.48.E04.1.454.CMB.1.raw
tcagagctcacgtacacgaccggtgctcgatttagagagcgtcacagagagaagggggaatcagtcccactcaggacacagcatggacatgagggtccccgctcagctccgtggggctcctgctgctctcggttcccaggtcgccgaggtgtgacactccaagatcgaccctagtcctccacttcctcctgtctcgctacgttctaggtaggacgtacgaacgtacgtaccactataccgtacgttcgggaccgggtacgtacggtcggaacggggttcgttacggaactaaacgttcggttaccgtttcggtccgttacggtttaccgacggtacaaccggaccgtaaccggaacggggtaacccggtacccgtaacggccgtaccgtacgtacgtacgttaggtcggtacacgtaacttaccgtacgtttacgaacgtaacggttacgggtacctacgtacgtaacggtcgacggccggtacgtaacggtcggtacggtacggtaacgtacgttacgtaccgtaccttacgtacctacgtacgaccgtaggcccggtctacgaacgtacgtacgttaacgacgttcttacgtagtaaccttaatttaccgtagttacctccgttaacgtagttactacgtacttacccgtaccgtttaccggaccggtttaccgttaccgggaaccggtaacggtaacggttaacgtaacggtaaacaacggttaacgtacgtacgacggttaaccacgtaccgtacgttacg

SEQ ID NO: 136361 - DNA, 748 bp, Homo sapiens
  misc_feature: GYAE6OF01BSUZV.47.48.E04.1.454.CMB.1.raw
  modified_base (191)..(191): a, c, t, g, unknown or other
  misc_feature (191)..(191): n is a, c, g, or t
tcagagctcacgtacacgaccggtgctcgatttagagagcgtcacagagagaaggggaggtctcagagaggagccttagccctggactccaaggccctttccacttggtgatcagcactgagcacagaggactcaccatggaagttggggctgagtcgttgggttttccttggttgcttagtttagaggtntccgagtgtgaggtgactaagttggtgactaagtcggtggggggaggtcgttcggtccgtacggtcccggtcggggggtcccctcgacgtacctcctccgtggtcgcagtcctcgtggtacttcctaccgttttagttcccttcgttacggagttacggttaacggtttccgggtcccgaaccgacggtaccgtaccggaacgggggtaacgggtcggtagggtacgggttggggttaccgaacgtaaaccgtaaggttaaaccgtccgtaaggtaacggtaaggtaacgtaacgaacgtaaaaccgttagtacggtacgtacgtcgtacggtacggtacgggtaccctagttaaccccacgtacttccgaacccgaaggtacgaaaccctaacccggacgttaaactaccgttacgttcgttaccgtttacgacgtaacctaagggccgtacgacgtacctaggacggtcgtaacgatcggagttgtagtacgttacgtgtgtaccttcgtcgccgtcggacccgtccggttaccggaccgtccgtttgccccggg

SEQ ID NO: 136362 - DNA, 828 bp, Homo sapiens
  misc_feature: GYAE6OF01A9IBV.47.48.E04.1.454.CMB.1.raw
tcagagctcacgtacacgaccggtgctcgatttagagagcgtcacagagagaagggggaatcagtcccactcaggacacagcatggacatgacgggtccccgctcagctccgtggggctcctgctgctcgtcggttcccaggtgccgaggtgtgacactccagatacgacctacgtcctaccactcccttcccttgtcctgctactcgtaggtaggtacgacgaggtactaccacctatacctacggttccgggccgggacgtacggtcggtacggggtccgttacggaactaagttcggttcgtttccggtccgtttcggttaccacggtaccgaacgaaccggaaccggtaaaccggggacccgggtacccccgtaaccggtccggtacccgttaggtaccgttaccgtttacggttacgggttacgtaccgtaaccttaacgtttaccgtttacgggtaacggttaaccggggttaccgggttaacccgtaacgttaacgttaacgggttcggaccgggtaccggtacgttaaacggggttaccggttacgggttacggggtaaacgtaaccggttacgttaccgtacccttacgtaccgtacgtacgtaccggtacgcccggtcgtcgacgtaacgcgtaacggttaacgttcttacgtaacgtaacttaacctttagttacttccgtaaccttactagttctacgtaccgttacgtacccttaccgtacggttaccggtcccggtaaacggtaacgggtaacgtaaggtaacgtaaccgtaaccgtaacgtacgtacggacggtaatcggtaacctcgttacg

SEQ ID NO: 136363 - DNA, 774 bp, Homo sapiens
  misc_feature: GYAE6OF01ESNQ6.47.48.E04.1.454.CMB.1.raw
  modified_base (213)..(213): a, c, t, g, unknown or other
  misc_feature (213)..(213): n is a, c, g, or t
  modified_base (630)..(630): a, c, t, g, unknown or other
  misc_feature (630)..(630): n is a, c, g, or t
  modified_base (651)..(651): a, c, t, g, unknown or other
  misc_feature (651)..(651): n is a, c, g, or t
tcagagctcacgtacacgaccggtgctcgatttagagagcgtcacagagagaagggggaatcagtcccactcaggacacagcatggacatgagggtcccccgctcagctccgtggggcctcctgctgctctggttcccgaggtgccaggttgtgacactccagatcgacccagtcctaccactcccttccctgtctgcctatcgtagtagganacgagacgtaccaaccatcctacgttcggcccgggacgtaggtcggaggggtcgtttacggaactaaagttcggttccggttttacggtccgtttacgggtttcgaacggtaccgaacggtaacccgaaccgggaaccgggggtaaacccggtaacccccgtaacggtccggtacccttaggtaccgttaccgttaaggtcgggtacgaaccttaacgttaaccgttacgtttacggaaccggtaaacgggttccggggtaacccctagttaaccggtaacggttcgaacgggtccggtacgtacggttacgggttacggacgggtaacgtacgtacgttaccacgttctaccgtacctagtcgacggtccgtcctgactacggtcctaagaactacgttctacgtacttaacgttntactcgtactacgtagttacncgtacgtcgttacccgttaccggtacgttacggtaacccggaccggtaacggtaccggtaaaggtacgtaaacgtaccggtaaacgtacggttgaccggttaacctcgtaaccgttacgtccg

SEQ ID NO: 136364 - DNA, 848 bp, Homo sapiens
  misc_feature: GYAE6OF01EQZIF.47.48.E04.1.454.CMB.1.raw
tcagagctcacgtacacgaccggtgctcgatttagagagcgtcacagagagaagggggaatcagtcccactcaggacacagcatggacatgagggtcccccgctcagctcctgggctcctgctgctctggttcccaggtgccgaggtgtgacatccagatcgacccagtcctccacttccctccctgtctgctatcgtggtaggagacagactccaccatcacgttcggccgggagacgtcggacgggtcgttagactaaagttcgtccgtttcggtccgttggtttcagacaacgaccgacggacgggaaccgaccccgtaaggccgtccgtagtacttcgtagtcggtacgactactacttacgtttacgacgtaacgggttccggggtaccctaacgttacggtaaacggttccgacggtaccgggtacggtaacgggttacggggttccggtaacggggaaccgttaaagggttaccgtttacccgtaaccgtttacccgtaaccgttaaccgttaacgtaccgggtacgggtaccccggtccgttacggaccgtaaccggtacccgttaaggtaaacgtttccgtttaaccggtaccgttaaaccgtttaaccgttttaacctttaaccgtttcgttaacccgttacgttaacgtttacgttaccggttaacgttacccgttaccccggttttaccccggtacgggttttaccccggttaccgggtaaacccgggtaaccgggttaaaccggtaaacggggttaaaccgtaaaaccgttaaacccggttaaaccgttaacggttaccgggtacggtaccgtaccggtaccgtaccgttaaccg

SEQ ID NO: 136365 - DNA, 818 bp, Homo sapiens
  misc_feature: GYAE6OF01A4AZQ.47.48.E04.1.454.CMB.1.raw
tcagagctcacgtacacgaccggtgctcgatttagagagcgtcacagagagaaggggaggaatcagtcccactcaggacacagcatggacatgagggtccccgctcagctcctggggctcctgctactctggctccggaggtgccagatgtgacatccagatcgacccagtctccatccctccctgtctcgctatccgtagtaggacacaggtacgtcacctatcctacgttcggccgggacaagtcaagacgactaagttaaaccaggtaccgttaagttttaaaacgttgggtaacttaccgaaacccgaacggaaaaaccccgaacggggaaaacccggtacccccctaaacccttcctacgtaacgttacttaacgtcgtactcgtccctaacttcccgtaggttttacgacgttaagttaccggtaccggggttacccctacgttacggttaacggtttaaccgtaggttacggtacggtaacggttacgggttaactaccgggtacgggtaaccgtaacgttaacgtttaccgtaccttaccgttacccaacccttactaccgaacggtacctacgtaccgtaacgtaacccttaaaccgtagtaacgtttagttttacgaaccgttaaacctttaccgtttaaccgttacgtaaccgtaacgtaacgttaacccggttaacccggttaccccgttaacggtttaccgtttaccgggaaccgtaaacccgggtaaaccctaacgtaaccggaactaaccgaaaccgttaaacgaacgttacgggtacgtacctaacgtccgaacgttaaccg

SEQ ID NO: 136366 - DNA, 781 bp, Homo sapiens
  misc_feature: GYAE6OF01D6WGZ.47.48.E04.1.454.CMB.1.raw
  modified_base (236)..(236): a, c, t, g, unknown or other
  misc_feature (236)..(236): n is a, c, g, or t
  modified_base (272)..(272): a, c, t, g, unknown or other
  misc_feature (272)..(272): n is a, c, g, or t
tcagagctcacgtacacgaccggtgctcgatttagagagcgtcacagagagaaggggaggaatcagtcccactcaggacacagcatggacatgacgggtccccgctcagcctccgtggggctcctgctgctcgtcggtttcccgaggttcgccgtagggtgtgactactaccaggacttcgacccctaggttcctcccacttcccttccctgttcctagctacttcgtggtagganacgaggtactaccaccatctaccggtcgggccgggngacggtcgtacggggtcgtagactaagtgttcgtttcggtccgttggttacgagtacgaacgaccgaccggaacggggaaccggacccgtacggtcccgtccgtagtactcgttagtggtacgctaacgtacttacgttacggacggtaacggttcggtacctacgtagtacggtcgaggtcggacgtaggtggtacggtaggaacgtaggtacgtactacgtacctactactacgtcgacggtccgtccgtacgccgtacgtaccgtaggtactacgttccgtacgttaactttacgtttaacttccgttacgtaccttaacggttagttagtacgttccgttacccgttaccccgttccggttaacccggttacccgggttaaaccgggtaccggggtaaaacccgggttaacggtaaacggggttaaacccggtaaaaccgggttaacccggtaaaccggttaacggttacggaccggggtttactcccggtaaaccgttacccgg

SEQ ID NO: 136367 - DNA, 753 bp, Homo sapiens
  misc_feature: GYAE6OF01B1YWA.47.48.E04.1.454.CMB.1.raw
tcagagctcacgtacacgaccggtgctcgatttagagagcgtcacagagagaaggggaggtctcagagaggagccttagccctggactccaaggcctttccacttggtgatcagcactgagcacagaggactcacagtgaagttgggctgagtcgttgggttttccttgttgtcttatttagaaggtgtccagtgtgagtgactaagttggtgctaagtcggtggggggacgtcgttcggtccgacggtccggttacggggggtccctacgacgtaccttccgtcctggtcgccgtacgtccttacgtacgtacttaccgttaccgtttacgttccgttcgtaggtagttaggtacggttccgggtccgtacgtacgtaccgtaccgggaggggacgggtcggtagggtagggttagggtacgaacctaaacgtaaagtaacgtacgaaggtaacgtaggtaacgtaacgaaacgtaaacgtagtacggtacgtaccgttacgtacggtacggacggtacctactactacgtactacgaccgaagaacgaaccgaacgaaccgtaactacttacgttacgttacgttacgtaacgtaacgtaacggtacggtaacgtaccgtacgtaggtaacggtaacggtaacggacgtaaacggtacggttagttaggttaagttacgttacggttattcggtcgttacggtacgtccggtaccgtacccgggtaccggtccggttccggttcggtcggg

SEQ ID NO: 136368 - DNA, 804 bp, Homo sapiens
  misc_feature: GYAE6OF01EWRME.47.48.E04.1.454.CMB.1.raw
  modified_base (108)..(108): a, c, t, g, unknown or other
  misc_feature (108)..(108): n is a, c, g, or t
  modified_base (220)..(220): a, c, t, g, unknown or other
  misc_feature (220)..(220): n is a, c, g, or t
  modified_base (252)..(252): a, c, t, g, unknown or other
  misc_feature (252)..(252): n is a, c, g, or t
  modified_base (258)..(258): a, c, t, g, unknown or other
  misc_feature (258)..(258): n is a, c, g, or t
  modified_base (696)..(696): a, c, t, g, unknown or other
  misc_feature (696)..(696): n is a, c, g, or t
tcagagctcacgtacacgaccggtgctcgatttagagagcgtcacagagagaaggggagatcacgtcccatcaggacacagcagtggacagttggacgggtcccccgntcgacgtcctccggtggggtcctcccgtgccgttgtcccttcgttcgggttacccgtaggtcgaccgtaggtgtcgactacgtaccaggactacggacccctagtcctaccncgttccctcgtgtcacgtcatcgtagtacganacagtntccaacctagttccgacgttacgggcccgggtacggtacggttacggccggggttcgttaaacggacttaacggtcgtttaccggtttacggttcgtttcggttaagaccgacgtaaacccggaccgtaaaccgggtacgggaaccgttaccccggtacggcccgtaccgtagttacttcggtacggttcggactaccttaattccggttaactacggtaaccggtaacggggttccgtaaccgaacgtggttaacggtccgggacgtacccggttaggtaaggtttaccgacgggtggtaaacccggtcttaaccgttcgttaccgtaccgttaactaccgggacttacggtacgggcccgtccgtacggtccgtaacgtaccgtaacgtactcgttaacgactttacgttacttacgttcccttacgacttaccgnttacgttctaccgtttacgccggtttaccgtaccgttactacccgggaggtaaccggaaacgttaggaaccctaagaaccgtagtacgcgttaccgcgactacgtacg

SEQ ID NO: 136369 - DNA, 843 bp, Homo sapiens
  misc_feature: GYAE6OF01EY8RI.47.48.E04.1.454.CMB.1.raw
tcagagctcacgtacacgaccggtgctcgatttagagagcgtcacagagagaagggggaatcagtcccactcaggacacagcatggacatgagggtccccgctcagctcctggggctcctgctgctctggctccgaggtgccagatgtgacatccagatcgacccagtctccatcctcctgtctgtcttcgtggtaggagacagacgtccacctatctacgttggtcgggacgagtcgtaaggggttattagcctaacgttgggttacgccgttagggtatacctaaaccgaaggtaaaacccgaacggggaaaaccggtacccccttaaccctcccttaccgaacttccctacttaccgtcggacctacttaccctacttttcggaacgtaaacgggttccggggtaccctagtacggtaacggtttcgacggtccggacgtaggtacgggtacgtcggtacggggaactacggttactttaccgaccgttaccttaccgtaacctttacgtaccgaacgggtcccgggtacccgttacggaccgtaacggtaccgtaaggtaacggttacgtttacccgtacgtaaccctttaaacgtttttaccgttaccgttacgttacccgttaaccggtaaggtttacgttacggttaaccgtttccggttacccgttttaaccccggttccggttaacccgggtttacccgggaaacccggtaaaaccggggttaacccggtaaacggggttaaacgggtaaaacccttaaccggtaaaacccgggttaccggttacgggttacgggtaccgttaccgtacccgtaacccgttaagtttaccccgg

SEQ ID NO: 136370 - DNA, 849 bp, Homo sapiens
  misc_feature: GYAE6OF01AECEH.47.48.E04.1.454.CMB.1.raw
tcagagctcacgtacacgaccggtgctcgatttagagagcgtcacagagagaaggggaggtctcagagaggagccttagccctggactccgaaggcctttccacttggtgatcagcactgagcacagaggactcaccatggaagttggggctggacgcgttcggggtttttccttggttcgtccgtttatttttaacggaagggttcgttaccgtaggttggtacggaggttcgactaagtttggggtcacgtaacgttccggtagggggggtaggtccgttacgggtcccgtacgggtccggttccggggggtcccctacgaggtaccttccgttccgtggtcgacgtaccgtcccgttcgtacggttaacttccctaccgtttacgaacggttctaaccttacctacgtacgttaggtaccgtaccgttcgggtaccgttaccccggaccggtaacgggtccccgtaacggggtaacggggtaaaccggggtacgggttaacgggaccgggtaggttacgtttaccgtacccgtttaagacgttacgtaaccgggttaagggttacggttacgggtttaacctttaaacccgtaagttttaaccctaccgtaaccgggtacgtaaccgtaccttcgggttacgacgggtaacgggtccttaccggtacgtaccccggttccaaccgggtacggaaccctaaccgtaccgtaacggtactaacggtaagtacgtccgtacggtagtacccgtaagacgtaccgagccgtaaggccgacgtaccggtacgaaccgtccggttcttacgtcgacggccgacggtgaccttacctctaccgtcgttaccgg

SEQ ID NO: 136371 - DNA, 761 bp, Homo sapiens
  misc_feature: GYAE6OF01C0D56.47.48.E04.1.454.CMB.1.raw
  modified_base (101)..(101): a, c, t, g, unknown or other
  misc_feature (101)..(101): n is a, c, g, or t
  modified_base (141)..(141): a, c, t, g, unknown or other
  misc_feature (141)..(141): n is a, c, g, or t
  modified_base (235)..(235): a, c, t, g, unknown or other
  misc_feature (235)..(235): n is a, c, g, or t
  modified_base (379)..(379): a, c, t, g, unknown or other
  misc_feature (379)..(379): n is a, c, g, or t
tcagagctcacgtacacgaccggtgctcgatttagagagcgtcacagagagaagggggaatcagtcccactcaggacacagcatggacatgagggtccccnctcagctcctggggctcctgctgctctggttcccaggtcnccaggtgtgacactccagatcgacccagtcctccatcctcctgtctgctatctgtaggacacaggactccacctaatccacgttggacccgggngacgtccgaggggttccgttagacctaaagttcggttcctttcgggtccgtttcgggtttaccaaggacccgaacgtaaccgaaccggtaacgggggaaccgtacccccgtaacgccggtccgtagtactacgttagtcggtanacgtataacgtcttaggacgtaaggtccggtaccagtaccgtaggtccagcgtacgagttacgccggttggaactacggtacgttaccacgtcttacgacttaacgcgaacggtcggccgttagaccggtacgtaccgtaggtaaacgttcgttaccgtacgttaaccgttaaacttttcgttacgtacgttacccgttaagttacggtacgtactacggttacccgttaccgtaccccggttaccggttaacccggttcccggaaaccgggttaacggaaaccccggttaaaggggttaacgttaaaaccgggtacgtaaaaaccggttccgtaagggtttacccgacccgtttaaggaccccgttaaaccgtttaaccgg

SEQ ID NO: 136372 - DNA, 731 bp, Homo sapiens
  misc_feature: GYAE6OF01DY5S7.47.48.E04.1.454.CMB.1.raw
  modified_base (192)..(192): a, c, t, g, unknown or other
  misc_feature (192)..(192): n is a, c, g, or t
  modified_base (276)..(276): a, c, t, g, unknown or other
  misc_feature (276)..(276): n is a, c, g, or t
  modified_base (684)..(684): a, c, t, g, unknown or other
  misc_feature (684)..(684): n is a, c, g, or t
tcagagctcacgtacacgaccggtgctcgatttagagagcgtcacagagagaagggctcagagaggagccttagccctggactccaaggcctttccacttggtgatcagcactgagcacagaggactcaccagtggaagtggggctgagtcgttggttttccttgttgcttattttagagtcgtcagtgtgngtgactagttggtgacgtagtcggtggggcgtacgttcggacctacggccggtcgggggtccctgacgtacgtcctcgtagtcncgacgtccgtgtgtacttccgttaccttttacgttccgttgttaggtacgttaggtacggtttccgggccgttaccgacggtaccgtaccgggaggggtaacggggtcgttaggtaacgggttgggttacggaaacctaacgtaaacgtaaaccgttccgaagttaacggtaacggtaaacggtaaccgtaaacgtaaaacgttcggtagtaccgtaccttacgtacggtaggaacggtccgtaactaccgtacctagtacctacggaacgaccgaaacgtaaccgaccgtaacgttacctcgtttaccgttcgttactaacgtagtaaccggttacgaccgtaacgtcgtaaggtaccgaagtacggaacgtacggacgtctagttactagttacgtcgttagttcnctacgcgtccgggtccttacggtaccggtccgttggtcggttcccgg

SEQ ID NO: 136373 - DNA, 766 bp, Homo sapiens
  misc_feature: GYAE6OF01AXSEB.47.48.E04.1.454.CMB.1.raw
tcagagctcacgtacacgaccggtgctcgatttagagagcgtcacagagagaagggggaatcagtcccactcaggacacagcatggacatgagggtccccgctcagctcctggggctcctgctgctctggttcccaggtgccgaggtgtgacatccgagatgacccagtctcctactcctcccgtgtctgctatctggtaaggtagacagacgtccaccatccacgttcggccgggcgaggtacgacggggtcgttaggactaaagtcgttcgttttacggtccgttggtttacacggtacaacggtaccgaccggaacggggaacccggtaccccgtaaacggcccgtacccgtaggtaaccttaccgttaagggttacggttaaccgtaaccgttaacgttaaccggtttaacggttaccgtaaacgggtacgggttacccgtaacgtacgtaacggtacgtacggacggcggtaccgttaggtacggtcgggtaacgtaggtcgttacgtctacgttctaacgtacgtaccgacggtcggtccgtcgactaccgtacgtaccgtaaagtcttaaccgtactaaccgttacgtttaccgttacttacgttccgtaacgtacgttaactaggtacgttacgtcccgttacccggttccggtaacgttacccgggtaccgtaaaacgggtccgtaaagggttaacgtaaaccggaacgtaaaaccgacgttacgggtaccgacgtacgaactcccggttcgttccg

SEQ ID NO: 136374 - DNA, 749 bp, Homo sapiens
  misc_feature: GYAE6OF01A2SVV.47.48.E04.1.454.CMB.1.raw
  modified_base (219)..(219): a, c, t, g, unknown or other
  misc_feature (219)..(219): n is a, c, g, or t
tcagagctcacgtacacgaccggtgctcgatttagagagcgtcacagagagaaggggaggtctcagagaggagccttagccctggactccaaggtcctttccacttggtgatcagcactgagcacagaggactcaccagtggaagttggggctgagcgttgggtttttccttgttgcttattttagaaggtgtcctaggtgtggaggtgcaagttggtncaatcggtgggggagtcttggtccgacggccggttcgggggggtcccctcgagaccttcctcctgtcgcacggtcctcgtcggactcctacccgttttagacctacttctcgtctagtgggtcgtcgggtccgccggacggccggtaccggggagggtcgtagggtggtggtcctacgaaggttcgtagagtagacggtagtcgggtaggaacgctactactttaccgtacggtacgtaccgttaccgggtacggtaaccggggttcccggtaccacgtactcgtaaccgaggtaacaacgttattacggaggaccgtaccgcggtaccttaggtacttaaccggtaaataaacggactaaacgggtcgttaaccgtagggacgaacgggcccgggttaaaggacccgggtaaaccccggtcgtttaacgttttcggtttaacccgttgggtaaacggtaccggtttaaaactttacggtttaccgaacgttaccccggcggtttcccccgaccccccgttaaaccgggg

SEQ ID NO: 136375 - DNA, 673 bp, Homo sapiens
  misc_feature: GYAE6OF01B36RE.47.48.E04.1.454.CMB.1.raw
  modified_base (203)..(203): a, c, t, g, unknown or other
  misc_feature (203)..(203): n is a, c, g, or t
  modified_base (205)..(205): a, c, t, g, unknown or other
  misc_feature (205)..(205): n is a, c, g, or t
tcagagctcacgtacacgaccggtgctcgatttagagagcgtcacagagagaagggggaatcagtcccactcaggacacagcatggacatgagggtcccccgctcagctcctggggctcctgctgctctcggttcccaggtgccaggtgtgacatccagatcgacccagtcctccactccctccctgtctgcatctgtaggananagatccaccatcacgttcggccgggcgagtcgaggggtcgttgactaaagtgtcgtttggtccgttggtttcacgacaacgaccaaccggaaggggaaccggaccccgtaacgccgcctagtactctagtggtgactatactacgttagacggaaggtccgggtacctagtacgtaaggttcgaggacggacgtaggttacggtcggtacgggaacgtagtacgttacaaccttctactacttaacaccgtacggccggtccgtcgacgtaccggaccgtagtaaacgtactttacgtaccgtaaccttaactttaacgttacttccgttacctaccgtaagttatacgtacgttcgttacccttacccgttacggttaccgttaccggtaaccggtaacggtaacgtaagggtaacgaaagttaaccgaaaacgtacgtacggtacgtacgtacgactaccgtaacg

SEQ ID NO: 136376 - DNA, 502 bp, Homo sapiens
  misc_feature: GYAE6OF02JR8WR.47.48.E04.1.454.CMB.1.raw
tcagagctcacgtacacgaccggtgctcgatttagagagcgtcacagagagaaggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcagtcagggcttgcaatgctttggcctggtttcagcagacaccagggaaggcccctaagcgcctgatctatggtgcatacactttgaaaagtgggtcccatcaaggttcagcggcagtaggtctgggacagagttcacgtctcactatcagcggcctgcagcctgaagattctgcaacttatactgtctccagtatgatgtcttacccgtcgtactttcggacctaacgggacctaagggtagaacttcgaaacgtacgtagtcggacttgactaccatccg

SEQ ID NO: 136377 - DNA, 484 bp, Homo sapiens
  misc_feature: GYAE6OF02IFNT6.47.48.E04.1.454.CMB.1.raw
  modified_base (389)..(389): a, c, t, g, unknown or other
  misc_feature (389)..(389): n is a, c, g, or t
  modified_base (394)..(394): a, c, t, g, unknown or other
  misc_feature (394)..(394): n is a, c, g, or t
tcagagctcacgtacacgaccggtgctcgatttagagagcgtcacagagagaaggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcagtcagggcttgcaaatgctttggcctggttcagcagacaccagggaaggcccctaagcgcctgatctatggtgcatacactttgcaaagtggggtcccatcaaggttcagcggcagtaggtctgggacagagtttcactctcactatcagcggcctgcagcctgaanattcngcaattatactgtctccagttatgatgcttacctcggactttcggccaagggaccaaggtggaaatcaaacgactgtaggctgccactac

SEQ ID NO: 136378 - DNA, 558 bp, Homo sapiens
  misc_feature: GYAE6OF02H7X9W.47.48.E04.1.454.CMB.1.raw
tcagagctcacgtacacgaccggtgctcgatttagagagcgtcacagagagaaggggaggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcaggggcgttgcaaatgctttggcctggtttcagcagacaccagggaaggccctaagcgcctgatctatggtgcatacactttgcaaagtgggtcccatcaaggttcagcggcagtaggtctgggacagagttcactctcactatcagcggcctgcagcctgaagattctgctaaactttattactcgttctaccaagttatgtaatcgtcctttacccgttcggaccttttccgggacccgtaaacggggtaaccctaaaggggtacgggtaaaacttaccggaaaacggtaaccgttaggtacgggtaccttacgggtacctaacccg

SEQ ID NO: 136379 - DNA, 529 bp, Homo sapiens
  misc_feature: GYAE6OF02GSYR6.47.48.E04.1.454.CMB.1.raw
  modified_base (198)..(198): a, c, t, g, unknown or other
  misc_feature (198)..(198): n is a, c, g, or t
  modified_base (222)..(222): a, c, t, g, unknown or other
  misc_feature (222)..(222): n is a, c, g, or t
  modified_base (295)..(295): a, c, t, g, unknown or other
  misc_feature (295)..(295): n is a, c, g, or t
  modified_base (391)..(391): a, c, t, g, unknown or other
  misc_feature (391)..(391): n is a, c, g, or t
tcagagctcacgtacacgaccggtgctcgatttagagagcgtcacagagagaaggggaggaatcagtcccactcaggacacagcatggacatgagggtccccgctcagctcctggggctcctgctgctctggttcccaggtgccaggtgtgacatccagatgacccagtctccatcctcctgtctgcatctgtagganacagagtcaccatcacttgccggnagtcagggcttgcaaatgcttggcctggtttcagcagacaccagggaagcccctaagcgcctgatctatggtncatacactttgcaaagtcgggtccagtcaaggttcagcggcagtaggtctgggacagagttcactctcactatcagtcgctgcagtcctgaacgtnttcgagctaacgttattacgtgtacctcgaagttatgtatcgacctttacccgtcggtaccttttcggaccgtaacgggtaccctaagggtcgtaaaactccgtaaaacgtacgtaggtcggacttcggacctaaccg

SEQ ID NO: 136380 - DNA, 496 bp, Homo sapiens
  misc_feature: GYAE6OF02GI9UN.47.48.E04.1.454.CMB.1.raw
tcagagctcacgtacacgaccggtgctcgatttagagagcgtcacagagagaaggggaggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcagggcgttgcaaatgctttggcctggtttcagcagacaccagggaaggcccctaagcgcctgatctatggtgcatacactttgcaaagtgggtcccatcaaggttcagcggcagtaggtctgggacagagttcactctcactatcagcggcctgcagcctgagattctgcaacttattactgttctccagtatgatgcttaccctggtactttcggcctaagggacccaagggtggaactcgaaacgactgtaggctggctaacccg

SEQ ID NO: 136381 - DNA, 474 bp, Homo sapiens
  misc_feature: GYAE6OF02JA6B6.47.48.E04.1.454.CMB.1.raw
  modified_base (391)..(391): a, c, t, g, unknown or other
  misc_feature (391)..(391): n is a, c, g, or t
  modified_base (428)..(428): a, c, t, g, unknown or other
  misc_feature (428)..(428): n is a, c, g, or t
tcagagctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcagggcgttgcaaatgctttggcctggtttcagcagacaccagggaaggcccctaagcgcctgatctatggtgcatacactttgcaaagtggggtcccatcaaggttcagcggcagtaggtctgggacagagttcactctcactatcagcgctgcagcctgaagnttctgcacttattactgtctcagtatgatgcttaccncgtacttcggcaaggccaagtggaatcaacgactgtgctgcactac

SEQ ID NO: 136382 - DNA, 493 bp, Homo sapiens
  misc_feature: GYAE6OF02HJFHS.47.48.E04.1.454.CMB.1.raw
tcagagctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcagtcagggcgttgcaaatgctttggcctggtttcagcagacaccagggaaggcccctaagcgcctgatctatggtgcatacactttgcaaagtggggtcccatcaaggttcagcggcaggtaggtctggggacagagtttcactctcactatcagcggcctgcagcctgaagattctgcaacttattactgtctccagtatgatgcttaccctcggtactttcggaccaacgggaccaaggtggaaatcgaaacgactgtgctgcacctac

SEQ ID NO: 136383 - DNA, 494 bp, Homo sapiens
  misc_feature: GYAE6OF02GGVJF.47.48.E04.1.454.CMB.1.raw
tcagagctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcagggcgttgcaaatgctttggcctggtttcagcagacaccagggaaggcccctaagcgcctgatctatggtgcatacactttgcaaagtggggtcccatcaaggttcagcggcagtaggtctggggacagagttcactctcactatcagcgctgcagcctgaagattctgcaatttattactgtctccagtatgatgtcttacccgtcgactttccggccaagggaccaaggtacggaaatcgaaacgactggtggctcgcactacg

SEQ ID NO: 136384 - DNA, 515 bp, Homo sapiens
  misc_feature: GYAE6OF02GMZBY.47.48.E04.1.454.CMB.1.raw
tcagagctcacgtacacgaccggtgctcgatttagagagcgtcacagagagaaggggaggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcagggcgttgcaaatgctttggcctggtttcagcagacaccagggaaggcccctaagcgcctgatctatggtgcatacactttgcaaagtgggtcccatcaaggttcagcggcagtaggtctgggacagagttcactctcactatcagcggcctgcagcctgaagattctgctaacttattactgtctcctagtatgatgccttaccctcggtactttcggaccgtaaacgggaccaaagggtaggaaactacgaaacgaaccttggtacgggcttaggcctaaccg

SEQ ID NO: 136385 - DNA, 498 bp, Homo sapiens
  misc_feature: GYAE6OF02FUCJI.47.48.E04.1.454.CMB.1.raw
  modified_base (396)..(396): a, c, t, g, unknown or other
  misc_feature (396)..(396): n is a, c, g, or t
tcagagctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcagtcagggcgttgcaaatgctttggcctggtttcagcagacaccagggaaggcccctaagcgcctgatctatggtgcatacactttgcaaagtggggtcccatcaaggttcagcggcagtaggtctgggacagagttcactctcactatcagcggcctgcagcctgaagattcngcaactttattactgtctccagtatgatgcttaccctcggtactttcggacctaagggaccaaggtacggaaatacgaaacgacgtggtaggctgacactac

SEQ ID NO: 136386 - DNA, 519 bp, Homo sapiens
  misc_feature: GYAE6OF02IU6ML.47.48.E04.1.454.CMB.1.raw
  modified_base (393)..(393): a, c, t, g, unknown or other
  misc_feature (393)..(393): n is a, c, g, or t
tcagagctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcagggcgttgcaaatgctttggcctggtttcagcagacaccagggaaggcccctaagcgcctgatctatggtgcatacactttgcaaagtggggtccatcaaggttcagcggcagtagtcgtgggacaggagttcactctcactatcagcggcctgcagcctgaatnttctgctaacttattactgtcctacgtagtatgtatcgtaccttaccgtcgttacgttccgtaccggaacggtaacgtaaggtaacggtaactaacgaacgtacgtggtacgtcgtacgccactcg

SEQ ID NO: 136387 - DNA, 505 bp, Homo sapiens
  misc_feature: GYAE6OF02G6YHR.47.48.E04.1.454.CMB.1.raw
  modified_base (399)..(399): a, c, t, g, unknown or other
  misc_feature (399)..(399): n is a, c, g, or t
tcagagctcacgtacacgaccggtgctcgatttagagagcgtcacagagagaaggggaggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcagggcgttgcaaatgctttggcctggtttcagcagacaccagggaaggcccctaagcgcctgatctatggtgcatacactttgcaaagtggggtcccatcaaggttcagcggcagtaggtctgggacagagttcactctcactatcagcggcctgcagcctgaagattcngcactttattactgtctccagttatgatgcttacctcggtactttcggacctaacggggacctaagggtacgaaatacgaaacgtacgtggtaggactgactaccg

SEQ ID NO: 136388 - DNA, 480 bp, Homo sapiens
  misc_feature: GYAE6OF02JU1KV.47.48.E04.1.454.CMB.1.raw
  modified_base (145)..(145): a, c, t, g, unknown or other
  misc_feature (145)..(145): n is a, c, g, or t
  modified_base (194)..(194): a, c, t, g, unknown or other
  misc_feature (194)..(194): n is a, c, g, or t
  modified_base (200)..(200): a, c, t, g, unknown or other
  misc_feature (200)..(200): n is a, c, g, or t
  modified_base (386)..(386): a, c, t, g, unknown or other
  misc_feature (386)..(386): n is a, c, g, or t
  modified_base (391)..(391): a, c, t, g, unknown or other
  misc_feature (391)..(391): n is a, c, g, or t
  modified_base (397)..(397): a, c, t, g, unknown or other
  misc_feature (397)..(397): n is a, c, g, or t
  modified_base (415)..(415): a, c, t, g, unknown or other
  misc_feature (415)..(415): n is a, c, g, or t
  modified_base (466)..(466): a, c, t, g, unknown or other
  misc_feature (466)..(466): n is a, c, g, or t
tcagagctcacgtacacgaccggtgctcgattagagagcgtcacagagagaagggggaatcagtcccactcagacacagcatggacatgagggtccccgctcagctcctgggtctcctgctgctctggttcccaggtgccaggtntgacatccagatgacccagtctccatcctccctgtctgcatctgtaganacaggntcaccattcacttgccggggcagtcagggcttgcaaatgctttggcctggttttccagcagacaccgagtaaggcccctaagcgcctgatctatggtgcatacactttgcaaagtgggtccatcaaggttcagcgcagtagtctgggacagagttcactctcactatcagcggcctgcagcctganattcngcactnttactgctccagtatgangcttacctcggactttcggccaagggaccaaggtaggaatacaaacgaacngtggctgcacctac

SEQ ID NO: 136389 - DNA, 498 bp, Homo sapiens
  misc_feature: GYAE6OF02GXBWG.47.48.E04.1.454.CMB.1.raw
tcagagctcacgtacacgaccggtgctcgatttagagagcgtcacagagagaaggggaggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggccagtcagagtattgataggtggttggcctggtatcagcagaaaccagggaaagcccctaagctcctgatctacgatgcatccaatttggaaacaggggtcccatcaaggttcagtggaagtggatctgggacagatttcactctcaccatcagcagtctgcaacctgaagtattttgctaacttactactgtcaacagagttacggtacccgtactacgtttcggcagggaccacgtaggacatacaaacgaactgtgctgcaccatctgtacc

SEQ ID NO: 136390 - DNA, 511 bp, Homo sapiens
  misc_feature: GYAE6OF02F0UI0.47.48.E04.1.454.CMB.1.raw
  modified_base (222)..(222): a, c, t, g, unknown or other
  misc_feature (222)..(222): n is a, c, g, or t
tcagagctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggnagtcagggcttgcaaatgctttggcctggttttcagcagacaccagggaaggcccctaagcgcctgatctatggtgcatacactttgcaaagtggggtcccatcaaggttcagcggcagtaggtctggggacagagttcactctcactatcagcgcctgcagcctgaagattctgctacttatactgtctccagtatgatgtaccttacctcggtactttccggaccgtaagggacctaaagggtggaaaattaccgaaaacgacttcggtggactcggaccaccgtac

SEQ ID NO: 136391 - DNA, 512 bp, Homo sapiens
  misc_feature: GYAE6OF02INZB5.47.48.E04.1.454.CMB.1.raw
  modified_base (196)..(196): a, c, t, g, unknown or other
  misc_feature (196)..(196): n is a, c, g, or t
  modified_base (221)..(221): a, c, t, g, unknown or other
  misc_feature (221)..(221): n is a, c, g, or t
tcagagctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctcctgtctgcatctgtagganacagagtcaccatcacttgccgggnagtcagggcttgcaaatgctttggcctggtttcagcagacaccagggaaggcccctaagcgcctgatctatggtgcatacactttgcaaagtgggtcccatcaaggttcagcgcagtaggtctgggacagagttcactctcactatcagcggcctgcagcctagaagtattctgactaacttattactgtctaccgagtatgatgcttacctcggtactttcggaccgaacgggaacctaacggtaggtaaactacaaaacgtacttaggtcggtactcgaccgactaacg

SEQ ID NO: 136392 - DNA, 520 bp, Homo sapiens
  misc_feature: GYAE6OF02G34LG.47.48.E04.1.454.CMB.1.raw
  modified_base (371)..(371): a, c, t, g, unknown or other
  misc_feature (371)..(371): n is a, c, g, or t
  modified_base (381)..(381): a, c, t, g, unknown or other
  misc_feature (381)..(381): n is a, c, g, or t
  modified_base (393)..(393): a, c, t, g, unknown or other
  misc_feature (393)..(393): n is a, c, g, or t
tcagagctcacgtacacgaccggtgctcgatttagagagcgtcacagagagaaggggaggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcagggcgttgcaaatgctttggcctggttcagcagacaccagggaacggcccctaagcgcctgatctatggtgcatacactttgcaaagtgggtcccatcaaggttcagcggcagtagtctgggacagagttcactctcactncagcgctgcngcctgagattcngactaacttattactgtctcctagttatgtatcgtcttaccctcggtactttccggaccgtaacggggtaacctaagggtaacggtaaatacgaaacggtaacttggtacggacgtcgacctaaccg

SEQ ID NO: 136393 - DNA, 535 bp, Homo sapiens
  misc_feature: GYAE6OF02FFAF6.47.48.E04.1.454.CMB.1.raw
  modified_base (304)..(304): a, c, t, g, unknown or other
  misc_feature (304)..(304): n is a, c, g, or t
  modified_base (371)..(371): a, c, t, g, unknown or other
  misc_feature (371)..(371): n is a, c, g, or t
  modified_base (441)..(441): a, c, t, g, unknown or other
  misc_feature (441)..(441): n is a, c, g, or t
  modified_base (468)..(468): a, c, t, g, unknown or other
  misc_feature (468)..(468): n is a, c, g, or t
  modified_base (471)..(471): a, c, t, g, unknown or other
  misc_feature (471)..(471): n is a, c, g, or t
  modified_base (479)..(479): a, c, t, g, unknown or other
  misc_feature (479)..(479): n is a, c, g, or t
tcagagctcacgtacacgaccggtgctcgatttagagagcgtcacagagagaaggggctcagagaggagccttagccctggactccaaggcctttccacttggtgatcagcactgagcacagaggactcaccatggaattggggctgagctgggttttccttgttgctattttagaaggtgtccagtgtgaggtgcaattggtgcaatctgggggaggcttggtccagcctggggggtccctcagactctcctgtgcagcctctggatttcaccttttagttcctcttggatgaattgggtccnccagactccgagggaagggctggagtgggttggcaacataaatccagatggaagtcaagaaaacctntgtggactctcgtagaacgggccgattcacctatcctccagacgacaacgccaagaacttctcttgttcngacaatggacagcctgagagtacgaanacncggctgtntatcgttgtgtcgtctcgtggaccgtccgtccggccggtaccgttggctttccggg

SEQ ID NO: 136394 - DNA, 524 bp, Homo sapiens
  misc_feature: GYAE6OF02JJP9V.47.48.E04.1.454.CMB.1.raw
  modified_base (393)..(393): a, c, t, g, unknown or other
  misc_feature (393)..(393): n is a, c, g, or t
  modified_base (401)..(401): a, c, t, g, unknown or other
  misc_feature (401)..(401): n is a, c, g, or t
tcagagctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcagtcagggcttgcaaatgctttggcctggtttcagcagacacaggaaggcccctaagcgcctgatctactggtgcatacacttttgcaaagtggggtccatcaaggttcagcggcagtagtctgggacagagtttcacgtctcatatcagcggctgcagcctagagattcngctaattnttactgtctcctagtatgattcgctttaacccgtgtaccttttcggaccgtaaacgggaccctaagggttacggaaacttaccgaaacgtaaccgtggtacggtctacggtacctacctaacg

SEQ ID NO: 136395 - DNA, 585 bp, Homo sapiens
  misc_feature: GYAE6OF02F2P2V.47.48.E04.1.454.CMB.1.raw
tcagagctcacgtacacgaccggtgctcgatttagagagcgtcacagagagaagggggaatcagtcccactcaggacacagcatggacatgagggtccccgctcagctcctggggctcctgctactctggctccgaggtgccagatgtgacatccagatgacccagtctccatcctcctgtctgcatctgtaggagacagagtcaccagtccacttgccgggcaagtcagagcattaacagcgtaatttaaattggtatcaccaagaaaccagggaacacccctaacctcctgactctatgctgcatccgtagtttcgctagtaggtcgggtaccctagttcgtaggttactaggtggctaggtggattcgtagggacagtactttccacttcctacacctatcacgtctagtcctagacctaacctagtaacgttactttgacctaacttactactagtacaactagtacgttaccgtaccccgtagttaccgtttacgggacctacgggtaacctaacgtcggaacctaacgtaaccgaaacgtaacgttcggtacggtacctaggaccgtaccgtacttccg

SEQ ID NO: 136396 - DNA, 485 bp, Homo sapiens
  misc_feature: GYAE6OF02GXXYS.47.48.E04.1.454.CMB.1.raw
  modified_base (390)..(390): a, c, t, g, unknown or other
  misc_feature (390)..(390): n is a, c, g, or t
  modified_base (394)..(394): a, c, t, g, unknown or other
  misc_feature (394)..(394): n is a, c, g, or t
tcagagctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcagtcagggcgttgcaaatgctttggcctggtttcagcagacaccagggaaggcccctaagcgcctgatctatggtgcatacactttgcaaagtggggtccatcaaggttcagcggcagtagtctgggacagagttcactctcactatcagcggcctgcagcctgaagnttcngctaacttattactgtctcagtatgatgcttacctcgactttcggccaagggccaaaggtcggaaactcgaaacgactggtgctgcaccta

SEQ ID NO: 136397 - DNA, 507 bp, Homo sapiens
  misc_feature: GYAE6OF02JMPKS.47.48.E04.1.454.CMB.1.raw
  modified_base (393)..(393): a, c, t, g, unknown or other
  misc_feature (393)..(393): n is a, c, g, or t
  modified_base (397)..(397): a, c, t, g, unknown or other
  misc_feature (397)..(397): n is a, c, g, or t
tcagagctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcagtcaggcgttgcaaatgctttggcctggtttcagcagacaccagggaagcccctaagcgcctgatctatggtgcatacactttgactaaagtggggtcccatccaaggttcagcggcagtaggtctgggacagagttcacgtctcactatcagcgctgcagcctgaagtnttcngctaactttattactgtctaccagtaatgatgtccttaccgtcgtactttcggaccgtaagggcctaaggtaggaaacgtacaaacggtaactggtagctgacacctacg

SEQ ID NO: 136398 - DNA, 526 bp, Homo sapiens
  misc_feature: GYAE6OF02I4W1J.47.48.E04.1.454.CMB.1.raw
tcagagctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcagtcagggcttgcaatgctttggcctggtttcagcagacacagggaacggcccctaagccgcctgatctatggtgcatacactttgactaaaggtcggggtacccatcaaggttcaggcggcagtaggtctgggacagagttcactctcactatcagcgctgcagcctgaagtattctgactaacttattactgtctaccgagttatgtactgtccttaccgtcgtactttcggaccgtaacgggaaccgtaaggtacggtaaactacgaaacgtacgttcggtaggacgtacgaccacctacg

SEQ ID NO: 136399 - DNA, 540 bp, Homo sapiens
  misc_feature: GYAE6OF02GS8NB.47.48.E04.1.454.CMB.1.raw
  modified_base (410)..(410): a, c, t, g, unknown or other
  misc_feature (410)..(410): n is a, c, g, or t
tcagagctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcagggcgttgcaaatgctttggccttggtttcagcagacaccgagggaacggcccctaagcgcctgatctatggtgcatactactttgactaaaggtcggggtaccagtcaaggttcaggcggcaggtaggtcgtgggacaggagttcgactcgtacactatcagcggcctgcagcctagaagnttctgctaacttattactgtctccagtatgattgtcttacccgtcgtaccgtttccggaccgtaacgggaacctaagggttacggaaacttaccgaaacgtaacgtcggtacggactcggaccacctacg

SEQ ID NO: 136400 - DNA, 519 bp, Homo sapiens
  misc_feature: GYAE6OF02HZ1PI.47.48.E04.1.454.CMB.1.raw
  modified_base (303)..(303): a, c, t, g, unknown or other
  misc_feature (303)..(303): n is a, c, g, or t
  modified_base (375)..(375): a, c, t, g, unknown or other
  misc_feature (375)..(375): n is a, c, g, or t
  modified_base (394)..(394): a, c, t, g, unknown or other
  misc_feature (394)..(394): n is a, c, g, or t
  modified_base (398)..(398): a, c, t, g, unknown or other
  misc_feature (398)..(398): n is a, c, g, or t
tcagagctcacgtacacgaccggtgctcgatttagagagcgtcacagagagaaggggaggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttggccgggcgagtcagggcgttgcaaatgctttggcctggtttcagcagacaccagggaacggcccctaagcgcctgatctatggtncatacactttgcaaagtgggtcccatcaaggttcagcggcagtaggtctgggacagagttcactctcactancagcgcctgcagcctgaanttcngctaacttattactgttctaccagttatgtatcgtccttacccgtcgtactttccggaccgaaacgggacctaaagggtggtaaactaccgaaacgtacgtggtaggcttacgcctaaccg

SEQ ID NO: 136401 - DNA, 522 bp, Homo sapiens
  misc_feature: GYAE6OF02FYM9F.47.48.E04.1.454.CMB.1.raw
  modified_base (393)..(393): a, c, t, g, unknown or other
  misc_feature (393)..(393): n is a, c, g, or t
tcagagctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcagggcgttgcaaatgctttggcctggtttcagcagacaccagggaaggcccctaagcgcctgatctatggtgcatacactttgcaaagtggggtcccatcaaggttcagcggcagtaggtctgggacagagttcactctcactatcagcggcctgcagcctgaagnttctgctaacttattactgtctcagtatgatgcttacccgtcggtacctttcgggacctaaggggaccctaaagggtacggaaaactaccgaaaacgaacgttggtacggacctacggtccaacctacg

SEQ ID NO: 136402 - DNA, 525 bp, Homo sapiens
  misc_feature: GYAE6OF02IVMVA.47.48.E04.1.454.CMB.1.raw
tcagagctcacgtacacgaccggtgctcgatttagagagcgtcacagagagaagggggaatcagtcccactcaggacacagcatggacatgagggtcccgctcagctcctggggctcctgctgctctggttcccaggtgccaggtgtgacatccagatgacccagtctccatcctccctgtctgcatctgtaggagacagagtcaccatcacttgccgggcagtcagggcgttgcaaatgctttggccttggtttcagcagacaccagggaacggcccctaagcgcctgatctatggtgcatacactttgctaaaggtggggtcccatacaaggttcagcggcagtaggtcgtgggacagtagtttacactctacactatcgacgcggcctgcacgccctagaacgtattctgactaactttatactgttctacctagtatgattcgctttaccgcgtacgtttcggacctaacgggactaaggtaggaaactacgaaaccgaactggtacggctcgacactacg

SEQ ID NO: 136403 - DNA, 739 bp, Homo sapiens
  misc_feature: GYAE6OF02FE695.47.48.E04.1.454.CMB.1.raw
tcagagctcacgtacacgaccggtgctcgatttagagagcgtcacagagagaaggggaggaatcagtcccactcaggacacagcatggacatgagggtccccgctcagctcctggggctcctgctgctctggttcccaggtgccaggtgtgacatccagatgacccagtctccatcctccctgtctgcatctggtaggagaccagacgtcaccatccacgttggccgggcgagtcgagggtcgttgacaaatgtcgtttggccttggtttcagcagaccgaccgacgggaacgcccctaagccgtcctgactctagtggtgctaatactactttcgacgtaaacggtcgggtaccctagtacgtaacggttccacgggtccggtacgtaacgggttacgggttaccggtacggggaaccgtacggtaccgtttaccgtacccgttacctaccgtaaccgttaccgttaccgaaccgggtcccgggtcccgttacggaccgaacggtcccgttaagtaaaccgttactttaccgtacgttaaccttaaccgttttacgtttacctacggttacccttaccgttaagttacgttacgtactttaccggttacccgtttaacccggttaccgggtttaccgtttacccgggaacccggtaaacggggtaccggtaaacgggttaacgtaaacgtaaccggtaaaccgtacgttaccggtacggaccgttacgaccttaaccg

SEQ ID NO: 136404 - DNA, 536 bp, Homo sapiens
  misc_feature: GYAE6OF02GK2JA.47.48.E04.1.454.CMB.1.raw
  modified_base (392)..(392): a, c, t, g, unknown or other
  misc_feature (392)..(392): n is a, c, g, or t
  modified_base (396)..(396): a, c, t, g, unknown or other
  misc_feature (396)..(396): n is a, c, g, or t
tcagagctcacgtacacgaccggtgctcgatttagagagcgtcacagagagaaggggaggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcagtcagggcgttgcaaatgctttggcctggtttcagcagacacagggaaggcccctaagcgcctgatctatggtgcatacactttgcaaaggtgggtcccatcaaggttcagcggcagtaggtctggggacaggagttcactctcactatcagcgctgcagcctgagnttcngctaattattactgttcctccagttatgtacttgacctttacccgtcggttactttccgggaccgtaaacggggaccgtaaagggttacggaaacgttcgaaaaccggtacgttacggtagggaccttacgccgtaaccc

SEQ ID NO: 136405 - DNA, 505 bp, Homo sapiens
  misc_feature: GYAE6OF02GFR0E.47.48.E04.1.454.CMB.1.raw
  modified_base (438)..(438): a, c, t, g, unknown or other
  misc_feature (438)..(438): n is a, c, g, or t
tcagagctcacgtacacgaccggtgctcgatttagagagcgtcacagagagaaggggaggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcagggcgttgcaaatgctttggcctggtttcagcagacaccagggaagcccctaagcgcctgatctatggtgcatacactttgacaaaggtcgggtcccatcaaggttcagcggcagtaggtctgggacagagttcactctcactatcagcggcctgcagcctgaagattctgctaacttattactgtctcagtatgatgtcttacccgngtacttcggaccgtaagggaccgtaaggtagtaaactacaaacggacgtggtaggctcggctaaccg

SEQ ID NO: 136406 - DNA, 518 bp, Homo sapiens
  misc_feature: GYAE6OF02H5MD0.47.48.E04.1.454.CMB.1.raw
  modified_base (391)..(391): a, c, t, g, unknown or other
  misc_feature (391)..(391): n is a, c, g, or t
tcagagctcacgtacacgaccggtgctcgatttagagagcgtcacagagagaaggggaggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcagggcgttgcaaatgctttggcctggttcagcagacaccaggacggccctaagcgcctgatctatggtgcatacactttgcaaagtgggtacccatcaaggttcagcggcagtaggtctgggacagagttcactctcactatcagcgcctgcagcctgaagnttctgacaacttattactgtctaccagttatgatgcctttaccctcggtacttttccgggacctaaacggggaccctaagggtaggaaaactccgaaacggtactaggttggacttcggctaacccg

SEQ ID NO: 136407 - DNA, 522 bp, Homo sapiens
  misc_feature: GYAE6OF02HGDCQ.47.48.E04.1.454.CMB.1.raw
  modified_base (395)..(395): a, c, t, g, unknown or other
  misc_feature (395)..(395): n is a, c, g, or t
tcagagctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcagtcagggcttgcaaatgctttggcctggtttcagcagacaccagggaaggcccctaagcgcctgatctatggtgcatacactttgcaaagtggggtacccatcaaggttcagcggcagtaggtctgggacagagttcactctcactatcagcgcctgcagcctgaagattcngactaacttattactgtactccagtatgacttcgtccttaccgtcggtacctttcggaccgtaacgggtaaccaagggtacggaaactacgaaacggtaacgtcggtaggctacggtaccacctacg

SEQ ID NO: 136408 - DNA, 535 bp, Homo sapiens
  misc_feature: GYAE6OF02IOQ0Q.47.48.E04.1.454.CMB.1.raw
tcagagctcacgtacacgaccggtgctcgatttagagagcgtcacagagagaaggggaggaatcagtcccactcaggacacagcatggacatgagggtccccgctcagctccgtggggctcctgctgctctggttcccaggtgccaggtgtgacatccagatgacccagtctccatcctccctgtctgcatctgtaggagacagagtccaccatcacttgccgggcgagtcagggtcgttgcaaatgctttggcctggtttcagtcagacaccagggacggcccctaagcgcctgatctatggtgcatacactttgcaaagtgggtacccatcaaggttcagcgcagtagtctgggacagcgttcactctacactatcagcggctgcagcctaggaactattctgactaactttattactgttcctcagttactgatcgtacttacccgtcggtactttacggtacgtaacggggtacctaaagggtacggtaaacgtacgaaacggtaacttggtacggtacgtgacctaaccg

SEQ ID NO: 136409 - DNA, 726 bp, Homo sapiens
  misc_feature: GYAE6OF02JIRKZ.47.48.E04.1.454.CMB.1.raw
  modified_base (329)..(329): a, c, t, g, unknown or other
  misc_feature (329)..(329): n is a, c, g, or t
  modified_base (480)..(480): a, c, t, g, unknown or other
  misc_feature (480)..(480): n is a, c, g, or t
  modified_base (506)..(506): a, c, t, g, unknown or other
  misc_feature (506)..(506): n is a, c, g, or t
tcagagctcacgtacacgaccggtgctcgatttagagagcgtcacagagagaaggggaggaatcagtcccactcaggacacagcatggacatgagggtccccgctcagctcctggggctcctgctgctcgttcggttacccgaggtcgccgagggtggtgaacactccagatgactccgagtcctccactcccgttcccgtgttctcgactacttcgttagggaaggaacgaccaggtactacccaacctatcctacggttcgggccgggacgtagtcggacggggtcgttacgaactaaagtcgttcgttcggtccgttggttcacgnacgaccgaacggaaggggacctacccgtaggccgtccgtagtacgtacgtaggtgggtacactaacttaaccttaccgttaggaacgtaaacgggttccggtaccctaatacggtaaacgtcgacggcggtacaggttacggtcgacgganacgttacgtcacgttacacgtaactntccgaggccgtactgactcgaccgttagaacgttcttccgacgtaacctttaatttaccgtttacgtccgttccaccggttaagtactacggtactccgttacccctttacccggtaccgggtttacgtacccgggtaaacgggaaacggtaaccggttaaagggtaaccgtaaacctaaccgtaaacccggtagttcggggtactacgtacgtaacccg

SEQ ID NO: 136410 - DNA, 538 bp, Homo sapiens
  misc_feature: GYAE6OF02I8OJU.47.48.E04.1.454.CMB.1.raw
  modified_base (277)..(277): a, c, t, g, unknown or other
  misc_feature (277)..(277): n is a, c, g, or t
tcagagctcacgtacacgaccggtgctcgatttagagagcgtcacagagagaaggggaggaatcagtcccactcaggacacagcatggacatgagggtccccgctcagctcctggggctcctgctgctctggttcccaggtgccaggtgtgacatccagatgacccagtcgccatcctcactgtctgcatctgtaggagacagagtcaccatcacttgcgggcagtcaggcattagctaattttttagccttggtttcagcagaaaccagggaaacncccctaagtccctgatctatggtgcatacactttgacaaaggtcgggtcccatcgaaggttcagcggcaggtaggtctgggacagtagttcactctcactatcagcgctgcagctagaatattctgactaactttatactcgtcctcctagtatgattcgtccttacccgtacggtacctttccggaccgtaacgggtaccgaaagggtacgaaactaccgaaacgtacgtaggtcggtactacggacctacctagttccg

SEQ ID NO: 136411 - DNA, 534 bp, Homo sapiens
  misc_feature: GYAE6OF02H9TPR.47.48.E04.1.454.CMB.1.raw
  modified_base (222)..(222): a, c, t, g, unknown or other
  misc_feature (222)..(222): n is a, c, g, or t
  modified_base (405)..(405): a, c, t, g, unknown or other
  misc_feature (405)..(405): n is a, c, g, or t
tcagagctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggnagtcagggcgttgcaaatgctttggcctggtttcagcagacacgagggaagcccctaagcgcctgatctatggtgcatacactttgacaaaggtcggggtacccatcgaaggttcagcggacaggtggtactgggacagagtttcactctcactatcagcggcctgcagcctagaagtattcngtactaacttacttacttcgtcctccagttatgtatcgtaccttacccgtcggtacctttccggaccgtaacgggacctaagggtaggaaacttacgaaacgtacgtggtacggtcgtacgccactacg

SEQ ID NO: 136412 - DNA, 526 bp, Homo sapiens
  misc_feature: GYAE6OF02GFGZ0.47.48.E04.1.454.CMB.1.raw
  modified_base (224)..(224): a, c, t, g, unknown or other
  misc_feature (224)..(224): n is a, c, g, or t
  modified_base (399)..(399): a, c, t, g, unknown or other
  misc_feature (399)..(399): n is a, c, g, or t
tcagagctcacgtacacgaccggtgctcgatttagagagcgtcacagagagaaggggaggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggngagtcagggcgttgcaaatgctttggcctggtttcagcagacaccagggaaggcccctaagcgcctgatctatggtgcatacactttgcaaagtgggtcccatcaaggttcagcggcagtaggtctgggacagagttcactctcactatcagcggcctgcagcctgaagtattcngactaacttattactgtctccagtactgatcgacttacccgtcggtacctttcggaccgtaagggtaacctaaggggtacggtaaacgtacgaaaccgtacgttaggtacggtactcgactaacccg

SEQ ID NO: 136413 - DNA, 551 bp, Homo sapiens
  misc_feature: GYAE6OF02JAHBV.47.48.E04.1.454.CMB.1.raw
  modified_base (223)..(223): a, c, t, g, unknown or other
  misc_feature (223)..(223): n is a, c, g, or t
  modified_base (394)..(394): a, c, t, g, unknown or other
  misc_feature (394)..(394): n is a, c, g, or t
tcagagctcacgtacacgaccggtgctcgatttagagagcgtcacagagagaaggggaggaatcagtcccactcaggacacagcatggacatgagggtccccgctcagctcctggggctcctgctgctctggttcccaggtgccaggtgtgacatccagatgacccagtctccatcctcctgtctgcatctgtaggagacagagtcaccatcacttgccgggngagtcagggcgttgcaaatgctttggcctggtttcagcagacaccagggaagcccctaagcgcctgatctatggtgcatacactttgacaaagtgggtcccatcaaggttcagcggcagtaggtctagggacagagttcactctcactatcagcggcctgcagcctgaagnttctgctaacgttattactgttctcctagtactgtattcgtaccttacccgtcggtaccgttttcggacccgtaacggggtaaccctaaaggggttacggaaaacgttaccgaaaaccggtacgttacggttacgggaccttacggaccctaacccg

SEQ ID NO: 136414 - DNA, 598 bp, Homo sapiens
  misc_feature: GYAE6OF02G4N6Q.47.48.E04.1.454.CMB.1.raw
  modified_base (229)..(229): a, c, t, g, unknown or other
  misc_feature (229)..(229): n is a, c, g, or t
tcagagctcacgtacacgaccggtgctcgatttagagagcgtcacagagagaaggggaggaatcagtcccactcaggacacagcatggacatggacgggtccccgctcagctccgtggggctcctgctgctctggttcccaggtgccaggtgtgacatccagatcgacccagtctccatcctcctgtctgcatctggtaggagacagagtcacatcacttggcccgggngagtcgagggcgttgcaaatgctttggcctggttcagcagacaccgagggaacggccctaagccgcctgatctagtggtgcatactactttgacaaaggtcgggtcccatcaaggttcaggcggcagtagtcgtagggacagtagttcactctcactatcgacgcggcctgcacgcctagaacgtcttcgtcgactaaactttacttaacgttcgttaccgtacctaaggttacttgtagttcgttacctttacccgtcggttacccgtttccgggaacccggtaaacggggtaacccgtaaggggttaacggtaaaacgttaccgaaaaccggtaacggttaggtacggtacgtacggacctaacccg

SEQ ID NO: 136415 - DNA, 608 bp, Homo sapiens
  misc_feature: GYAE6OF02IZ8DR.47.48.E04.1.454.CMB.1.raw
tcagagctcacgtacacgaccggtgctcgatttagagagcgtcacagagagaaggggaggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcactggccgggcgagtcgagggcgttgcaaatgctttggcctggtttcagcagacaccagggaacggccctaagccgcctagatctagtggtgcatactactttgacgaaaggtcgggtccctaagtacgaaggttcaggcggacgtagtacgggtcgtagggacagtaggttccacgtctacaacttactacgacggcggtcctgccgtacgtccgtaggtaaactacgttccgtaacgtacctaaactttagtttaactccgtttacctaccgtaagttacgtgtaactcgtacccgtttacccgtcggttaccgttcggacccgtaagggtaaccgtaaggtaaggtaaccgtaacgaaaccgtaacgtcggttacggacgtacgcctaaccg

SEQ ID NO: 136416 - DNA, 528 bp, Homo sapiens
  misc_feature: GYAE6OF02I3PZ4.47.48.E04.1.454.CMB.1.raw
  modified_base (197)..(197): a, c, t, g, unknown or other
  misc_feature (197)..(197): n is a, c, g, or t
  modified_base (297)..(297): a, c, t, g, unknown or other
  misc_feature (297)..(297): n is a, c, g, or t
  modified_base (388)..(388): a, c, t, g, unknown or other
  misc_feature (388)..(388): n is a, c, g, or t
  modified_base (393)..(393): a, c, t, g, unknown or other
  misc_feature (393)..(393): n is a, c, g, or t
tcagagctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtagganacagagtcaccatcacttgccgggcagtcagggcttgcaaatgctttggcctggtttcagcagacaccagggaaggcccctaagcgcctgatctatggtncatacactttgctaaagtggggtcccatcaaggttcagcggcagtaggtctgggacagagttcactctcactatcagcgctgcagcctganattcngactacttattactgtctccagttatgattcgtcctttacccgtcggtaccttttccggaccgtaacgggtacctaagggttacggaaaactccgtaaaacgtaacgttaggtacggactacggacctacctacg

SEQ ID NO: 136417 - DNA, 521 bp, Homo sapiens
  misc_feature: GYAE6OF02J1DF3.47.48.E04.1.454.CMB.1.raw
  modified_base (197)..(197): a, c, t, g, unknown or other
  misc_feature (197)..(197): n is a, c, g, or t
  modified_base (285)..(285): a, c, t, g, unknown or other
  misc_feature (285)..(285): n is a, c, g, or t
  modified_base (299)..(299): a, c, t, g, unknown or other
  misc_feature (299)..(299): n is a, c, g, or t
  modified_base (408)..(408): a, c, t, g, unknown or other
  misc_feature (408)..(408): n is a, c, g, or t
tcagagctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtagganacagagtcaccatcacttgccgggcgagtcagggcttgcaatgctttggccttggtttcagcagacaccgaggaacggcccctaagcncctgatctagtggngcatacactttgacgtaaaggtcgggccctagtcaaggttcagcgacaggtagtcgagggacagagttcactctctactatcagcgtcctgcagctagaacgtattcgnactaacctatactgtaccagtacgtagttaccgtacccgtataccgtttggaccagggtacctaagtcggaactagtaccgaaacgtagtgacggtcacgacaccacttctcg

SEQ ID NO: 136418 - DNA, 555 bp, Homo sapiens
  misc_feature: GYAE6OF02G4OTF.47.48.E04.1.454.CMB.1.raw
  modified_base (406)..(406): a, c, t, g, unknown or other
  misc_feature (406)..(406): n is a, c, g, or t
  modified_base (410)..(410): a, c, t, g, unknown or other
  misc_feature (410)..(410): n is a, c, g, or t
tcagagctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcagggcgttgcaaatgctttggcctggtttcagcagacaccgagggaacggcccctaagccgcctgatctatggtgcatacactttgacaaaggtcggggtacccatcgaaggttcaggcggcaggtaggtcgtgggacaggtagttcactctcactatcagcgctgcagcctagaagtnttcngactaactttattactgtctccgtagttatgtattcgtaccttacccgtcggtaccgtttccgggaccgtaaacggggtaccgtaagggttacggtaaacttaccgaaaacggtacgttaggtacggtactcggacctacctacg

SEQ ID NO: 136419 - DNA, 586 bp, Homo sapiens
  misc_feature: GYAE6OF02JATMJ.47.48.E04.1.454.CMB.1.raw
  modified_base (279)..(279): a, c, t, g, unknown or other
  misc_feature (279)..(279): n is a, c, g, or t
tcagagctcacgtacacgaccggtgctcgatttagagagcgtcacagagagaagggggaatcagtcccactcaggacacagcatggacatgagggtccccgctcagctcctggggctcctgctgctctggttcccaggtgccagatgtgacatccagatgacccagtctccatcctccctgtctgcatctgtaggagacagagtcaccatcacttgccgggcaagtcagagcattaacagcgtatttaaattggtatcaccaagaaaccgagggaaacncccctaacctcctgatctatgctgcatcctagtttgctagtacggtcgggtcccagttcgttaggttcaggtggcagtggatcgtagggacagtatttcactctacaccatcagctagtctgacctaacgtgtaagttattttacgacctaacttactaccttagtaccaacgtagtaacgttaccggttaaccccgtacttacgtttacggaccgtaggggaaccctaaaccggtcggtaacctaacgtaaccgtaaaaccggtaacgttacggtacggtacctacggaccctaccgtagttaccg

SEQ ID NO: 136420 - DNA, 763 bp, Homo sapiens
  misc_feature: GYAE6OF02GET0Q.47.48.E04.1.454.CMB.1.raw
  modified_base (303)..(303): a, c, t, g, unknown or other
  misc_feature (303)..(303): n is a, c, g, or t
tcagagctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcagggcgttgcaaatgctttggcctggtttcagcagacaccgagggaacggcccctaaggccgcctgatctatggtncatactactttgactaaaggtcggggtacccagtacgtaaaggttcaaggtccgggacgaaggttaacggggtccgtagggggaaccgaaggtaacggtttccaaccttccgtacctaaccttaagtaccgtaaggcccgggtccttacgggacctaacgggtcccttaaggtaaaacggttacgttttaccgtacgggtaaccttaaaaccgttttaactttaaccgttcggtttacccttacccgtaaggtttaactacggttaactttacggttacccgttttaaacccccgttaccgggtttaacccggttttttacccggggaaccccggttaaaaccgggggtaaccccggttaaaacggggtttaacgggtaaaaaccgttaacccggtaaaaaccgtaaccggtttacgggttaaccgggttacgttaccgggtaccctaacccgttaaccg

SEQ ID NO: 136421 - DNA, 582 bp, Homo sapiens
  misc_feature: GYAE6OF02I45FR.47.48.E04.1.454.CMB.1.raw
  modified_base (283)..(283): a, c, t, g, unknown or other
  misc_feature (283)..(283): n is a, c, g, or t
tcagagctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcagtcagggtcttgcaatgcttggccttggttcagcagacaccgagggaacgcccctaagcncctgatctatggtgcacgtacactttgactaaaggtcggggtacccagtacgaaggttcaaggtcggactaggtacggtcgtagggacaggtacgtttacactcgtactactaatcgagtccggcctgccacgtcctaggaatacttctgaccttaacttatttacgtgttacctaccgtagtaatcgaagttcctaccgttacccgtggttaaccgttcggtaccggtaacggtaaccgtaagggttacggaaacttaccgaaacgtacgttacggtcgacgtacgtaccaccttacg

SEQ ID NO: 136422 - DNA, 554 bp, Homo sapiens
  misc_feature: GYAE6OF02ID304.47.48.E04.1.454.CMB.1.raw
tcagagctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctcctgtctgcatctgtaggagacagagtcaccatcgacttgccgggcaggtcagggggtcttgcaaatgtcgtttggcctggtttcagcagacacagggaacgcccgtaagcgcctgatctagtggtgcatactactttgacgtaaagtcggggtacccagtacgtaacggttcgacggcggactacggttaggtacgtacgggacacgtagttcactcgtactactatacgacgcggtccgtgactcgactaggaactagttctagactaactttattactgtacctaccgtatattacgatcgtacttaccgtcgtacttcgggaccaagggtaccgaaggtacgaatacgtaagtacgtgacgtcacgtcactacg

SEQ ID NO: 136423 - DNA, 563 bp, Homo sapiens
  misc_feature: GYAE6OF02GTT93.47.48.E04.1.454.CMB.1.raw
  modified_base (221)..(221): a, c, t, g, unknown or other
  misc_feature (221)..(221): n is a, c, g, or t
  modified_base (373)..(373): a, c, t, g, unknown or other
  misc_feature (373)..(373): n is a, c, g, or t
tcagagctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccggnagtcagggcttgcaaatgctttggcctggtttcagcagacaccagggaaggcccctaagcgcctgatctatggtgcatacacttttgacaaagtcggggtacccatcaaggttcagcggcaggtaggtctgggacagagtcactctcactancagcggcctgcagcctagaacgtattctgactaactttattactgtactcctagtatgtatcgtaccttacccgtacggtacctttcgggacccgtaaacggggtaacccgtaagggttacgggtaaacgttaaccgtaaaaccggtaacgttcgggtacggtaccgttacggaccctaacccgttaacg

SEQ ID NO: 136424 - DNA, 559 bp, Homo sapiens
  misc_feature: GYAE6OF02IJWJH.47.48.E04.1.454.CMB.1.raw
  modified_base (192)..(192): a, c, t, g, unknown or other
  misc_feature (192)..(192): n is a, c, g, or t
  modified_base (225)..(225): a, c, t, g, unknown or other
  misc_feature (225)..(225): n is a, c, g, or t
  modified_base (401)..(401): a, c, t, g, unknown or other
  misc_feature (401)..(401): n is a, c, g, or t
  modified_base (405)..(405): a, c, t, g, unknown or other
  misc_feature (405)..(405): n is a, c, g, or t
tcagagctcacgtacacgaccggtgctcgatttagagagcgtcacagagagaaggggaggaatcagtcccactcaggacacagcatggacatgagggtccccgctcagctcctggggctcctgctgctctggttcccaggtgccaggtgtgacatccagatgacccagtctccatcctccctgtctgcatcngtaggagacagagtcaccatcacttgccgggtnagtcagggcgttgcaaatgcttggcctggttcagcagacaccagggacgccctaagcgcctgatctatcggtgcatacactttgacaaagtgggtcccatcaaaggttcagctgcagtaggtctggggacaggacgttcactctcactatcgagcggcctgacacgtactgaaatnttcngtactaacttaacttactacgccttccgagttataggtactcggtacttacccgtacggttaccgttttcggaccgtaaaccgggtaccgtaaagggtacggttaaactaacgtaaacccggtaacgttacgggtacggttccagggttaaccc

SEQ ID NO: 136425 - DNA, 531 bp, Homo sapiens
  misc_feature: GYAE6OF02GOSVF.47.48.E04.1.454.CMB.1.raw
  modified_base (199)..(199): a, c, t, g, unknown or other
  misc_feature (199)..(199): n is a, c, g, or t
tcagagctcacgtacacgaccggtgctcgatttagagagcgtcacagagagaaggggaggaatcagtcccactcaggacacagcatggacatgagggtccccgctcagctcctggggctcctgctgctctggttcccaggtgccaggtgtgacatccagatgacccagtctccatcctccctgtctgcatctgtagganacagagtcaccatcacttgccgggcgagtcagggcgttgcaaatgctttggcctggtttcagcagacacagggaaggcccctaagcgcctgactctatggtgcatacactttgctaaagtgggtccatcaaggttcagcggcaggtagtctgggacagagttcactctcactatcagcggctgccagcctagaagtattctgactaacttattactgtctccagttactgtatgtcttacccgtggtacctttcgggaccgtaacggggtaacctaagggttacgtaaacgttacgaaaacgtacgttacggtcggtactggaccctaaccg

SEQ ID NO: 136426 - DNA, 615 bp, Homo sapiens
  misc_feature: GYAE6OF02JXFIX.47.48.E04.1.454.CMB.1.raw
  modified_base (456)..(456): a, c, t, g, unknown or other
  misc_feature (456)..(456): n is a, c, g, or t
tcagagctcacgtacacgaccggtgctcgatttagagagcgtcacagagagaaggggaggtctcagagaggagccttagccctggactccaaggcctttccacttggtgatcagcactgagcacagaggactcaccatggaattggggctgagctgggttttccttgttgctatttagaaggtgtccagtgtgaggtgcaattggtgcaatctgggggaggcttggtccagccgtggggggtccctcagactctcctgtgcagcctctggattctacctttagttcctcttgatgtaagttggtccgccagactcgagggagggctgggaggtggttggacaactagtaatccgagagtaggaagtcaagaaacctagtgtaggactactcgtaggaacgggtccgatttccgaacctagtctaccgagacgaacaccgaccaagaactctacttntttcagactaaacgtgaactacgcctaggaacgagtacgaaacgaccgacgtaccgttgttacgtacgtttaccgtaggtttcggttacggttaccttcggtaccgggttacccgtcccgggttcccggacccggggtttacccgttcgggttcccggg

SEQ ID NO: 136427 - DNA, 514 bp, Homo sapiens
  misc_feature: GYAE6OF02G0GVL.47.48.E04.1.454.CMB.1.raw
  modified_base (422)..(422): a, c, t, g, unknown or other
  misc_feature (422)..(422): n is a, c, g, or t
  modified_base (426)..(426): a, c, t, g, unknown or other
  misc_feature (426)..(426): n is a, c, g, or t
  modified_base (478)..(478): a, c, t, g, unknown or other
  misc_feature (478)..(478): n is a, c, g, or t
tcagagctcacgtacacgaccggtgctcgatttagagagcgtcacagagagaaggggctcagagaggagccttagccctggactccaaggcctttccacttggtgatcagcactgagcacagaggactcaccatggaattggggctgagctgggttttccttgttgctattttagaaggtgtccagtgtgaggtgcaattggtgcaatctgggggaggcttggtccagcctggggggtccctcagactctcctgtgcagcctctggattcacctttagttcctcttggatgaattgggtccgccagactccgagggaaggggctggagtgggttggcaacataaatccagatgggaagtcagaaaacctatgtggactctctgaaggccattcacatctcagagacacgccaagactctctnttcngcaatcggacagcctgagagtacgaagacacgggctgtgtattacgtgtgtntctctgacgccgtcggcccgtacgttcggcttcggg

SEQ ID NO: 136428 - DNA, 506 bp, Homo sapiens
  misc_feature: GYAE6OF02GE4VH.47.48.E04.1.454.CMB.1.raw
tcagagctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcagggcgttgcaaatgctttggcctggtttcagcagacaccagggaaggcccctaagcgcctgatctatggtgcatacactttgcaaagtggggtcccatcaaggttcagcggcagtaggtctgggacagagttcactctcaccatcagcagtctgcaacctgaagtatttgactaacttactactgtacaactagtacgttacgtacccgttactacgtttcggaccaggggaccaacgtggaacatacaaacgacgtgtagctgaccacatctgtacc

SEQ ID NO: 136429 - DNA, 616 bp, Homo sapiens
  misc_feature: GYAE6OF02JTWT3.47.48.E04.1.454.CMB.1.raw
tcagagctcacgtacacgaccggtgctcgatttagagagcgtcacagagagaaggggaggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttggccgggcgagtcgagggtcgttgcaaatgctttggccttggtttcagcagacaccagggaacggcccctaagccgcctgactctagtggtgcatactacttgacaaaggttcgggtacccagtcaacggttcaacggtcggacgtaggtaggtccgtagggtacaggtagttccgaacgtctactactactacgacggtccgaccgtggaccacggtcctaggaacgtacttccgtagtacctaaactttacgtttaacgtcggttcctaaccgtaggttacttggtacttcgtaacccgtttacccgtacggttaccgtttacggaccggtaaacgggtaacctaagggttacgaaacttacgaaaccgttagtacgtacggactacgacctaaccg

SEQ ID NO: 136430 - DNA, 538 bp, Homo sapiens
  misc_feature: GYAE6OF02JJ9HM.47.48.E04.1.454.CMB.1.raw
  modified_base (352)..(353): a, c, t, g, unknown or other
  misc_feature (352)..(353): n is a, c, g, or t
  modified_base (369)..(369): a, c, t, g, unknown or other
  misc_feature (369)..(369): n is a, c, g, or t
  modified_base (432)..(432): a, c, t, g, unknown or other
  misc_feature (432)..(432): n is a, c, g, or t
  modified_base (437)..(437): a, c, t, g, unknown or other
  misc_feature (437)..(437): n is a, c, g, or t
  modified_base (457)..(457): a, c, t, g, unknown or other
  misc_feature (457)..(457): n is a, c, g, or t
  modified_base (465)..(465): a, c, t, g, unknown or other
  misc_feature (465)..(465): n is a, c, g, or t
  modified_base (470)..(470): a, c, t, g, unknown or other
  misc_feature (470)..(470): n is a, c, g, or t
tcagagctcacgtacacgaccggtgctcgatttagagagcgtcacagagagaagggaggtctcagagaggagccttagcctggactccaaggcctttccacttggtgatcagcactgagcacagaggactcaccatggaattgggctgagctgggtttccttgttgctattttagaaggtgtccagtgtgagtcgcaattggtgcaatctgggggaggcttggtcagcctggggggtccctcagactctcctgtgacagcctctggattcacccttttagttcctcttggtatgaattgggtccgccagactccagggaagggctggagtgggttgcaacgataaatccagnnggaatcaagaaaactntggtagactactctagaagggccattcgactatctccaagagacaacgaccaagaactctctnttctnacaaatggacagcctgtaanagtcgaanaacgnggtactagtataacgttctagtcgtagtactcgtagaccgtccgttacggacccggtactttggtccg

SEQ ID NO: 136431 - DNA, 527 bp, Homo sapiens
  misc_feature: GYAE6OF02FKXPR.47.48.E04.1.454.CMB.1.raw
  modified_base (440)..(440): a, c, t, g, unknown or other
  misc_feature (440)..(440): n is a, c, g, or t
tcagagctcacgtacacgaccggtgctcgatttagagagcgtcacagagagaaggggaggtctcagagaggagccttagccctggactccaaggcctttccacttggtgatcagcactgagcacagaggactcaccatggaattggggctgagctgggttttccttgttgctattttagaaggtgtccagtgtgaggtgcaattggtgcaatctgggggaggcttggtccagcctggggggtccctcagactctcctgtgcagcctctggattcacctttagttcctcttggatgaattgggtccgccagactccgaggggaaggggctgggagtgggttggcaacataaatccagatggaagtcaagaaaacctatagtggactctctgaagggccgattcaccatctccagagacaacgccaagaactctctgtttcngacaaatggaacagcctgagagtcgaaagacacggctgtgtattactgtgtgtctcgtgacgccgtcgggcccggtaccttggtccg

SEQ ID NO: 136432 - DNA, 566 bp, Homo sapiens
  misc_feature: GYAE6OF02JCMUT.47.48.E04.1.454.CMB.1.raw
  modified_base (361)..(361): a, c, t, g, unknown or other
  misc_feature (361)..(361): n is a, c, g, or t
  modified_base (377)..(377): a, c, t, g, unknown or other
  misc_feature (377)..(377): n is a, c, g, or t
tcagagctcacgtacacgaccggtgctcgatttagagagcgtcacagagagaaggggaggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcagtcagggcgttgcaaatgctttggcctggtttcagcagacaccgagggaacggcccctaagcgcctgatctatggtgcatacactttgacgaaagtgggtcccagtcaaggttcagcggcagtagtctgggacagngttcactctcgactancagcgcctgcagccgtagaagcttcgcgtactaactttacttattcgtacttccgagttatgaattcggacctttaacccgtcggtacctttacgggaccgtaaacggggtaaccctaaagggttaaccggtaaacgttaccgtaaaacggtaccggttacgttacgggcccgttagacccgtaacccg

SEQ ID NO: 136433 - DNA, 664 bp, Homo sapiens
  misc_feature: GYAE6OF02IZAXQ.47.48.E04.1.454.CMB.1.raw
  modified_base (198)..(198): a, c, t, g, unknown or other
  misc_feature (198)..(198): n is a, c, g, or t
tcagagctcacgtacacgaccggtgctcgatttagagagcgtcacagagagaaggggaggaatcagtcccactcaggacacagcatggacatgagggtcccgctcagctcctggggctcctgctgctctggttcccaggtgccaggtgtgacatccagatgacccagtctccatcctccctgtctgcatctgtagganacagacgtcaccatcacttggccggcgagtcgagggtcgttgacaaatgacttggcctggtttcacgcagacacgacgggaacgccctaagccgctgactctagtcggtagcatacactttacgacgtaaagtcgggtaccagtacgtaacggttcgacggtcggtacgtaggttacgggtcgtagggaacgtaggtacgtttcctacgtctacgacttagtccaacggtccggtaccgtggaccgtagtacccgtaggtaacttacgtttaccgtacgtacttaacgtttacgttaaccgttacggttaccgtaccgttagtacgttacgtacgttacgttaccgttaacccgttaccgggttacctttaccgggacccggttaaacggggtacccgttaaacgggttacgtaaaaccgttaccggaaacggttacttacggtacgggtactccgtacctaaccg

SEQ ID NO: 136434 - DNA, 546 bp, Homo sapiens
  misc_feature: GYAE6OF02IKY3C.47.48.E04.1.454.CMB.1.raw
  modified_base (356)..(356): a, c, t, g, unknown or other
  misc_feature (356)..(356): n is a, c, g, or t
  modified_base (402)..(402): a, c, t, g, unknown or other
  misc_feature (402)..(402): n is a, c, g, or t
  modified_base (419)..(419): a, c, t, g, unknown or other
  misc_feature (419)..(419): n is a, c, g, or t
tcagagctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatccctccctgtctgcatctgtaggagacagagtcaccatcacttgccgggcagtcagggcttgcaaatgctttggcctggtttcagcagacaccagggacggcccctaagccgcctgatctatggtgcatacactttgcaaaggtgggtcccatcaaggttcagcggacagtaggtctgggacngagttcactctcactatcagcggcctgcagcctagaacgtattcgngactaacttattacgtntcctaccagttatgtatcgtacttacccgtcggtacctttccggacctaacggggtaaccgtaacgggttacggtaaactaaccgaaaaccggtacgtacggtacggacctagtacccaccgtaacg

SEQ ID NO: 136435 - DNA, 576 bp, Homo sapiens
  misc_feature: GYAE6OF02IRR61.47.48.E04.1.454.CMB.1.raw
  modified_base (197)..(197): a, c, t, g, unknown or other
  misc_feature (197)..(197): n is a, c, g, or t
tcagagctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtagganacagagtcaccatcacttgccgggcgagtcagggcgttgcaaatgctttggccttggtttcagcagacaccgagggaacgccccgtaagccgctgatctagtggtgcatactactttgacgtaaagtcggggtaccagtcgaaggttcaggcggcaggtaggtcgtgggacaggtacgttcaacttctacaactatcgagccggcctgccacgtcctagaagtattcgtacgacttaaactttattacttcgttaccttaccgtaagttattgaactttcgtaccctttaacccgtcggttaccgtttccggaccgtaacggggaacctaagggtacggtaaactacgaaacgtaactggtacgactacgaccactacg

SEQ ID NO: 136436 - DNA, 516 bp, Homo sapiens
  misc_feature: GYAE6OF02GIV8X.47.48.E04.1.454.CMB.1.raw
  modified_base (433)..(433): a, c, t, g, unknown or other
  misc_feature (433)..(433): n is a, c, g, or t
  modified_base (443)..(443): a, c, t, g, unknown or other
  misc_feature (443)..(443): n is a, c, g, or t
  modified_base (452)..(452): a, c, t, g, unknown or other
  misc_feature (452)..(452): n is a, c, g, or t
tcagagctcacgtacacgaccggtgctcgatttagagagcgtcacagagagaaggggaggtctcagagaggagccttagccctggactccaaggcctttccacttggtgatcagcactgagcacagaggactcaccatggaattggggctgagctgggttttccttgttgctattttagaaggtgtccagtgtgaggtgcaattggtgcaatctgggggaggcttggtccagcctggggggtccctcagactctcctgtgcagcctctggattcacctttagttcctcttggatgaattgggtccgccagactccagggaggggctgggagtgggttggcaacataaatccagatggaagtcagaaaacctatgtgactctctgaacggccgattcaccatctccagagacaacgccaagaactctctgttcngacaatgacngacctgagngtcgaagacacggctgtgtagttacgtgttgtgtctctcgacgtcctcggccgtccgtggtccg

SEQ ID NO: 136437 - DNA, 515 bp, Homo sapiens
  misc_feature: GYAE6OF02GDQ1V.47.48.E04.1.454.CMB.1.raw
  modified_base (399)..(399): a, c, t, g, unknown or other
  misc_feature (399)..(399): n is a, c, g, or t
tcagagctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcagggcgttgcaaatgctttggcctggtttcagcagacaccagggaaggcccctaagcgcctgatctatggtgcatacactttgcaaaggtcggggtcccatcaaggttcaggcggcagtaggtctgggacagagttcactctcactatcagcgcctgcagcctgaagattcngactaacttattactgtctcctagttatgatcgtcttacctcgtacctttcggaccaacgggtaccgtaaggtacgaaactacgaaacgtacgtaggtcgacgtgacctacctacg

SEQ ID NO: 136438 - DNA, 503 bp, Homo sapiens
  misc_feature: GYAE6OF02FOS50.47.48.E04.1.454.CMB.1.raw
  modified_base (198)..(198): a, c, t, g, unknown or other
  misc_feature (198)..(198): n is a, c, g, or t
tcagagctcacgtacacgaccggtgctcgatttagagagcgtcacagagagaaggggaggaatcagtcccactcaggacacagcatggacatgagggtccccgctcagctcctggggctcctgctgctctggttcccaggtgccaggtgtgacatccagatgacccagtctccatcctcctgtctgcatctgtagganacagagtcaccatcacttgccgggcgagtcagggcgttgcaaatgctttggcctggtttcagcagacaccagggaaggcccctaagcgcctgatctatggtgcatacacgtttgcaaagtgggtccatcaaggttcagcggcagtaggtctgggacagagttcactctcactatcagcggcctgcagcctagagtacttctgctaacttattactgttctcctagtatgactgcgttaccctcgtacttcggccgaacgggtaccaaggtcgaaatcgaaacgacgtacgtaggctcgactaccg

SEQ ID NO: 136439 - DNA, 654 bp, Homo sapiens
  misc_feature: GYAE6OF02GAPGX.47.48.E04.1.454.CMB.1.raw
tcagagctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctcctgtctgcatctgtaggagacagagtcaccatcacttgccgggcgagtcgagggcttgcaaatgcttggcctggtttcagtcagacaccagggaacggccctaagcgccgtgatctatggtgcatacactttaggactaaaggtcggggtacccataccgtaaggttccaacggcggtacgaggttacgggtcgtaggggacctaggtacgtttacgaccgttcctaccgacttacttccgacggccggtcctcggaccagcccgtaggtaacgtattccgtacgtaccgtaaacttttacgttaccgttcggttaccttaccgtaagttaactacgtacgttacgtcccgtttaacccgttacggttacccgtttaccgggacccggtaaacgggtaacccggtaaggttaacggtaaaccgttaccgtaaaacgttaccggttacggtcgggtacctacggacctacccgtaacg

SEQ ID NO: 136440 - DNA, 510 bp, Homo sapiens
  misc_feature: GYAE6OF02J2R01.47.48.E04.1.454.CMB.1.raw
  modified_base (367)..(367): a, c, t, g, unknown or other
  misc_feature (367)..(367): n is a, c, g, or t
  modified_base (377)..(377): a, c, t, g, unknown or other
  misc_feature (377)..(377): n is a, c, g, or t
  modified_base (383)..(383): a, c, t, g, unknown or other
  misc_feature (383)..(383): n is a, c, g, or t
  modified_base (408)..(408): a, c, t, g, unknown or other
  misc_feature (408)..(408): n is a, c, g, or t
  modified_base (452)..(452): a, c, t, g, unknown or other
  misc_feature (452)..(452): n is a, c, g, or t
tcagagctcacgtacacgaccggtgctcgatttagagagcgtcacagagagaaggggaggaatcagtcccactcaggacacagcatggacatgagggtccccgctcagctcctggggctcctgctgctctggttcccaggtgccaggtgtgacatccagatgacccagtcctccatccctcctgtctgcatctgtaggagacagagtcaccatccacttgccgggcgagtcagggcgttgcaatgctttggcctggttcagcagacacagggaacgccctaagcgcctgatctatggtgcaatcgtactttgcgtaaagtgggtcccaatcgaaggttcaagtcggctagtaggtctagggacaggngttacactcncactancagcgctgcagccttagagtattcngactaacttattactgtactaccagttactgattcgcttaaccncggtacttcggaccgaaggactaaggtcgaaagtcaaacgtcagtcgactcgactacg

SEQ ID NO: 136441 - DNA, 551 bp, Homo sapiens
  misc_feature: GYAE6OF02GBBQ4.47.48.E04.1.454.CMB.1.raw
  modified_base (224)..(224): a, c, t, g, unknown or other
  misc_feature (224)..(224): n is a, c, g, or t
  modified_base (318)..(318): a, c, t, g, unknown or other
  misc_feature (318)..(318): n is a, c, g, or t
tcagagctcacgtacacgaccggtgctcgatttagagagcgtcacagagagaaggggaggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggnagtcagggcgttgcaaatgctttggccttggtttcagcagacaccagggaaggcccctaagctcctgatctacgatgcatccaatttggaaacngggtcccatcaaggtcagtgagtggatcgtgggacagtattttacttcactatcagcagcctgcagcctagaagatattgcaacattattactgtacaactagttaatctaataactaccttacccctactttccggaccccgttagggaaccctaaaggttacggtaacttaacgtaacctaaaaccggtaaccttaggttacggtacctacgggtacctaacccgttaacg

SEQ ID NO: 136442 - DNA, 628 bp, Homo sapiens
  misc_feature: GYAE6OF02GA2HF.47.48.E04.1.454.CMB.1.raw
  modified_base (222)..(222): a, c, t, g, unknown or other
  misc_feature (222)..(222): n is a, c, g, or t
tcagagctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatccctcctgtctgcatctgtaggagacagagtcaccatcacttgccgggnagtcgagggcgttgcaaatgctttggccttggtttcagcagacaccgagggacggcccctaagccgcctgatctagtggtcgcatacctactttgacgtaaaggtcggggtacccagtaccgtaagggttccaaggcggacgtaggtacgggtcgtagggactaggtacgtttcacgtcctacgtaaccttagtacgacggtccggtccctgcccgtaacggtccctaggaacgtactttcgtacggtaccttaaactttacgttacttcgtaccttccgtagttatgtacttcgtcccttaaccgtccggttacctttccggaccgtaaacgggtacccgtaagggtaacggtaaacgtaaccgtaaaccgtaacgtcggttacggacgtcgaccgtacctaacg

SEQ ID NO: 136443 - DNA, 531 bp, Homo sapiens
  misc_feature: GYAE6OF02G0QBT.47.48.E04.1.454.CMB.1.raw
  modified_base (222)..(222): a, c, t, g, unknown or other
  misc_feature (222)..(222): n is a, c, g, or t
  modified_base (398)..(398): a, c, t, g, unknown or other
  misc_feature (398)..(398): n is a, c, g, or t
  modified_base (402)..(402): a, c, t, g, unknown or other
  misc_feature (402)..(402): n is a, c, g, or t
tcagagctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggnagtcagggcgttgcaaatgctttggcctggtttcagcagacaccagggaacggcccctaagcgcctgatctatggtgcatacactttgacaaaggtggggtcccatcaaggttcagcggcagtaggtctggggacaggagttcactctacactatcagcggcctgcagcctgaagnttcngctaactttattactcgtctccagtatgtatcgtccttacccgtcggtacctttcggaccgtaagggaccctaagggtacggtaaactaccgaaaccgtaacgtcggtaggacctacggaccacgtacg

SEQ ID NO: 136444 - DNA, 653 bp, Homo sapiens
  misc_feature: GYAE6OF02GX8T9.47.48.E04.1.454.CMB.1.raw
  modified_base (224)..(224): a, c, t, g, unknown or other
  misc_feature (224)..(224): n is a, c, g, or t
tcagagctcacgtacacgaccggtgctcgatttagagagcgtcacagagagaaggggaggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggngagtcgagggcgttgcaaatgctttggcctggtttcagcagacaccaggggaacggcccctaagccgcctggatctatggtgcatactacgtttgacgtaaaggtcgggtacccatacgtaacggttcgacggtcggcaggtacggtcgtagggacgagtacgttacacttcctctacttatcgaacggtccggtccgttacgccgaccggtccgtaaggtaacgtagtttccgtagtacctaaacgttttacttaacgttcgtaccttaccgtagttaacgttgtaagttacgtacccgtttacccgttaccgggttaccgttttaccgggacccgttaaacgggggaaccccgttaagggggtaaacggttaaacgttaaccggaaacgttaacggttacggttacggtccgtacgaccttaacccg

SEQ ID NO: 136445 - DNA, 559 bp, Homo sapiens
  misc_feature: GYAE6OF02HYDTO.47.48.E04.1.454.CMB.1.raw
  modified_base (351)..(351): a, c, t, g, unknown or other
  misc_feature (351)..(351): n is a, c, g, or t
  modified_base (387)..(387): a, c, t, g, unknown or other
  misc_feature (387)..(387): n is a, c, g, or t
tcagagctcacgtacacgaccggtgctcgatttagagagcgtcacagagagaaggggaggaatcagtcccactcaggacacagcatggacatgacgggtccccgctcagctcctggggctcctgctgctctggttcccaggtgccaggtgtgacatccagatgacccagtctccatcctccctgtctgcatctgtaggagacagagtcaccatcacgttcggccgggcgagtcgagggcgttgacaaatgcttggcctggttcagcagacacgagggaacgcccctaagcgcctgatctagtggtgcattacactttgacaaaggtcgggtcccatcgaagttcagcgganagtaggtctagggacagtacgttcactctcacttancagcgcctgcagccgtagaagtcttcgtgactaactttattaccgttgtcctaccgtagtagttagtactcgtacctttacccgtcgttaccgttttccggaccggtaaagggaaccgtaagggtacggtaaaactcgaaacgacgttcggtacggtctacggactaacccg

SEQ ID NO: 136446 - DNA, 480 bp, Homo sapiens
  misc_feature: GYAE6OF02FQQ3V.47.48.E04.1.454.CMB.1.raw
tcagagctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccaggcgagtcagggcgttgcaaatgctttggcctggtttcagcagacaccagggaaggcccctaagcgcctgatctatggtgcatacactttgcaaagtgggtcccatcaaggttcagcggcagtaggtctgggacagagttcactctcactatcagcggcctgcagcctgaagattctgcaacttattactgtctccagtatgatgcttacctgtacttcggccaagggaccaaggtgaaatcgaacgactgtagctgctac

SEQ ID NO: 136447 - DNA, 541 bp, Homo sapiens
  misc_feature: GYAE6OF02HGDFY.47.48.E04.1.454.CMB.1.raw
  modified_base (437)..(437): a, c, t, g, unknown or other
  misc_feature (437)..(437): n is a, c, g, or t
  modified_base (442)..(442): a, c, t, g, unknown or other
  misc_feature (442)..(442): n is a, c, g, or t
  modified_base (466)..(466): a, c, t, g, unknown or other
  misc_feature (466)..(466): n is a, c, g, or t
tcagagctcacgtacacgaccggtgctcgatttagagagcgtcacagagagaaggggaggtctcagagaggagccttagccctggactccaaggcctttccacttggtgatcagcactgagcacagaggactcaccatggaattggggctgagctgggttttccttgttgctattttagaaggtgtccagtgtgaggtgcaattggtgcaatctgggggagcttggtccagcctggggggtccctcagactctcctgtgcagcctctggattcacctttagttcctcttggatgaattgggtccgccagacctccgagggaaggggctggaggtgggttggcaacataaatccagatggaatcaagaaaacctatagtggactctctgaagggccattcaccatcctacgagagaccaacgccaaagacctctcttntttcngacaaatcgaacagacctgaacgngtacgaagacgacgctgtagtattcgtgtgtgttctcgtcggaccgtccgtaccgggtcccgtacgttcggtccg

SEQ ID NO: 136448 - DNA, 599 bp, Homo sapiens
  misc_feature: GYAE6OF02FS7N3.47.48.E04.1.454.CMB.1.raw
tcagagctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttggccgggcgagtcgagggcgttgcaaatgctttggcctggtttcagcagacaccgggaaggacccgtaaccgtacgccgtcgtagtactacgtaggtggtcactactacttacgttcgaaacgtagggttccgactacgtagtacgtacgacggcgagtaggtcgtggtaggacgagtactactctctactactacacgacggcgtaccgcgacgtcgtcgaagtacttgtacgactaaccttaactttacttacgttcgtacctagtagtagtagttcgtcgttacccttacggttaccgttaccggtaccgaacggtaaccggtaacggtacggtaaacgtaaccgaacgtaacgtagtacggtcgtacgctacctattacg

SEQ ID NO: 136449 - DNA, 555 bp, Homo sapiens
  misc_feature: GYAE6OF02GJDD3.47.48.E04.1.454.CMB.1.raw
  modified_base (223)..(223): a, c, t, g, unknown or other
  misc_feature (223)..(223): n is a, c, g, or t
  modified_base (409)..(409): a, c, t, g, unknown or other
  misc_feature (409)..(409): n is a, c, g, or t
tcagagctcacgtacacgaccggtgctcgatttagagagcgtcacagagagaaggggaggaatcagtcccactcaggacacagcatggacatgagggtccccgctcagctcctggggctcctgctgctctggttcccaggtgccaggtgtgacatccagatgacccagtctccatcctcctgtctgcatctgtaggagacagagtcaccatcacttgccgggngagtcagggcgttgcaaatgctttggccttggtttcagcagacaccagggaacggcccctaagccgcctgatctatggtgcatacactttgacaaagtcgggtacccatacaaggttcagcggctagtaggtctagggacagagttcactctcactatcgagccggctgcagcctagacgattccngacctaactttattactgttactcctagttatgattcgtacctttacccgtcggttacctttccgggaccgtaaacggggtacccgtaagggtacggttaaactacggtaaaacgtacgttaggtacggaccttggacctaacccg

SEQ ID NO: 136450 - DNA, 537 bp, Homo sapiens
  misc_feature: GYAE6OF02IH32N.47.48.E04.1.454.CMB.1.raw
  modified_base (405)..(405): a, c, t, g, unknown or other
  misc_feature (405)..(405): n is a, c, g, or t
tcagagctcacgtacacgaccggtgctcgatttagagagcgtcacagagagaaggggaggaatcagtcccactcaggacacagcatggacatgagggtccccgctcagctcctggggctcctgctgctctggttcccaggtgccaggtgtgacatccagatgacccagtctccatcctcctgtctgcatctgtaggagacagagtcaccatcacttggccgggcgagtcgagggcgttgcaaatgctttggcctggtttcagcagacaccgagggacggcccctaagcgcctgatctatggtgcatactactttgacaaaggtcgggtcccatcaaggttcagcggcagtagtcgtagggacagtagttcactctacactatcagcgctgcagctagagtattcngactaacttattactgtctacgtagtatgtatcgtaccttacccgtcggttaccgtttcggaccgtaacgggtaaccctaaggggtaacggtaaactaccgaaacgacgtaggtacggctacgcctaacccg

SEQ ID NO: 136451 - DNA, 542 bp, Homo sapiens
  misc_feature: GYAE6OF02HK5YL.47.48.E04.1.454.CMB.1.raw
  modified_base (408)..(408): a, c, t, g, unknown or other
  misc_feature (408)..(408): n is a, c, g, or t
tcagagctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatccctccctgtctgcatctgtaggagacagagtccaccatcacttggcccgggcgagtcgagggcgttgcaaatgctttggcctggtttcagcagacaccagggaacggcccctaagcgcctgatctatggtgcatacactttgactaaaggtggggtcccatcaaggttcagcggcaggtaggtctgggacaggagtttcatctctactatcagccggcctgcagcctagaagtnttctgactaactttattactcgttactcctagttatgtatcgtcctttaacccgtcggtactttccggaccggtaacgggtaccgtaaggtaggaaactaccgaaacgtactggtacggtctacgaccactacg

SEQ ID NO: 136452 - DNA, 812 bp, Homo sapiens
  misc_feature: GYAE6OF02JYAWC.47.48.E04.1.454.CMB.1.raw
  modified_base (199)..(199): a, c, t, g, unknown or other
  misc_feature (199)..(199): n is a, c, g, or t
tcagagctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatcgacccagtcctccatccctcctgtctgcatctgtagganacagagtcaccatctacgttcggccgggcgagtcgagggtcttgacaatgctttggccttggtttcagcagacaccgagggaacggccctaaggcgccgtgactcctagtcggtgactaattaacctacgtttcgacgtaaaacggttcggggtaccctaacgtacgtaacggttacgaacgggccggtacgtaagggttacgggttaccggtacggggtaaaccgtaaggttacggtttaccgtaccgttaccgttaccgtaacgttaacgtaccggaaccgggtcccgggtacccgttagggtaacccgtaacggtacccgttaaagggtaaacgttaccgtttaccggtaaccggtaacttaaaaccgttttaacgtttaacccgttacgttacccttaaccgtaaacgtttacgttacgggttaaccgtttaccggtacccgttttaaccccgttaccggggtttaacccgtttacccggggtaacccggtaaacgggggtaaccccgttaaaaggggtaacggttaaaaccgttaaacccggttaaaccgggtaaacggtttacgggtaaccgggtaccgtaaccggttaccgtaaccctttaaccgg

SEQ ID NO: 136453 - DNA, 534 bp, Homo sapiens
  misc_feature: GYAE6OF02IZNS3.47.48.E04.1.454.CMB.1.raw
  modified_base (385)..(385): a, c, t, g, unknown or other
  misc_feature (385)..(385): n is a, c, g, or t
  modified_base (420)..(420): a, c, t, g, unknown or other
  misc_feature (420)..(420): n is a, c, g, or t
tcagagctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcagggcttgcaaatgtctttggcctggtttcagcagacaccgagggaacggcccctaagcgcctgatctatggtgacactacactttgacgtaaaggtcggggtcccatcaaaggttcagcggcaggtaggtgtgggacagtagttcactctacactancagcgctgcagctagagtattctgacattatactntctacagtatgatcgtaccttacccgtacgtcctttacggaccgtaacgggtaccctaaagggtaccgaaaacgttaccgaaacgtaacgtggtacggcttacgacaccctaag

SEQ ID NO: 136454 - DNA, 530 bp, Homo sapiens
  misc_feature: GYAE6OF02GLM51.47.48.E04.1.454.CMB.1.raw
  modified_base (403)..(403): a, c, t, g, unknown or other
  misc_feature (403)..(403): n is a, c, g, or t
  modified_base (407)..(407): a, c, t, g, unknown or other
  misc_feature (407)..(407): n is a, c, g, or t
tcagagctcacgtacacgaccggtgctcgatttagagagcgtcacagagagaaggggaggaatcagtcccactcaggacacagcatggacatgagggtccccgctcagctcctggggctcctgctgctctggttcccaggttccaggtgtgacatccagatgacccagtctccatcctccctgtctgcatctgtaggagacagagtcaccatcacttgccgggcgagtcagggcgttgcaaatgctttggcctggtttcagcagacaccagggaaggcccctaagcgcctgatctatggtgcatacactttgcaaagtggggtcccagtcaaggttcaaggcggcagtaggtctggggacaggagtttccactctcactatcaggcgcctgcagcctagaagnttcngctaactttattactgttctcctagtatgtatgtaccttaccgtcgtacgttttcggtacgaaggggtacctaagggtacggaaacttacgaaaacgtaacgtcggtaggactgaccactacg

SEQ ID NO: 136455 - DNA, 538 bp, Homo sapiens
  misc_feature: GYAE6OF02H2A13.47.48.E04.1.454.CMB.1.raw
  modified_base (304)..(304): a, c, t, g, unknown or other
  misc_feature (304)..(304): n is a, c, g, or t
  modified_base (419)..(419): a, c, t, g, unknown or other
  misc_feature (419)..(419): n is a, c, g, or t
tcagagctcacgtacacgaccggtgctcgatttagagagcgtcacagagagaaggggaggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttggccgggcgagtcgagggcgttgacaaatgctttggcctggtttcagcagacacgagggaaggcccctaagcgcctgatctatggtncatacactttgacaaaggtcgggtcccatacaaggttcagctgactaggtaggtcgtagggacaggtacgttcactctactactatcgagcggctgcagccgtagaagtacttcncgactaacttacttacttgtactcctagttactgtacttcgtaccttaccctcggtacctttcggaccgtaacgggacgtaaggtagaactacgaacgtacgtagtcggtactgtaccg

SEQ ID NO: 136456 - DNA, 528 bp, Homo sapiens
  misc_feature: GYAE6OF02F8AVQ.47.48.E04.1.454.CMB.1.raw
  modified_base (438)..(438): a, c, t, g, unknown or other
  misc_feature (438)..(438): n is a, c, g, or t
tcagagctcacgtacacgaccggtgctcgatttagagagcgtcacagagagaaggggaggtctcagagaggagccttagccctggactccaaggcctttccacttggtgatcagcactgagcacagaggactcaccatggaattggggctgagctgggttttccttgttgctatttagaaggtgtccagtgtgaggtgcaattggtgcaatctgggggaggcttggtccagcctggggggtccctcagactctcctgtgcagcctctggattcacctttagttcctcttggatgaattgggtccgccagactccagggaggggctggagtgggttgcaacataaatccagatggaagtcaagaaaacctatagtggactctctgaagggccgattcaccgatcctccaagacgacaacgccaagaacctctctgttcngcaaatggacagcctggatagtacgaagacgacggctgtgtacttactgttgtgtcctgtcgaccgcctccgggccggtccgttggtccg

SEQ ID NO: 136457 - DNA, 494 bp, Homo sapiens
  misc_feature: GYAE6OF02FXEPX.47.48.E04.1.454.CMB.1.raw
  modified_base (382)..(382): a, c, t, g, unknown or other
  misc_feature (382)..(382): n is a, c, g, or t
  modified_base (391)..(391): a, c, t, g, unknown or other
  misc_feature (391)..(391): n is a, c, g, or t
tcagagctcacgtacacgaccggtgctcgatttagagagcgtcacagagagaaggggaggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcagtcagggcgttgcaaatgctttggcctggtttcagcagacaccagggaaggcccctaagcgcctgactctatggtgcatacactttgcaaagtgggtccatcaggttcagtggaagtgatctgggacagtatttactttcactatcagcagcctgcngcctgaagntatgactaacatattactgtacaactagtactcatatcctacccacttccggcctggaaccaagttcgacttacgtacaacgtacgtgtggctagacctaacg

SEQ ID NO: 136458 - DNA, 628 bp, Homo sapiens
  misc_feature: GYAE6OF02JPERI.47.48.E04.1.454.CMB.1.raw
  modified_base (200)..(200): a, c, t, g, unknown or other
  misc_feature (200)..(200): n is a, c, g, or t
  modified_base (223)..(223): a, c, t, g, unknown or other
  misc_feature (223)..(223): n is a, c, g, or t
  modified_base (289)..(289): a, c, t, g, unknown or other
  misc_feature (289)..(289): n is a, c, g, or t
  modified_base (399)..(399): a, c, t, g, unknown or other
  misc_feature (399)..(399): n is a, c, g, or t
  modified_base (444)..(444): a, c, t, g, unknown or other
  misc_feature (444)..(444): n is a, c, g, or t
tcagagctcacgtacacgaccggtgctcgatttagagagcgtcacagagagaaggggaggaatcagtcccactcaggacacagcatggacatgagggtccccgctcagctcctggggctcctgctgctctggttcccaggtgccaggtgtgacatccagatgacccagtctccatcctcctgtcctgccatctgtagganacagatcacatcacttgcccggngatcgagggcgttgcaatgctttggcttggttcagcagacacacgggaacggcccctaagcgcctnacgtactagtcggtcacatactactttgactaaggtcggtcctatccaaggttcagcgctagtaggtcgagggacagtagttcgacctctacactagtacacgtcgtccngcccagtccgtgaaacgttgtactcgactaaactttattaccgtnttccgtaccgtagtacgttgtaacgtacgtacccgtttacccgtacggtttacccgttaccgggtaccccgtaaaacgggggtaacccgttaaaggggttaaccggtaaaaccgttaaaccggtaaaaccggtaacccggtttacgggttccgggtaacccgtttacgaaccccgttaaccccg

SEQ ID NO: 136459 - DNA, 553 bp, Homo sapiens
  misc_feature: GYAE6OF02FWHEW.47.48.E04.1.454.CMB.1.raw
  modified_base (422)..(422): a, c, t, g, unknown or other
  misc_feature (422)..(422): n is a, c, g, or t
  modified_base (470)..(470): a, c, t, g, unknown or other
  misc_feature (470)..(470): n is a, c, g, or t
  modified_base (494)..(494): a, c, t, g, unknown or other
  misc_feature (494)..(494): n is a, c, g, or t
tcagagctcacgtacacgaccggtgctcgatttagagagcgtcacagagagaagggggccttagccctggactccaaggcctttccacttggtgatcagcactgagcacagaggactcaccatggaattggggctgagctgggttttccttgttgctattttagaaggtgtccagtgtgaggtgcaattggtgcaatctggggggaggcttggtccagcctgggggggtccctcagactctcctgtgcagcctctggattcacctttagttcctcttggatgaattgggtccgccagactccgaggggaaggggcgtggaggtgggtggacacataaatccagataggaagtcaagaaacctatgtggactctcgtgaagggccattccaccatctcagacgacaacgccaagactctactntttctgacaaagtggacagcctggagacgtcgaagacacggctcggtntattactgtgtgtctcgtggaccnccgtcgggcccgtaccttgggcctttcggtcgggggccttacgggacccttgggtaccc

SEQ ID NO: 136460 - DNA, 640 bp, Homo sapiens
  misc_feature: GYAE6OF02IBFL3.47.48.E04.1.454.CMB.1.raw
  modified_base (222)..(222): a, c, t, g, unknown or other
  misc_feature (222)..(222): n is a, c, g, or t
tcagagctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggngagtcagggcgttgcaaatgtcgtttggccttggtttcagcagacaccgaagggaacgccccgtaagccgcctgatctagtggtgacatacgtacgtttgacgtaacggtcggggtacccagtacgtaaggttcgacggcggtacgaaggttacgggtacgtaggggaccgtaggtacgtttactacgttcgtacctacgttactcgacggtccggtaccgtcgaccgacgtccgtacggaacgttacttcgtacgtaccttaaactttacttacgttcgttaccttacctaagttactgtacgttcgtaccgttacccgttaccggttaccgtttaccggaacccgtaacgggaaccggtaaggtacggaaacgttaaccgaaacgtacgtaggtaccgtacgtcgaccctactacg

SEQ ID NO: 136461 - DNA, 512 bp, Homo sapiens
  misc_feature: GYAE6OF02GSOMZ.47.48.E04.1.454.CMB.1.raw
  modified_base (306)..(306): a, c, t, g, unknown or other
  misc_feature (306)..(306): n is a, c, g, or t
tcagagctcacgtacacgaccggtgctcgatttagagagcgtcacagagagaagggggaaggtcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcagggcgttgcaaatgctttgcctggtttcagcagacaccagggaaggcccctaagcgcctgatctatggtgcatacnctttgcaaagtggggtcccagtcaaggttcagcggcagtaggtctgggacaggagttcatctacactatcagcggcctgcagcctgaagattcagactaacttattactgtctccagtatgtatctcttacctcggtactttcggaccaacgggtacccaaggtacggaaattccgaaacggtactggtacggctacgccactacg

SEQ ID NO: 136462 - DNA, 515 bp, Homo sapiens
  misc_feature: GYAE6OF02GWNB2.47.48.E04.1.454.CMB.1.raw
  modified_base (426)..(426): a, c, t, g, unknown or other
  misc_feature (426)..(426): n is a, c, g, or t
tcagagctcacgtacacgaccggtgctcgatttagagagcgtcacagagagaaggggctcagagaggagccttagccctggactccaaggcctttccacttggtgatcagcactgagcacagaggactcaccatggaattggggctgagctgggttttccttgttgctattttagaaggtgtccagtgtgaggtgcaattggtgcaatctgggggaggcttggtccagcctggggggtccctcagactctcctgtgcagcctctggattcacctttagttcctcttggatgaattgggtccgccagactccagggaagggctggagtgggttgcaacataaatccagatggaagtcaagaaaacctatgtggactctctgaagggccgattcaccatctcagagacaacgcaagactctctgttcngcaaatgacagcctagagtacgtacgaacgacacggctgtgtattacgtgtgtagtctctgcgtccgtcggccgtacttggcttccggg

SEQ ID NO: 136463 - DNA, 776 bp, Homo sapiens
  misc_feature: GYAE6OF02HO1UR.47.48.E04.1.454.CMB.1.raw
tcagagctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatccctccctgtcctgctactctggtaggacgacgagtacgtaccaacctactacctacgttcgggacccgggacgacgtacggagggtcgttacgaactaaagtcgttcgtttcggaccgtttcggttacacgacgacgaaccgaaccggaacggggaaccccgaccccgtaaggcccgtaccgtagtacttacgttaggtcggtcgactaacttaccgttacgtttacgaacggttaaacggggttcccgggtaccctaagtaaccggtaacgggttaccgacgggtacgggtacgtaagggttacgggtaccgggtacgggaacgtacggtttaacctttaccgaacctttaccgtaacccgtaacgttacgtaccggacggtcccggtactcgacgtaccgtacgtaaggtaagttacttcgtaccgtaacttaaacgttttactacgttcgttacccgtacgtaagttacgtagttacgttaccgttacccttacccggttccggttaccgttaccgggaacggtaaccgggaaccgtaagggtaacgtaaaccttaacggaaaccgttacgtacggtacgtacgaccgtacaccgtacg

SEQ ID NO: 136464 - DNA, 661 bp, Homo sapiens
  misc_feature: GYAE6OF02FU3GL.47.48.E04.1.454.CMB.1.raw
  modified_base (225)..(225): a, c, t, g, unknown or other
  misc_feature (225)..(225): n is a, c, g, or t
tcagagctcacgtacacgaccggtgctcgatttagagagcgtcacagagagaaggggaggaatcagtcccactcaggacacagcatggacatgagggtccccgctcagctcctggggctcctgctgctctggttcccaggtgccaggtgtgacatccagatgacccagtctccatcctcctgtctgcatctgtaggagacagagtcaccatcacgttggccgggngagtcgaggggcgttgcaaatgctttggccttggtttcagcagacaccgagggaacggcccctaagcgcctgatctatggtgcatactacgtttgacaaagggttcgggtacccagttaccgtaaggttcgacggtccgggacgtaaggttacgggtcgtacgggggaactagggtacgtttaccgtaccgttcctacctaacgtactccgacggccggtccgtcggacctacggtcctaggtaacgtactttacctacggtaaccttaacgtttaactttaccgtacgttccctaccgtaagttatacgtacttcgtacctttaacccgttcggttacccgttttaccggaccggtaaacgggtaacccgtaagggtaacgtaaaccgttaccggaaacgttacggttacggttacggcctacggtacctaaccg

SEQ ID NO: 136465 - DNA, 555 bp, Homo sapiens
  misc_feature: GYAE6OF02H3LUD.47.48.E04.1.454.CMB.1.raw
  modified_base (415)..(415): a, c, t, g, unknown or other
  misc_feature (415)..(415): n is a, c, g, or t
tcagagctcacgtacacgaccggtgctcgatttagagagcgtcacagagagaaggggaggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatccacttgccgggcgagtcagggcgttgcaaatgcgtttggcctggtttcagcagacaccgagggacgcccctaagcgcctgatctatgtgcatacactttgacaaaggtcgggtacccagtacgaaggttcaggcggacaggtacggtcgtagggactagagttccgaactctacactatcgagccgctgcacgcctgaagtnttcgtagacctaacttattacgtgttactcctagtatagatgtacccttaccgtacggtaccgtttacggaccggtaaagggaaccgtaaggtacggtaaacgtaacgaacgtaacgtagtcggactacggacctaaccg

SEQ ID NO: 136466 - DNA, 707 bp, Homo sapiens
  misc_feature: GYAE6OF02HAZDJ.47.48.E04.1.454.CMB.1.raw
  modified_base (198)..(198): a, c, t, g, unknown or other
  misc_feature (198)..(198): n is a, c, g, or t
  modified_base (208)..(208): a, c, t, g, unknown or other
  misc_feature (208)..(208): n is a, c, g, or t
  modified_base (225)..(225): a, c, t, g, unknown or other
  misc_feature (225)..(225): n is a, c, g, or t
tcagagctcacgtacacgaccggtgctcgatttagagagcgtcacagagagaaggggaggtctcagagaggagccttagccctggactccaaggcctttccacttggtgatcagcactgagcacagaggactcaccatggaattggggctgagctgggttttcctgttgctattttagaaggtgtccagtgtgaggtnactagttggnactaatcgggagggggngtcgttcggtacgacggccgggttcgggggtcccagacgtacctcctccgtgtcgacgcgtcctgtaggtacttccttaccgtttacgttccttcgttaggtataggttacggttccgggtacccgaccgtacgtaccgtacgggaagggggacgggtcggtagggagggttcggggtacgaaccgaagtaaagtaactacggagtaggtaggtaacgtaacgaaaacgtaaacgtagtaggtacgtactccgttacggtaacgggacggtacctacgtaccaacgtcttaccgaacgaggtaacgaaacgacccgaacgtaaagtaccctttcttaccgtttgttacacgaacgtaaagtccggaacttcgaccttagggaagttaacggtagaaaccgagtccgagttagtctttaacgtgttggttatcgtcctaccggagtcccggtccggtacggttacccgttcggtcgttccggg

SEQ ID NO: 136467 - DNA, 610 bp, Homo sapiens
  misc_feature: GYAE6OF02I4XTP.47.48.E04.1.454.CMB.1.raw
  modified_base (345)..(345): a, c, t, g, unknown or other
  misc_feature (345)..(345): n is a, c, g, or t
tcagagctcacgtacacgaccggtgctcgatttagagagcgtcacagagagaaggggaggtctcagagaggagccttagccctggactccaaggcctttccacttggtgatcagcactgagcacagaggactcaccatggaattggggctgagctgggttttccttgttgctattttagaaggtgtccagtgtgaggtgcaattggtgcaatctggggggaggcttggtccagcctggggggtcccctcagactctcctgtgcagcctctggattcacctttagttcctcttggatgaattgggtccgcagctccgagggagggctggagtgggtgcaacataanccagatggaagtcaagaaactatgtagactctctagaacggggccaattccaaccatccgtaccagacgaaccaaccgacccaaagaaccttcctacttgtttacctcggactaaagttcggaacacggtaccctaggaacggtacgtacggaaacgaccgacgggtacttaggtagttaacgtttacgttggttaggttcgttaccgttacgtacggtacccggtcccggttaccggggccccgggttacctttcgggtcccgg

SEQ ID NO: 136468 - DNA, 548 bp, Homo sapiens
  misc_feature: GYAE6OF02IIPXP.47.48.E04.1.454.CMB.1.raw
  modified_base (313)..(313): a, c, t, g, unknown or other
  misc_feature (313)..(313): n is a, c, g, or t
  modified_base (376)..(376): a, c, t, g, unknown or other
  misc_feature (376)..(376): n is a, c, g, or t
  modified_base (384)..(384): a, c, t, g, unknown or other
  misc_feature (384)..(384): n is a, c, g, or t
tcagagctcacgtacacgaccggtgctcgatttagagagcgtcacagagagaagggggaatcagtcccactcaggacacagcatggacatgagggtccccgctcagctcctggggctcctgctactctggctccgaggtgccagatgtgacatccagatgacccagtctccatcctccctgtctgcatctgtaggagacagagtcaccatcacttgccggcaagtcagagcattaacagcgtatttaaattggtatcaccagaaaccagggaaacgcccctaaacctcctgatctatgctgcatcctagtttnctatagtcggtcccattcgtaggttcagtgcagtggatcgtggactgatttcactctcacatnagcatctnacctaactgaagtattttgactaacttactactacgtacaacgtagtacgttaccgtaaccccgtattacgttttaggacccgtaaggggacctaaacgtggtaacctacgtaaaccgaaaccgtaaacgttggtacggtacctacgacctacccgtattaccg

SEQ ID NO: 136469 - DNA, 513 bp, Homo sapiens
  misc_feature: GYAE6OF02G6MYO.47.48.E04.1.454.CMB.1.raw
tcagagctcacgtacacgaccggtgctcgatttagagagcgtcacagagagaagggggaatcagtcccactcaggacacagcatggacatgagggtccccgctcagctcctggggctcctgttgctctggttcccaggttccagatgcgacatccagatgacccagtctccatcttctgtgtctgcttctgtaggagacagagtcaccatcacttgtcgggcgagtcagggtattagcaactggttagcctggtatcaacagaaaccagggaaagcccctaacctcctcatctctactgcatccactttgcaaagtgggtcccatctaggttcagtggcagtggatcgtgggacagtatttcactctcaccatcagcagtctgcaacctgaagtatttgctaacttactactgtacaacagtacgttaccggtaccccgtactacgttttggccgaaggggaccaaacgtggacatacaaacgactgtcggctgcacatctgtcttcatcccg

SEQ ID NO: 136470 - DNA, 607 bp, Homo sapiens
  misc_feature: GYAE6OF02H2V51.47.48.E04.1.454.CMB.1.raw
  modified_base (472)..(472): a, c, t, g, unknown or other
  misc_feature (472)..(472): n is a, c, g, or t
  modified_base (510)..(510): a, c, t, g, unknown or other
  misc_feature (510)..(510): n is a, c, g, or t
tcagagctcacgtacacgaccggtgctcgatttagagagcgtcacagagagaaggggctcagagaggagccttagccctggactccaaggcctttccacttggtgatcagcactgagcacagaggactcaccatggaattggggctgagctgggttttccttgttgcttattttagaaggtgtccagtgtgaggtgcaattggtgcaatcgtggggggaggcttggtccagccgtgggggggtccctgagactctcctgtgcagcctctggattcacctttagttccctcttggatgaacgtttgggtcccgccagactccgagggagggctggaggtgggttggcaagtaataaactccgagtatggaagtcaaacgaaaacctatggtagtactctcgtaggaacgggaccgtattccaacctagtcctaccgaagacgaacaaccgacaaagtaacctcttactgttcngacaatgaacagcctagagagtacgaagacaccgggtntggtacgtagtttaccgaggttgttcgtccttacgtcggtaacccgtcccggtaccgggtaccccgggttacgttttcgggacccttttcccggggg

SEQ ID NO: 136471 - DNA, 564 bp, Homo sapiens
  misc_feature: GYAE6OF02IO8AE.47.48.E04.1.454.CMB.1.raw
tcagagctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcagtcagggcttgcaaatgctttggcctggtttcagcagacaccagggaacggcccctaagcgcctggatctagtggtgcatacactttgacaaaggtcggggtcccagtcaaggttcagcggcaggtacggtcgtggggacaggtacgttcactctcaactatcaggcgcctgcacgcctagaatattctgactaaacttattactgtcctaccgtagttatgaacttcgtacctttacccgtcgggttaccttttccgggaccgtaacggggtaaccgtaaagggtacggtaaacgtaccgaaaacgtaacgtcggttacggaccgtacgacctacctacg

SEQ ID NO: 136472 - DNA, 537 bp, Homo sapiens
  misc_feature: GYAE6OF02FK3R1.47.48.E04.1.454.CMB.1.raw
  modified_base (400)..(400): a, c, t, g, unknown or other
  misc_feature (400)..(400): n is a, c, g, or t
tcagagctcacgtacacgaccggtgctcgatttagagagcgtcacagagagaaggggaggaatcagtcccactcaggacacagcatggacatgagggtccccgctcagctcctggggctcctgctgctctggttcccaggtgccaggtgtgacatccagatgacccagtctccatcctcctgtctgcatctgtaggagacagagtcaccatcacttgccgggcgagtcagggcgttgcaaatgctttggctggtttcagcagacacagggaaggcccctaagcgcctgatctatggtgcatacactttgacaaagtcgggtccagtcaaggttcagcggcagtacgtctgggacagtagttcacgtctcactatcagcgcctcgcacgctgaagtattcngtactaacttattactcgttcctactagttattcgattcgccttacccgtccggtacgttcggaccggtaacgggtaccgtaagggttacggtaaacgtacgaaaccgtaacgttacggtacggcgtcgactaaccg

SEQ ID NO: 136473 - DNA, 877 bp, Homo sapiens
  misc_feature: GYAE6OF02GCQ69.47.48.E04.1.454.CMB.1.raw
tcagagctcacgtacacgaccggtgctcgatttagagagcgtcacagagagaaggggctcagagaggagccttagccctggactccaaggcctttccacttggtgatcagcactgagcacagaggactcaccatggaattggggctgagctgggttttccttgttgcttattttagaaggtgtccagtgtgaggtgcaattggtgcaatcgtgggggagtcgttggtccaggccgtggggggtccctggacgactctcctgccgcagcctctggatttcctcctttaggtagttatcgccctagtgtacgttggggtcccgcctacggcctaccgaagggggaaggggccgttgggaggttcgggtcctacgaggtcgtacgtttggggtagggttacggtggggtaccgtacggaacgggtaacctaacgtaacgttttaaaccggtaaaaccggttccccgttaggaccggtaacgggggtcccgtaactttttacgttttaacgtccttacccgaaagggtaacgtaaaccttaaaccgttacccggaaaagggtaaaccttaacgttaacccgttagttaacgtttcccttagggacccttaagggtttaaccggaacccttaaagggtacccgttagggaaacgggtaccgggttacgggtaaaccgggtaaccgtaaccccgggggttaccgtttaagttttaacggttttaccgttttaggggtttaaaacgtttttaaaaccgggggttgggggtttaacgttttacggggggttaacggttaacccccggttttaaacggtaaccccggggtttttaccgggggttttaccccggggggggggacccccgggtttttaaaaaccccgg

SEQ ID NO: 136474 - DNA, 530 bp, Homo sapiens
  misc_feature: GYAE6OF02GCOUB.47.48.E04.1.454.CMB.1.raw
  modified_base (382)..(382): a, c, t, g, unknown or other
  misc_feature (382)..(382): n is a, c, g, or t
  modified_base (414)..(414): a, c, t, g, unknown or other
  misc_feature (414)..(414): n is a, c, g, or t
tcagagctcacgtacacgaccggtgctcgatttagagagcgtcacagagagaaggggctcagagaggagccttagccctggactccaaggcctttccacttggtgatcagcactgagcacagaggactcaccatggaattggggctgagctgggttttccttgttgctattttagaaggtgtccagtgtgaggtgcaattggtgcaatctgggggaggcttggtccagcctgggggggtccctcagactctcctgtgcagcctctggattcaccttttagttcctcttggatgaattgggtccgccagactccagggaaggggctggagtgggttggcaacataaaatccaagatggaagtcaagaaaacctatgtggactntcgtagaagggccgattccaccatctccaganacaacgccaaagacctctctgttctgcaaatggacagcctagagagtacgaagacgcgctgtagtattacgtgtgtgtctcgtgacgtccctcggcccggtacttcgggcttcggg

SEQ ID NO: 136475 - DNA, 667 bp, Homo sapiens
  misc_feature: GYAE6OF02HWGHA.47.48.E04.1.454.CMB.1.raw
tcagagctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctcctgtctgcatctgtaggagacagagtcaccatcacttgccgggcagtcaggggtcttgcaaactgctttggcctggtttcagcagacaccagggaacggcccctaagcggcctgatctatggtgcatacactttgcaaaagtcggggtacccatacgaaggttcaggcggtacagtaaggtctggggacgaggtacgtttcacttcgtacaccttaagtaccaggcgggtaccttcggaccacggtcccgttaggtaaacggtaacgtttccttagggaccttaaaccttttaaacgtttaccgttggttacccttaccctaaggtttaacttaggtacgttaaccggtacccgtttaaccccggttacggggtaccctttttacggggacccgtaaacggggtacccaaaggggttaccggaaaacgtttacccaaaacgggttaccgtacggtaccgggtacccgtttacggacccgtaccgttaacg

SEQ ID NO: 136476 - DNA, 557 bp, Homo sapiens
  misc_feature: GYAE6OF02JKKP1.47.48.E04.1.454.CMB.1.raw
  modified_base (191)..(191): a, c, t, g, unknown or other
  misc_feature (191)..(191): n is a, c, g, or t
  modified_base (198)..(198): a, c, t, g, unknown or other
  misc_feature (198)..(198): n is a, c, g, or t
  modified_base (223)..(223): a, c, t, g, unknown or other
  misc_feature (223)..(223): n is a, c, g, or t
  modified_base (236)..(236): a, c, t, g, unknown or other
  misc_feature (236)..(236): n is a, c, g, or t
tcagagctcacgtacacgaccggtgctcgatttagagagcgtcacagagagaaggggaggaatcagtcccactcaggacacagcatggacatgagggtccccgctcagctcctggggctcctgctgctctggttcccaggtgccaggtgtgacatccagatgacccagtctccatcctcctgtctgcatcngtagganacacagtccacatcacttgccgggnagtcagggtcgtncaatgcttggctggttcagtcagacacgagggacgaccctaagccgcctgactctagtcggtagcagtacactttgactaaagtcgggtacccattacaaggttcagcggctagtaggtctgggacaggtagtcacgtctacactatcacgcgtctagcagcctgaacgtcgttgacttttatcgtgtcgtataccgagtcgtggtacttcgtcggtcctcgtccgtctaccggtttcgggaccgggtcgggtaaccgtacggggtacgtaacggtgttacccggaaaacggttaccgtacgggttcggtaccgtaacggg

SEQ ID NO: 136477 - DNA, 564 bp, Homo sapiens
  misc_feature: GYAE6OF02FMFGE.47.48.E04.1.454.CMB.1.raw
  modified_base (304)..(304): a, c, t, g, unknown or other
  misc_feature (304)..(304): n is a, c, g, or t
  modified_base (399)..(399): a, c, t, g, unknown or other
  misc_feature (399)..(399): n is a, c, g, or t
  modified_base (410)..(410): a, c, t, g, unknown or other
  misc_feature (410)..(410): n is a, c, g, or t
tcagagctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcgagggcgttgcaaatgctttggcctggtttcagcagacaccgagggaacggcccctaagcgcctgactctagtggtncatacactttgacaaaggtcggggtcccatcgaaggttcaggcggcaggtaggtcgtgggacagtacgttcactctcactatcgagcggctcgcncgcctgaacgnttcgtgactaacgttacttactcgttactcctagttatgtatcgtaccttacccgtcgttacgtttaccggaccgtaacgggaacgtaacgggtaacggtaaacgtaaccgaaaccggtaacgttcggtacggtcgtacggtacctaacctacg

SEQ ID NO: 136478 - DNA, 558 bp, Homo sapiens
  misc_feature: GYAE6OF02FUULC.47.48.E04.1.454.CMB.1.raw
tcagagctcacgtacacgaccggtgctcgatttagagagcgtcacagagagaaggggaggaatcagtcccactcaggacacagcatggacatgagggtccccgctcagctcctggggctcctgctgctctggttcccaggtgccaggtgtgacatccagatgacccagtctccatcctccctgtctgcatctgtaggagacacagtcaccatcacttgccgggcgagtcagggcgttgcaaatgctttggcctggtttcagcagacacgagggaaggcccctaagcgcctgatctatggtgcatacactttagcaaagtcggggtcccagtacaaggttcagcggcaggtaggtcgttaggggacaggacgttcacgtctacactactcgagcgcctgcacgcctagaagtacgtttggtactttattacttgtacagtcacgtcgtgtagttctcggtccctcgtcctacgtccgtttccgggcgggtacgggacccggtaggggttacggaacggtacgtaccggaaaaccgtacggtacggttacggcgtaccgg

SEQ ID NO: 136479 - DNA, 556 bp, Homo sapiens
  misc_feature: GYAE6OF02HG7VV.47.48.E04.1.454.CMB.1.raw
  modified_base (479)..(479): a, c, t, g, unknown or other
  misc_feature (479)..(479): n is a, c, g, or t
  modified_base (494)..(494): a, c, t, g, unknown or other
  misc_feature (494)..(494): n is a, c, g, or t
tcagagctcacgtacacgaccggtgctcgatttagagagcgtcacagagagaaggggaggtctcagagaggagccttagccctggactccaaggcctttccacttggtgatcagcactgagcacagaggactcaccatggaattggggctgagctgggttttccttgttgctatttagaaggtgtccagtgtgaggtgcaattggtgcaatctgggggaggcttggtccagccgtgggggggtcccctcagactctcctgtgcagcctctggattccacctttagttcccttcttggatgaagttcgggtcccgccagacctccgaggggaaggggctggagtgggttggcaacataaatccagagtaggaagtacaagaaaacctatagtggtactcgtctggaaggggccgatttcaacctactctccgagacgaccaacgacccaagtaacctctcttcgttctgacaatcggacngactgagagtacganacgacgctgtgtactgtgtggtcgtctcgtgaccgccgttccgggccgtaccgttgtcccgg

SEQ ID NO: 136480 - DNA, 596 bp, Homo sapiens
  misc_feature: GYAE6OF02HL0PZ.47.48.E04.1.454.CMB.1.raw
tcagagctcacgtacacgaccggtgctcgatttagagagcgtcacagagagaaggggaggaatcagtcccactcaggacacagcatggacatgagggtccccgctcagctcctggggctcctgctgctctggttcccaggtgccaggtgtgacatccagatgacccagtctccatcctccctgtcctgcatctgtaggagacagagtcaccatcacttgccgggcgagtccgaggggcgttgacaaatgtcttggcctggtttcagcagacacagggaacgccctaagccgcctgactctagtggtgcatacactttgactaaaggtcgggtacccatcgaaggttcagcggcagtagtctgggacagagttcactctcatatcgagcggcctcgacgaagcccttaaggaactagttccgtagacctaaactttattaaaccgttgttaccgttccgtaaacgttgttacgactcggtaaccctttaacccgttcggttaccttttccgggaccgtaacgggtaaaccgtaggtaacgggttaaactaacgaaaccggtaacgttcggtaccgggtctccgggtaactaaccccg

SEQ ID NO: 136481 - DNA, 607 bp, Homo sapiens
  misc_feature: GYAE6OF02F0K2A.47.48.E04.1.454.CMB.1.raw
  modified_base (266)..(266): a, c, t, g, unknown or other
  misc_feature (266)..(266): n is a, c, g, or t
  modified_base (372)..(372): a, c, t, g, unknown or other
  misc_feature (372)..(372): n is a, c, g, or t
  modified_base (460)..(460): a, c, t, g, unknown or other
  misc_feature (460)..(460): n is a, c, g, or t
tcagagctcacgtacacgaccggtgctcgatttagagagcgtcacagagagaaggggaggtctcagagaggagccttagccctggactccaaggcctttccacttggtgatcagcactgagcacagaggactcaccatggaattggggctgagctgggttttcctgttgctatttagaaggtgtccagtgtgaggtgcaattggtgcaatctgggggaggcttggtccagccgtggggggtccctcagactctcctgtgcagcctntggattcacctttagttcctcttggatgaattgggccgtccagactccgagggaagggctggagtgggttgcaacataaactccagatggaagtcaagaaaacctntgtaggactctctggaacggaccgtactcaccactctaccacgacgaccaaccgaccaacgaacctactacttcgttctgacgtaaanacggttttacacgaccgtaggagacgtaccgaaacgaacgaccggtacgtcgtagttacgtttaacgttagttacggttcgttaccgttccgttacggacccggtacccggtcccgggtccccgggttacccgtttcggttacccgg

SEQ ID NO: 136482 - DNA, 743 bp, Homo sapiens
  misc_feature: GYAE6OF02IS07P.47.48.E04.1.454.CMB.1.raw
tcagagctcacgtacacgaccggtgctcgatttagagagcgtcacagagagaaggggaggtctcagagaggagccttagccctggactccaaggcctttccacttggtgatcagcactgagcacagaggactcaccatggaattgggctgagctgggtttcttgttgctatttagaggtgtccagtgtgaggtgcaattggtgcaatcgtgggggaggcttgggtccagccgtggggggtccctcgagactctccgtgtgcacgcctcgtggacttcctacctttacgttcctcgttggtatagtaagttcgggtccgacctagactccgaaggggaagggtcctagggaggttggggttcggacgaaactaagtaaactccgaaggtagtaggaacgttacgaaagtaaaaaccgttgtacggtacggtacgtcctacgtaggtaacggggcctacttacgaacccgaagtttaccctaccgaaggaacaaaccgaaaccgtacaaaacggacctttaccttccgttacggttttaccaggtaaccgtaaaaacgtcgggtaaaccaacgttacccgtaggtaacgtacggtaccgtaaacgaaaccggtaccggtacgtacgggtttacgtttaaacgttacggttacggttacgggttaacgtcccggtttacgttaccggtaccccggtacccccgttacccgggggtaaccccggttcccggttttggttccccgggg

SEQ ID NO: 136483 - DNA, 562 bp, Homo sapiens
  misc_feature: GYAE6OF02HA6SZ.47.48.E04.1.454.CMB.1.raw
  modified_base (440)..(440): a, c, t, g, unknown or other
  misc_feature (440)..(440): n is a, c, g, or t
tcagagctcacgtacacgaccggtgctcgatttagagagcgtcacagagagaaggggaggtctcagagaggagccttagccctggactccaaggcctttccacttggtgatcagcactgagcacagaggactcaccatggaattggggctgagctgggttttccttgttgctattttagaaggtgtccagtgtgaggtgcaattggtgcaatctgggggaggcttggtccagcctggggggtccctcagactctcctgtgcagcctctggattcacctttattcctcttggatgaattgggtccgccagactccagggaaggggctggagtgggttggcaacataaatccagatggaagtcaagaaaacctatgtaggacctctctagaaggggcctattcaaccatctcagagacaacgaccaagaactctctgtttcngacaaatggacagcctagagcggtacgaaacgacacggctagtgttaacgttacgtaggttgtacgttccgtcgttacggaccgtcccttccggggaccccggtaccgttcgggttacccgg

SEQ ID NO: 136484 - DNA, 573 bp, Homo sapiens
  misc_feature: GYAE6OF02HFXPA.47.48.E04.1.454.CMB.1.raw
  modified_base (424)..(424): a, c, t, g, unknown or other
  misc_feature (424)..(424): n is a, c, g, or t
tcagagctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatccctccctgtctgcatctgtaggagacagagtcaccatcacttgccgggcagtcagggcgttgcaaatgctttggcctggtttcagcagacaccgagggaacggcccctaagccgcctgatctatggtgcatactactttgacgaaacggtggggtcccatacgaaggttcaggcggcaggtaggtcgtgggacaggagttcgactcttcactatcgaagccggccttcggcacgcctagaagtacgttcncgtactaactttattacttcgtacctacctagttatagtactcgtaccttacccgtcggttaccttaccgggtaccgtaacgggaaccgtaagggtacgaaaacgttccgaaacgtaacgtggtacggcttacggaccctacgtaaccg

SEQ ID NO: 136485 - DNA, 567 bp, Homo sapiens
  misc_feature: GYAE6OF02HKUZK.47.48.E04.1.454.CMB.1.raw
tcagagctcacgtacacgaccggtgctcgatttagagagcgtcacagagagaaggggaggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcagggcgttgcaaatgctttggcctggtttcagtcagacaccagggaaggcccctagcgcctcgatcctatggtgcatacactttgcaaagtgggtcccagtcaaggttcagcggcaggtaggtctgggacagtacgttacactctcacgtatcgagcgccttggcctagccttgaagtacttctgtaccaactttattacgttctacctcctagttacttgtacgttcgaccgtttacccttcgggtactttccgggaccgttaacggggaacccgtaagggtaacggtaaacgtacctaaaccggtacgtacggttcgggaccgttgacgtaacccg

SEQ ID NO: 136486 - DNA, 679 bp, Homo sapiens
  misc_feature: GYAE6OF02JBV6M.47.48.E04.1.454.CMB.1.raw
  modified_base (225)..(225): a, c, t, g, unknown or other
  misc_feature (225)..(225): n is a, c, g, or t
tcagagctcacgtacacgaccggtgctcgatttagagagcgtcacagagagaaggggaggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgcccgggngagtcagggcgttgcaatgcttggcctggtttcagcagacacgagggaacgccctaagcgcctgacttctatggtcgcattactacttttcgacgaaaggttcggggtcccaagtcgtaaaggttcaaggcggtacgaggtacgggttcgtgggaacgtagtacgttacctactacctacgaacttaacgtccgaaggtccgggccttacggcaccgtaccgttaggtaaagtactttccgaacgttacctaacgtttaattccgtttacggttccctttaaccgtacggttaacgtttggtaacctttcggtaaccccgtttaccccggtaccggttaccgtttccgggtaaccccgtaaacgggggtaacccgtaaaggggtaacggtaaaacgttacccgtaaaaacggaccggtttaggttacccgggacttaccgggacccttaacccg

SEQ ID NO: 136487 - DNA, 572 bp, Homo sapiens
  misc_feature: GYAE6OF02FQVY2.47.48.E04.1.454.CMB.1.raw
  modified_base (439)..(439): a, c, t, g, unknown or other
  misc_feature (439)..(439): n is a, c, g, or t
tcagagctcacgtacacgaccggtgctcgatttagagagcgtcacagagagaaggggctcagagaggagccttagccctggactccaaggcctttccacttggtgatcagcactgagcacagaggactcaccatggaattggggctgagctgggttttccttgttgctattttagaaggtgtccagtgtgaggtgcaattggtgcaatctgggggaggcttggtccagcctggggggtccctcagactctcctgtgcagcctctggattcacctttagttcctcttggatgaattgggtccgccagactccgaggggaagggctgggagtgggttggcaacataaaatccaagatggaagtcaagaaaacctatgtgactctctggaagggccgattcaccatcctccagagacaacgccaaagaacctctctgtttcngacaaatggacaggcctgagacgtcgaaagacacgggctaggtacgttattacgttggtagttcgttaccttcgttagggaccgtccccgttccggggaccccggtacccgttttcggggccctttcccgggg

SEQ ID NO: 136488 - DNA, 527 bp, Homo sapiens
  misc_feature: GYAE6OF02HCVGO.47.48.E04.1.454.CMB.1.raw
  modified_base (355)..(355): a, c, t, g, unknown or other
  misc_feature (355)..(355): n is a, c, g, or t
  modified_base (390)..(390): a, c, t, g, unknown or other
  misc_feature (390)..(390): n is a, c, g, or t
  modified_base (394)..(394): a, c, t, g, unknown or other
  misc_feature (394)..(394): n is a, c, g, or t
tcagagctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcagggcttgcaaatgctttggccttggtttcagcagacaccagggaacggcccctaagcgcctgactctatggtgcatacactttgcaaaggtgggtccatcaaggttcagcgcagtagtctggacagngttcactctcactatcagcgctgcagcctagaagnttcngactaacttattactgtctctagtatgtatcgtcttacccgtcggtacctttcggaccgtaacgggacctaagggttacggaaactaccgaaaacggtaacgttggtacggtccgtacggacctaaccgtacg

SEQ ID NO: 136489 - DNA, 561 bp, Homo sapiens
  misc_feature: GYAE6OF02I4N45.47.48.E04.1.454.CMB.1.raw
  modified_base (293)..(293): a, c, t, g, unknown or other
  misc_feature (293)..(293): n is a, c, g, or t
  modified_base (355)..(355): a, c, t, g, unknown or other
  misc_feature (355)..(355): n is a, c, g, or t
  modified_base (371)..(371): a, c, t, g, unknown or other
  misc_feature (371)..(371): n is a, c, g, or t
  modified_base (382)..(382): a, c, t, g, unknown or other
  misc_feature (382)..(382): n is a, c, g, or t
  modified_base (398)..(398): a, c, t, g, unknown or other
  misc_feature (398)..(398): n is a, c, g, or t
tcagagctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcagtcagggcttgcaatgcttggcctggttcagcagacacagggaacggccctaagcgcctgatctatggtncatacactttgacgtaaagtcggggtcccatcgaaggttcagcgcgagtagtcgtggacagngttcactctactactntcacgcgtccngcacgccgtagaagtnttcgtagtctaacttattacgttcgtctaccgtagtatgtactcgtccttacccgtcgtaccgtttacggacccgtaacgggacctaaagggtacggtaaaacgttacccgaaaacggttaaccgttacgggttacggaccgttcggaccgtaccgttaaccg

SEQ ID NO: 136490 - DNA, 610 bp, Homo sapiens
  misc_feature: GYAE6OF02FUQOG.47.48.E04.1.454.CMB.1.raw
  modified_base (199)..(199): a, c, t, g, unknown or other
  misc_feature (199)..(199): n is a, c, g, or t
tcagagctcacgtacacgaccggtgctcgatttagagagcgtcacagagagaaggggaggaatcagtcccactcaggacacagcatggacatgagggtccccgctcagctcctggggctcctgctgctctggttcccaggtgccaggtgtgacatccagatgacccagtctccatcctccctgtctgcatctgtagganacagagtcaccatcacgttgccgggcgagtcgagggtcgttgcaaatgtctttggccttggtttcagcagacacgaggacggcccctaagccgcctgactctagtggtcgctatcctagtttcgctagtacggttcgggtcctagttcgttaggttcgaggtggacgtaggtggagtcgtagggactagtactttccacttctccacctatccgacgtctacgtcgtacgacctaaccgtgtaacgtcgtttacgacttaacttactacgttcgtacgtaactacgttaaccgttaacccgttacccgtaacgtttaccgtttacggacccggtaacgggtaccctaacggtacgtaactacgtaaccgtaaaccgtacgttcggtaccggtactacggtaccacgttacg

SEQ ID NO: 136491 - DNA, 553 bp, Homo sapiens
  misc_feature: GYAE6OF02IFGJV.47.48.E04.1.454.CMB.1.raw
  modified_base (454)..(454): a, c, t, g, unknown or other
  misc_feature (454)..(454): n is a, c, g, or t
  modified_base (469)..(469): a, c, t, g, unknown or other
  misc_feature (469)..(469): n is a, c, g, or t
  modified_base (483)..(483): a, c, t, g, unknown or other
  misc_feature (483)..(483): n is a, c, g, or t
  modified_base (488)..(488): a, c, t, g, unknown or other
  misc_feature (488)..(488): n is a, c, g, or t
tcagagctcacgtacacgaccggtgctcgatttagagagcgtcacagagagaagggggccttagccctggactccaaggcctttccacttggtgatcagcactgagcacagaggactcaccatggaattggggctgagctgggttttccttgttgctattttagaaggtgtccagtgtgaggtgcaattggtgcaatctgggggaggcttggtccagcctggggggtccctcagactctcctgtgcagcctctggattccaccttttagttcctcttggatgaattgggtccgccagactccgaggggaaggggcgtggagtgggttgcaacataaatccagatggaagtcaagaaaaccctatgtaggactctctaggaacgggccattcacatctccagacgacaaacgccaaagacttcctattcgttctgactaaagtgacagcctgagngtacgaagacacggntgtagtacttacgngtgtntctgtacgcgtcctcgggcccgtacgttggccttcggtcgggcccgtcggacccgtggtaccccg

SEQ ID NO: 136492 - DNA, 644 bp, Homo sapiens
  misc_feature: GYAE6OF02IMMLJ.47.48.E04.1.454.CMB.1.raw
tcagagctcacgtacacgaccggtgctcgatttagagagcgtcacagagagaagggggaatcagtcccactcaggacacagcatggacatgagggtccccgctcagctcctggggctcctgctgctctggttccaggtgccaggtgtgacatccagatcgacccagtctccatccctccctgtctgctatctggtaggagaccagagtccaaccatccacgttcggccgggacgagtcgaggggtcttgacaaagtcgtctttggccttggtttcacgcagacacgagggaacgccctaagcgcctgactcgtaactggtcgactaatacgtacgtttcgacgtaaacggtcggggtaccctaagtaccgtaaagggttcacggtacggcgtaaggttaggtcgtaggggacctaggacgttacgacttaccgtctaacgtaatccgaggccggtcctgacctaggacccgtagtaacgttacttcgtacgtaaccgtaaactttacgtttacttaggttccttcccgtaagttaatcgtagttcgtaccttaccgtacgttaccgttcgtaccgaagggtaacctacggggtaagtaaccgtaacgaaacggtaccttaggtcgggaacttcgacctactacg

SEQ ID NO: 136493 - DNA, 848 bp, Homo sapiens
  misc_feature: GYAE6OF02J3NOE.47.48.E04.1.454.CMB.1.raw
tcagagctcacgtacacgaccggtgctcgatttagagagcgtcacagagagaaggggaggaatcagtcccactcaggacacagcatggacatggacgggtccccgctcacgtcctccgtgggctcctgctcgctcgtcggtcccgaggtcgaccgtaggtgtacgactactaccgaagtacgtaccgtacccgtacgtccctacctaccttccccgtccgttcgtccgtactacgtacgttacgtaggacggacgaaccgtacgtacctacctacctacgtaccggtaccggtccgggtaccgggtacgtacggtacggtacggtacgttaaccgaacttacggttccggttcggttccgtcgttaccggacgacgaccggaaccgaccggtaaccggtaaccgggtaccctaccgtacgtaccgtacgtaggtaccgtacggtaggtactaccgttagtaaccgttacggtaccgggtaacgtaaccgggttaccgtaccgtaacgtaaggtccggtacggtacgacggtacggtacgggtacggtaccggtaacgtaccgtacgtacctaccgtaccgtacgtaccgtaacccgtcggtaacccgtaccggtaccgtaccgtacggtacgtacgtaaccgtaggtaacttaccgtacgttaaccttaagttacctaaccggttacgtaccgtacggttacgtaacgtacgttaccgttacccgtacccgttaccgtaccgggtacccgtaagggttacccgaacgggtaaccggtaaaccgtggtaaaaccctacggttaaccgacggttacggcgtaaccgtcacccgttacggtacttacccgg

SEQ ID NO: 136494 - DNA, 524 bp, Homo sapiens
  misc_feature: GYAE6OF02GKA74.47.48.E04.1.454.CMB.1.raw
  modified_base (387)..(387): a, c, t, g, unknown or other
  misc_feature (387)..(387): n is a, c, g, or t
  modified_base (403)..(403): a, c, t, g, unknown or other
  misc_feature (403)..(403): n is a, c, g, or t
  modified_base (431)..(431): a, c, t, g, unknown or other
  misc_feature (431)..(431): n is a, c, g, or t
tcagagctcacgtacacgaccggtgctcgatttagagagcgtcacagagagaaggggaggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcagggcgttgcaaatgctttggcctggtttcagcagacaccgagggaacggcccctaagcgcctgatctatggtgcatacactttgcaaagtgggtcccatcaaggttcagcggcagtaggtcgtgggacagtagttcactctcactatcagcgctgcngccttgaacgattcgngactaacttattactgtctctagtatgntgtccttacctcggtacctttcggaccgaacgggtacctaagggtacggtaaactacgaaacggtacgtcggtacggtactcggacctaaccg

SEQ ID NO: 136495 - DNA, 562 bp, Homo sapiens
  misc_feature: GYAE6OF02IZYEI.47.48.E04.1.454.CMB.1.raw
tcagagctcacgtacacgaccggtgctcgatttagagagcgtcacagagagaaggggaggaatcagtcccactcaggacacagcatggacatgagggtccccgctcagctcctggggctcctgctgctctggttcccaggtgccaggtgtgacatccagatgacccagtctccatcctcctgtctgcatctgtaggagacagagtcaccatcacttgccgggcagtcagggcgttgcaaatgctttggcctggtttcagcagacaccgagggaacggcccctaagcgcctgatctatggtgcatactactttgactaagtcgggtcccagtacaaggttcagcggcaggtagtcgtgggactagagttcactctacactatcgagcggtcctgcacgcctagaagtacttcgacgactaacttacttactcgttctacctagttacgtagtacgttcgtaccttacccgtaccggtaccgtttaccgggaccgtaacgggtaaccgtaagggtacggtaaacgtacgaaacggtactaggtacggtactacggactaacccg

SEQ ID NO: 136496 - DNA, 588 bp, Homo sapiens
  misc_feature: GYAE6OF02GQ9VS.47.48.E04.1.454.CMB.1.raw
tcagagctcacgtacacgaccggtgctcgatttagagagcgtcacagagagaaggggaggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcagggctttgcaaatgctttggcctggtttcagcagacaccagggaaggcccctaagcgcctgatctatggtgcatacactttgacaaaggtcgggtcccatcaaggttcagcggcagtaggtctgggacagagttcactctcactatcgagcggcctgcacgccgtagaagtactttacgtgtacctaactttacttaccgttcgttacctacctagttagtgtaacttcgttccctttaaccccgttccgggtaccttttcccgggacccgtaaacggggaacccgtaaaggggttaacggtaaaaccttaccgaaaaccggtacgttacggtacgggaccttacggaccctaacccg

SEQ ID NO: 136497 - DNA, 535 bp, Homo sapiens
  misc_feature: GYAE6OF02HIWRC.47.48.E04.1.454.CMB.1.raw
  modified_base (410)..(410): a, c, t, g, unknown or other
  misc_feature (410)..(410): n is a, c, g, or t
tcagagctcacgtacacgaccggtgctcgatttagagagcgtcacagagagaaggggctcagagaggagccttagccctggactccaaggcctttccacttggtgatcagcactgagcacagaggactcaccatggaattggggctgagctgggttttccttgttgctattttagaaggtgtccagtgtgaggtgcaattggtgcaatctggggggaggcttggtccagcctgggggggtccctcagactctcctgtgcagcctctggattcacctttagttcctcttggatgaagttgggtccgccagactccaggggagggctggagtgggtggcaacataaatccagataggaagtcaagaaaacctatggtaggactctcgtgagggccgattcacatctccaganacaacgccaagaactctctgtttctgacaatggacagacctgagagtacgaaagacacgggctagtgttattacgtggtgttgtactctcggacgcccgtccggccggtaccttggtccttcggg

SEQ ID NO: 136498 - DNA, 774 bp, Homo sapiens
  misc_feature: GYAE6OF02IXF6X.47.48.E04.1.454.CMB.1.raw
tcagagctcacgtacacgaccggtgctcgatttagagagcgtcacagagagaaggggaggaatcagtcccactcaggacacagcatggacatgagggtccccgctcagctcctggggctcctgctgctctggttcccaggtgccaggtgtgacatccagatgacccagtctccatcctcctgtctgcatctgtagagacagagtcacatcacttggccgggcgagtcgagggtcgttgcaaatgtctttggccttggttcagcagacacgagggacggcccctaaggccgcctagactcgtagttcggtgactactactacttttaggacgtaaaagggttcggggttacccctaagttacggtaaacggtttccgaacggtccgggacgtaaggttaacgggttcgtacggggaacctaagggtacgtttaccaacctttcctaccgtaaccttagttacccgaaggcccgggtaccgttacggaccgtaccggtacccgttaagggaaaccggtttacgtttaccgttaacggtaccttaaaacctttttaacgttaacccgtttacggttacccttaacccgtaaggttttaacgttacggttaacctttccgggttaaccccttttacccggttacccgggtttaccgttttaccccgggaacccgtaaacccgggggtaacccgtaaaggggttaacggtaaaacctaccggttaaaaaccggtaccggtttacgggttaccgggtaccgttaccggaccttaaccccg

SEQ ID NO: 136499 - DNA, 543 bp, Homo sapiens
  misc_feature: GYAE6OF02GITQK.47.48.E04.1.454.CMB.1.raw
  modified_base (408)..(408): a, c, t, g, unknown or other
  misc_feature (408)..(408): n is a, c, g, or t
  modified_base (431)..(431): a, c, t, g, unknown or other
  misc_feature (431)..(431): n is a, c, g, or t
  modified_base (438)..(438): a, c, t, g, unknown or other
  misc_feature (438)..(438): n is a, c, g, or t
  modified_base (453)..(453): a, c, t, g, unknown or other
  misc_feature (453)..(453): n is a, c, g, or t
tcagagctcacgtacacgaccggtgctcgatttagagagcgtcacagagagaaggggaggtctcagagaggagccttagccctggactccaaggcctttccacttggtgatcagcactgagcacagaggactcaccatggaattggggctgagctgggttttccttgttgctattttagaaggtgtccagtgtgaggtgcaattggtgcaatctgggggaggcttggtccagcctggggggtccctcagactctcctgtgcagcctctggattcacctttagttcctcttggatgaattgggtccgccagactccagggaaggggctggagtgggttggcaacataaatccagatggaagtcaagaaaacctatgtggactctctgaaggccgatcaccatctcaganacaacgccaagactctctgttcngactaancggacagcctgacgngtacgaacgcgacggctaggttcgtattcgtaggttgttcgttccttcgtcggaccgtcccgtaccgggcccggtacgttcggttcccgg

SEQ ID NO: 136500 - DNA, 491 bp, Homo sapiens
  misc_feature: GYAE6OF02G9ITH.47.48.E04.1.454.CMB.1.raw
tcagagctcacgtacacgaccggtgctcgatttagagagcgtcacagagagaaggggaggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcagggcgttgcaaatgctttggcctggttcagcagacaccagggaaggcccctaagcgcctgatctatggtgcatacactttgcaaagtgggtcccatcaaggttcagcggcagtaggtctgggacagagttcactctcactatcagcgctgcagcctgaagtattctgactaacttattactgtctcagtatgatcgcttacctcggtacttcggaccgaagggaccaaggtacgaatacgaacgtactgtagctgctaccg

SEQ ID NO: 136501 - DNA, 635 bp, Homo sapiens
  misc_feature: GYAE6OF02IMY5E.47.48.E04.1.454.CMB.1.raw
  modified_base (312)..(312): a, c, t, g, unknown or other
  misc_feature (312)..(312): n is a, c, g, or t
  modified_base (385)..(385): a, c, t, g, unknown or other
  misc_feature (385)..(385): n is a, c, g, or t
tcagagctcacgtacacgaccggtgctcgatttagagagcgtcacagagagaaggggaggtctcagagaggagccttagccctggactccaaggcctttccacttggtgatcagcactgagcacagaggactcaccatggaattggggctgagctgggttttccttgttgctattttagaaggtgtccagtgtgaggtgcaattggtgcaatctgggggaggcttggtccaggccgtggggggtccctcgagacctctcctgtgcagcctcgtggattcactttacgttcctcttggatgtaagttggtccncctagactccgagggagggctggagtgggttgacaactaagtaaatccaagagtggaagtcaaacgaaaactntaggtagactctagtacggaagggtccgtattaccgaaccgtaactctacccgaaggtacgaacctaaacgacccaaagaaccgttctccgttgtttacctagactaaaagtggtaacacgcccgttaggacgtaagtacggtaaacgaacgacggtccgttacgttagtaacgtttacgtagttggttacgttacgtccgttaggacccgtacccgttccggggtacccgtcccggtttacggttcccg

SEQ ID NO: 136502 - DNA, 680 bp, Homo sapiens
  misc_feature: GYAE6OF02JM7IP.47.48.E04.1.454.CMB.1.raw
  modified_base (284)..(284): a, c, t, g, unknown or other
  misc_feature (284)..(284): n is a, c, g, or t
  modified_base (365)..(365): a, c, t, g, unknown or other
  misc_feature (365)..(365): n is a, c, g, or t
  modified_base (376)..(376): a, c, t, g, unknown or other
  misc_feature (376)..(376): n is a, c, g, or t
  modified_base (401)..(401): a, c, t, g, unknown or other
  misc_feature (401)..(401): n is a, c, g, or t
tcagagctcacgtacacgaccggtgctcgatttagagagcgtcacagagagaaggggaggtctcagagaggagccttagccctggactccaaggcctttccacttggtgatcagcactgagcacagaggactcaccatggaattggggctgagctgggttttccttgttgctatttagaagtgtcagtgtgaggtgcaattggtgcaatcgtggggggaggtcttggtccgagtccgtcggggggttccctcgagtactctcctgtgcagtcctctggacttcnccttttagttccttcgttggatggtaacgttgggtcccgccgtagactccgaagggaagggcgtggtagtgggttgacaanataaagtccanaacgtggtaagtctaaagaaacttntaggtacggtactcgtagttacggaacggggtaccgtaattcccaaccgtatacccttacccgaagacggtaaccaaaccgacctaaaggtaaccttcgttacccttgtttaccacgacgaaagttcggaacttcggtaccaagtacggaacgttaccggaaacgtaacgaccgttccggttagttaacgttaggttaacctgggtttacgtgtttaaccctggttaaccgaccggttcccgggtacgggaccccgggtttacgttaccgggttcccgg

SEQ ID NO: 136503 - DNA, 540 bp, Homo sapiens
  misc_feature: GYAE6OF02GJ5L2.47.48.E04.1.454.CMB.1.raw
tcagagctcacgtacacgaccggtgctcgatttagagagcgtcacagagagaaggggctcagagaggagccttagccctggactccaaggcctttccacttggtgatcagcactgagcacagaggactcaccatggaattggggctgagctgggttttccttgttgctattttagaaggtgtccagtgtgaggtgcaattggtgcaatctggggggaggcttggtccagccgtgggggggtccctcgagactctcctgtgcagcctctggatttcaccttttagttccctcttggatgaatttggggtccgccagacctccgaggggaaggggctggagtgggttggcaacataaatccagatggaagtcaagaaaacctatgtaggactctcgtgaagggccattcaccatctcagagacaacgccaagactctctgttctgcaatcggacagcctgagtagtcgaagacacgctgtagtatacgtgtgtacgtcttcgtggaccgtccgtcggtacccggtccgtttggcctttcggg

SEQ ID NO: 136504 - DNA, 582 bp, Homo sapiens
  misc_feature: GYAE6OF02HU6JX.47.48.E04.1.454.CMB.1.raw
tcagagctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcagggcgttgcaaatgctttggccttggtttcagcagacaccagggaacggcccctaagcgccctgatctaatgggtgcatacctacttttagacgtaaaacggtcggggtaccctagtacgtaaagggttccgaaggtcggctaaggtacgggtcgtcggggaactaggtaagttcctacgtctacaactatcgaaggccggtccgtgaccacggcctaggtaacgtactttcgtagacctaactttacttacgtgttacctctagtatgatcgtcttacccgtcgtacttcggaccgtaacgggacctaaggtacggaaataccgaaacgtactcggtggtactacgcactacg

SEQ ID NO: 136505 - DNA, 879 bp, Homo sapiens
  misc_feature: GYAE6OF02H35GM.47.48.E04.1.454.CMB.1.raw
tcagagctcacgtacacgaccggtgctcgatttagagagcgtcacagagagaaggggctcagagaggagccttagccctggactccaaggcctttccacttggtgatcagcactgagcacagaggactcaccatggaattggggctgagctgggttttccttgttgctattttagaaggtgtccagtgtgaggtgcaattggtgcaatcgtgggggaggcttggtccagccgtggggggtccctcagactctcctgtgcagcctctggtacttcctaccttttacgttccttctttggattagaagtttcggggtcccgccgagaccgtccggaagggggaacgggggtccgttaggggtagggttcggggggtttcgggaccgtaaaaccgtaaagttaaaaacgtcccgtaaaggtaagttacggggtaaaggttaccgaaaacggtaaaaaacccgttagtacgggttacgggtaaccttaccgttacgtacggggtaaacgggggtaccccgtaagtttacccaaacccgtacgttaccccgttacccgaaaggaacgaaacccgaaaaccggaccccgaaaacggttaaaccttccgttaccgtttcgttttaccgttacgaaacgtaaaacgtcgggtaaacccacggtaccctagggaaacggtaacggttaaccggaaaacggtaccggtaaccgggtcgttacggtttacggttaacgttttaccggttaaggttttccgggttacggtttaccgtttcccggttaaccgggtaccccggggtttaccccggtttaccccggggggtaccccccgggggtttaacccccggtttttaccggggggttccccgtttttaaccccggggggg

SEQ ID NO: 136506 - DNA, 560 bp, Homo sapiens
  misc_feature: GYAE6OF02GKJ41.47.48.E04.1.454.CMB.1.raw
  modified_base (404)..(404): a, c, t, g, unknown or other
  misc_feature (404)..(404): n is a, c, g, or t
tcagagctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcgaggggcttgcaaatgctttggcctggtttcagcagacaccgaggaacggcccctaagcgcctgatctatggtgacatactactttgactaaagtcggggtcccatcgaaggttcagcgacagtaggtctgggacagtagttcactctcactatcagcggctgcgacgcctgaagtnttcgtgactaactttattactgttacctcctagttatgtactcgtaccttacccgttccgtacgtttaccggaccgtaacgggtaacctaagggtaacggtaaacgttaccgtaaaaccggtaacgtacggttacggactacggtacctactaacg

SEQ ID NO: 136507 - DNA, 771 bp, Homo sapiens
  misc_feature: GYAE6OF02F9EAL.47.48.E04.1.454.CMB.1.raw
  modified_base (281)..(281): a, c, t, g, unknown or other
  misc_feature (281)..(281): n is a, c, g, or t
  modified_base (348)..(348): a, c, t, g, unknown or other
  misc_feature (348)..(348): n is a, c, g, or t
tcagagctcacgtacacgaccggtgctcgatttagagagcgtcacagagagaaggggaggtctcagagaggagccttagccctggactccaaggcctttccacttggtgatcagcactgagcacagaggactcaccatggaattggggctgagctgggtttccttgttgctattttagaaggtgtccagtgtgaggtgcaattggtgcaatcgtggggggaggcgttgggtccaggccgtgggggggtcccctcgacgactcctcctgtgcagcctctggnttcacctttagttccttcttggatgaagttcgggtccgccagactccgaggggaacggggcgtgggnggtgggttggcaacataaataccagagtggaagtcaagaaactatggtacggactctacgtgaagggtccgtaattccaacctacgtcctaccgaacgtaacgaaacccgaacgacccgaaagtaacctacccgttaccgttcggttttacctaacggtacctaaaaagttcgggaaaccctacggtcccgttaaggggtaaacggtacggttaacccggaaaacgggtaaacccgtaacccgggggttacgtacggggttttaaccggtttaaccggtttttaacgggtttacggtttacggggttttaccggtttacccggttttacccggttaacggttaacccccgggttaccccggggttaccccgggggttacccccccgggtttaacccggtttccggggggtttttccccccggg

SEQ ID NO: 136508 - DNA, 599 bp, Homo sapiens
  misc_feature: GYAE6OF02HXKLJ.47.48.E04.1.454.CMB.1.raw
tcagagctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgaccagtctccatcctcctgtctgcatctgtaggagacagagtcaccatcacttcggccgggcagtcagggtcttgcaaatgtactttggccttggtttcagtcagacaccgacgggaacggtcccctaaggccgccgtgtatctagtcggtgacatacgtacttgacgtaaaggtcgggtaccagtacgtaaggttcacggtcggctagggtacggtcgtagggacgacgtacgttactactcgtactaacgttactcgaggccggtctacgcacggcctagtaacgtattcctagtactaactttacttacgttcgtaccgtacgtagttatacgttatcgtaccttaccgttcgtaaccgttcggaaccgtaccggtaacgtaacggtaacggtaaacttacgaaacgttacggtggtacgtcgtacgtcaacttcg

SEQ ID NO: 136509 - DNA, 640 bp, Homo sapiens
  misc_feature: GYAE6OF02FY8DU.47.48.E04.1.454.CMB.1.raw
  modified_base (224)..(224): a, c, t, g, unknown or other
  misc_feature (224)..(224): n is a, c, g, or t
  modified_base (449)..(449): a, c, t, g, unknown or other
  misc_feature (449)..(449): n is a, c, g, or t
tcagagctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtccaccatcacttggccgggngagtcgagggtcttgcaaatgctttggccttggtttcagcagacaccgagggaacggcccctaagccgcctagactctagtggtgctatactactttgacgtaaaggtcggggtccctaataccgtaaggttcaggcggacaggttaggtcgtagggaactagtacgttcactctacgacctagtccgaggcccggtctcgaccgtacgacccgttaggaacgtnttacgtacgtaccttaaactttacgttacttcgttacccttaccgtaagttacttagtaacgttccgtacccgtttaacccgtaccggttacccgtttaccggaaccggtaaccgggtaaaccgtaagggttaacgtaaaactaccgtaaaaccggtacgttcggtacggtactacggtacctaccgtacg

SEQ ID NO: 136510 - DNA, 677 bp, Homo sapiens
  misc_feature: GYAE6OF02JIM2N.47.48.E04.1.454.CMB.1.raw
  modified_base (226)..(226): a, c, t, g, unknown or other
  misc_feature (226)..(226): n is a, c, g, or t
tcagagctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatcgacccagtctccatccctcctgtctgcatctaggtaggagacagagtcaccatcacttggccgggngaggtccgagggtcgttcgacaaagttgtctttcgggccttggtttcagcgacgaccaccgaacggggaacgccccgtaagccgtaccgtgtactacgtagttcgggtcactaatactactttggacgtaaacggtcgggtccctagtacgtaaggttccaggccggtagacggtacggtcgtagggacgtaggtacgtcactctactactagtacgcggcggtctcgaccgagtcccgttaaggaacttctttacgacggtaaccttaaacttttagttacgtccggttccttaccggtattacgttacggtactttaccggttaccctttacccgtccgggtacccttacgggtaaccggaaccgggttaacgtaaacgggtaacggtaaactaaccggtaaacgtaccggttacggtccggtacgttaccgtaccgtaacccgttacg

SEQ ID NO: 136511 - DNA, 665 bp, Homo sapiens
  misc_feature: GYAE6OF02GOQJU.47.48.E04.1.454.CMB.1.raw
tcagagctcacgtacacgaccggtgctcgatttagagagcgtcacagagagaaggggaggtctcagagaggagccttagccctggactccaaggcctttccacttggtgatcagcactgagcacagaggactcaccatggaattggggctgagctgggttttccttgttgctatttagaaggtgtccagtgtgaggtgcaggtagtggaggtccgggggaggcttagttcagccgtgggggacgtccctggagactctccgtgtgtagtctctggaatctagtttcagttaccttcgtggatgcacgttcgggtccaccgaaacctccgaagggttaacggggcttgggtgttcggcgtcctacacgttatcaaatcctagacgtggactagttagttaataaagtttatcggtacggtacctccgggtagggtacggggtccgtaatttcgaacggcctagttccctaccgaggaacgaacgaaacggactaaaggagttaacttacgtgtaacttacgtaggtaaacttacgaaaactaattcgtagaagacggtaccgaacgtacgtacggtcgttacgtaactacgttacgtaagttttcggtttacgttttacgtagttccggttcccgtttcggggttacccgggtcgggtttacccgg

SEQ ID NO: 136512 - DNA, 738 bp, Homo sapiens
  misc_feature: GYAE6OF02HANZE.47.48.E04.1.454.CMB.1.raw
  modified_base (199)..(199): a, c, t, g, unknown or other
  misc_feature (199)..(199): n is a, c, g, or t
  modified_base (204)..(204): a, c, t, g, unknown or other
  misc_feature (204)..(204): n is a, c, g, or t
tcagagctcacgtacacgaccggtgctcgatttagagagcgtcacagagagaaggggaatcagtcccactcaggacacagcatggacatgagggtccccgctcagctcctggggctcctgctgctctggttcccaggtgccaggtgtgacatccagatcgacccagtctccactccctccctgtctgcatctgtagganacagngtcaccatcactcggccggcgtagtcgagggtcgttgactaatgtcgtttcggtccgttggtttcacgcgtacgaccgaaccggtaacggggaacccggaccccgttaacggccgtaccgtacgtaacttccgttaaggttcggtacgtacgtacttaccgttacgtttacgaaccgtaaagggttcggggtaccctagtacgtacggttcgacggcgtacgtaggttacgggtacgttacgggaacgtaggtaccgttaccgtacttactactacttacgtacggtacggccggtccgacggtactaccggtacgtagaacgttacgttcgtacgttaaccgttaactttactttcgtacggttcctaccgtagttacgtacgttagttccgttacccgttacccggttaccggttaccggttaccgggaaccggttaacgggaaccggttaaacgggtaacgtaaaccgttaaacccggaaacgttaccggttcggtaccgggttaccgtaccgtaccgttacccgtaccgg

SEQ ID NO: 136513 - DNA, 843 bp, Homo sapiens
  misc_feature: GYAE6OF02GAG0Z.47.48.E04.1.454.CMB.1.raw
tcagagctcacgtacacgaccggtgctcgatttagagagcgtcacagagagaaggggaggaatcagtcccactcaggacacagcatggacatgagggtccccgctcagctcctggggctcctgctgctctggttcccaggtgccaggtgtgacatccagatgacccagtctccatcctcctgtctgcatctgtaggagacagagtccaccatcacttggccgggcgagtcagggtcgttgcaaatgctttggcctggtttcagcagacacagggaacggcccctaagcgcctgatctatggtgcatactactttgaccgtaaaaggttcggggtacccaagttaccgtaaacgggtttccaaacgggtccgggaccgtaaggggttaacgggtccgttaggggggaacctaaagggtaacggttttacctaaccgttccgttacctaaacccgttaagttcccgaacgggtccggggaccccttagggacccgtaacggtccccggttaaggaaaaccggttacgttttaccgttacgtaaccgtttaaaacccgtttttaacgttttaacccgttacgggttttaaccccttacccggttaaaggtttaacgtttacgggttaaacgttacccggtttaccccggttttaaacccccggtttacccggggtttaacccggttttttacccccgggggaaccccggttaaaaccgggggtaaaccccggttaaaagggggttaaaccggggttaaaaaccgttaacccggtaaaaacccgggttaacccggttaacgggttaaccggggtacccgtttacccgggaaccctttaaacccccgg

SEQ ID NO: 136514 - DNA, 674 bp, Homo sapiens
  misc_feature: GYAE6OF02FXSUJ.47.48.E04.1.454.CMB.1.raw
tcagagctcacgtacacgaccggtgctcgatttagagagcgtcacagagagaagggggaatcagtcccactcaggacacagcatggacatgagggtccccgctcagctcctggggctcctgctgctctggttcccaggtgccaggcgtgacatccagatcgacccagtctccatcctccctgtctgcatctgtaggagacagacgtcaccatcacgttggccgggcgagtcgagggtccgttgacaaagtgtcgtttcggccgttggtttacagtcacgaaccgaacccgaaggggaaccggaccccgtaaggccgtccgtgaacttcgtagttggtcgtacaacttaacgtacgttttgaccgtaaagggtcggggtaccctagtacgtaacgggttcgacggcggtacgtacggttacggtcgtagggtaacgtaggtacgttacacgttctactaacgttagtaccgacggccggtccgtacgccgacgtccgttagaacgtacgttcgacgtaccttaactttactacgttcgtaccttacgtagtagtacgtactacgtcccgttaccgtcggttaccgttccggaacggtacggtaacggtaacgggttaacgtaaacgtaacggtaaacgtacggttaggtaccgtacgttacggacctacgtacgg

SEQ ID NO: 136515 - DNA, 828 bp, Homo sapiens
  misc_feature: GYAE6OF02FPT1M.47.48.E04.1.454.CMB.1.raw
  modified_base (198)..(198): a, c, t, g, unknown or other
  misc_feature (198)..(198): n is a, c, g, or t
tcagagctcacgtacacgaccggtgctcgatttagagagcgtcacagagagaaggggaggaatcagtcccactcaggacacagcatggacatgagggtccccgctcagctcctggggctcctgctgctctggttcccaggtgccaggtgtgacatccagatgacccagtctccatcctcctgtctgcatctgtagganacagacgtcaccatcacgttcggccgggcgacggtcgacggggtcgtttgactaaagtgtcgtttaggccttggtttcagcgtaagaccaaccgaggggaaccggccccgtaaaggccgtacccgtggtaactcgttaagtcggggtacgacctaacttaccgttacgttttcggaaccgtaaaacggggtttccgggggtacccctaagttaccggtaaacgggtttcgacgggtaccgggtacgtaaggggttacgggtcggttacgggggaacctacgggtacgtttacccgtacctttaccgtaccgtaacgttaccgtaccggacgggtcccgggtcccgtcggaccgtaccggtacccgttaaggaacgtttaccgttaccgtacggtaacctttaaaccgttttaagtttacccgttacggttacccgttacgtaacgtttacggttacgtaaccgtttacggttacccctttacccgggttacccgggtttacgttaacccgggaacccggttaaaacgggggtcccgtaaaacgggggttaaccgtaaaaccgttaacccggtaaaacggttaccggtttaacggggtacggttacccgtaacggaaccccgttaacccgg

SEQ ID NO: 136516 - DNA, 710 bp, Homo sapiens
  misc_feature: GYAE6OF02F1KHN.47.48.E04.1.454.CMB.1.raw
tcagagctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatcgacccagtcctccatccctccctgtctgcatctggtaggagacagagtcaccatcacttggccgggcgagtcgagggcgttgacaaatgtctttggcctggtttcagcagacaccgagggacgccctaaggcgcctgactctagtggtcgctattactacgtttagacgtaaacggtcggggtacccaagtacgtaaggttcgacggtaccggactaacgggttaggtacgtaggggaacgtaggtaacgtttacacgttcctaacctaccgttaagttccgaacgggtcccggtcccgttacggaccgtacggtcccttaagggtaacgttacgtttacccgtcgttaaaccgttaaaccttttaacgttaccgtttcgttaacccgtttcccgtaaaggtttcctaagggttacttcccggtaacccttttacccggtacggttacccgtttccggaaccggtaacgggtaaccggtaaggtaaccggaaacgttaaccggtaaaacggtacggttacggtacggtcgtaccgtaccgacccgttacg

SEQ ID NO: 136517 - DNA, 670 bp, Homo sapiens
  misc_feature: GYAE6OF02F6X23.47.48.E04.1.454.CMB.1.raw
tcagagctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatccctcctgtctgcatctgtaggagacagagtcaccatcacttggccgggcgagtcgagggtcgttgacaaatgtctttcggccttggtttcagcagacacgagggaacgccctaagccgctgactctagtggtgactatactacgtttagacgtaaaggtcgggtaccctagtacgtaacggttcaggtccggacgaagggttaggtcgtagggactaggtacgtttacactctactactagtcgacggtccggctcgacgacgtcgtaggaacgtacttcgtacgtaacttaactttacgtttaccgttgtaccttaccgtaagttacttaggtaacctttccgttaacccgtttaccccggtcgggttttaacccgttacccgggaacccggtaaaccggggaaccggttaaacgggttaaacgggtaaaccgtaaccgttaaaccggtacggttacggtaccggttaccggtacggtaccctaaccgttaacgg

SEQ ID NO: 136518 - DNA, 727 bp, Homo sapiens
  misc_feature: GYAE6OF02GBUMK.47.48.E04.1.454.CMB.1.raw
tcagagctcacgtacacgaccggtgctcgatttagagagcgtcacagagagaaggggaggtctcagagaggagccttagccctggactccaaggcctttccacttggtgatcagcactgagcacagaggactcaccatggaattggggctgagctgggttttccttgttgctattttagaaggtgtccagtgtgaggtgcaattggtgcaatcgtgggggaggcttggtccagccgtggggggtccctcagactctcctgtgcagcctcgtggtattcacctttagttcctcttggactgtaagttgggtcccgccacgtactccgaaggggaacggggctggaggttgggttggacgtaaacgataaatccgaagacgttaggaaagtcaaggtaaaaccctagtacggtaggtaccttacgtccgtaggtaacgggggtcccgtaaagttttcccaaaccgtactttacccgtacccgaacggtaaacgaaccctaaaaccgggaccccaaaaggttaaaccctccttaccgtttacggttttaccctacggtacctaaaaggttccggaacctaggtaccccgtgaaacgggtacgttaaccggaaaggtaccgtaacggggtcttaggtaacgttaacgtttaccgttaggttcggttacgttccgttcgtacgggtaccccgccggttccgggtacccccggttacggttgggttaccccgg

SEQ ID NO: 136519 - DNA, 556 bp, Homo sapiens
  misc_feature: GYAE6OF02GN3PL.47.48.E04.1.454.CMB.1.raw
  modified_base (225)..(225): a, c, t, g, unknown or other
  misc_feature (225)..(225): n is a, c, g, or t
  modified_base (478)..(478): a, c, t, g, unknown or other
  misc_feature (478)..(478): n is a, c, g, or t
tcagagctcacgtacacgaccggtgctcgatttagagagcgtcacagagagaaggggaggaatcagtcccactcaggacacagcatggacatgagggtccccgctcagctcctggggctcctgctgctctggctcccaggtgccaggtgtgacatccagatgacccagtctccatcctccctgtctgcatctgtaggagacagagtcaccatcacttggccgggngagtcgagggcgttgcaaatgctttggcctggtttcagcagacaccgagggaacggcccctaagccgcctgactctatgttacattccactttgactaacgttccggggtccctaattccgtcggttacagtcggcgagtggatcgtagggactagtattccacgtcctcactactcacgcacgcctgcacgcctgaagtatgtcgactaacttattactagtaactaaaatactaaactagtacgaccccgnttacctaccgtttcgggacggaacgggtaccgtaagggtggaacgtacgtacgaaaccgtacgtacggtacgcgtacg

SEQ ID NO: 136520 - DNA, 490 bp, Homo sapiens
  misc_feature: GYAE6OF02FKQYP.47.48.E04.1.454.CMB.1.raw
tcagagctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcagtcagggcgttgcaaatgctttggcctggttttcagcagacaccagggaaggcccctaagcgcctgatctatggtgcatacactttgcaaagtggggtcccatcaaggttcagcggcagtaggtctgggacagagttcactctcactatcagcggcctgcagcctgaagattctgcaacttattactgtctccagttatgatgcttaccctcggtactttcggccaagggccaaggtggaaatcgaaacgactgtaggctgcactac

SEQ ID NO: 136521 - DNA, 935 bp, Homo sapiens
  misc_feature: GYAE6OF02ICOIX.47.48.E04.1.454.CMB.1.raw
tcagagctcacgtacacgaccggtgctcgatttagagagcgtcacagagagaagggggaatcagtcccactcaggacacagcatggacatgacgggtccccgctcagctcctggggctcctgctgctctggttcccaggtgccaggtgtgacatccagatgacccagtcctccatccctccctgtctgcatctggaggagacgagtacgtccaaccatccacgttcgggcccgggacgtaaggtcgacggggtcgttagactaaaatggtccgttttgggcccgtttcgggtttcgaacgtacgacgaccgtaaccggaaggggtaaccggaccccccgttaaacggcccggtcccgttacggtaacgttccgttaaaggttcggggtacgtaccgtaaacttaaccgttaaccgttttacggaaaccggttaaaacgggttcccggggggtacccctaacggttaccgtaaacgggtttaccgaacgggtacccggtaggtaaacgggttcggggtaccgtacgggggaaccgtaaaggttaccggttttaacccgtaaccgtttaccgttaaccgtaacccttaaggtacccggtaaacgggtcccggtacccgtccgggtaccgacggttacccggttaaaggtaacggttaccttttcgaacggttaacccttaaacgttttaacgttaacccgttcggttacccgttacccgtaagttaccgttacgggttaacgtttacccgttaccccggtttaacccccggtttaacccggggttaaccgtttacccggggaacccggggttaaaaccgggggtaacccggttaaaaacgggggtaaaccggttaaaaccgttaaacccgggttaaaaccgtacgggtttacgggtacccggttacggtaaccccgtaccctaacccgtttaaccgg

SEQ ID NO: 136522 - DNA, 587 bp, Homo sapiens
  misc_feature: GYAE6OF02I5CQ3.47.48.E04.1.454.CMB.1.raw
  modified_base (321)..(321): a, c, t, g, unknown or other
  misc_feature (321)..(321): n is a, c, g, or t
  modified_base (328)..(328): a, c, t, g, unknown or other
  misc_feature (328)..(328): n is a, c, g, or t
  modified_base (379)..(379): a, c, t, g, unknown or other
  misc_feature (379)..(379): n is a, c, g, or t
  modified_base (444)..(444): a, c, t, g, unknown or other
  misc_feature (444)..(444): n is a, c, g, or t
  modified_base (449)..(449): a, c, t, g, unknown or other
  misc_feature (449)..(449): n is a, c, g, or t
  modified_base (569)..(569): a, c, t, g, unknown or other
  misc_feature (569)..(569): n is a, c, g, or t
tcagagctcacgtacacgaccggtgctcgatttagagagcgtcacagagagaagggggaatcagtcccactcaggacacagcatggacatgagggtccccgctcagctcctgggctcctgctgctctggttcccaggtgccaggtgtgacatcccagatgacccagtctccatcctccctgtctgcatctggtaggagacaggcgtccaccatccacttcggccgggcagtcgagggtcgttgacaattcgtcgtttggccgttggtttcagcacgaccaccggtaagggaaccggcccctaacggccgaccgtgatcgtntagggtnactatactactttgaacgtaagggtccggtaccatacgaggttcaggcganaggttcgcgtgggactagtcgtacactacgtctactatcgacgccgtctcgcacgctaggacgtnttcgntacttaattacttacgtcgtcctacgtagttctacgtacttcgtacccttacgtacggttaccgttcggacccggtaacggaaccgtaggtaacgaactaaccgagtacggtgttccggngtaccgaccgattaccgg

SEQ ID NO: 136523 - DNA, 709 bp, Homo sapiens
  misc_feature: GYAE6OF02HSJNF.47.48.E04.1.454.CMB.1.raw
  modified_base (199)..(199): a, c, t, g, unknown or other
  misc_feature (199)..(199): n is a, c, g, or t
tcagagctcacgtacacgaccggtgctcgatttagagagcgtcacagagagaaggggaggaatcagtcccactcaggacacagcatggacatgagggtccccgctcagctcctggggctcctgctgctctggttcccaggtgccgggtgtgacatccagatgacccagtctccatcctccctgtctgcatctgtagganacagagtcaccatcacttcggccgggcgagtcgagggtcgttgacaaatgtctttggccttggttcagcaagacacgacgggaacgcccgtaagcgacctgatctagtggacacataactacttacgacgtaaacggtcggggtacctagtacgtaaggttacgacgggacggacgtaacggttacgggtacgtacgggtacgtaagtacggtttacctaccgttaccgttaccctaaactacgtacgaaccgggtccggtccgtacggacgaccgtaccgtaacggtaaacgttacttacgtacgtaaaccgttaaacgttttaacttaacgttcgttaaccttaaccgtaagttaacgtacgttaactttaccggttaccctttaaccccggtttaacggttaacccgttttaccgggaaccggtaaaaccgggaaccggttaaacggtaacggaaaacgttaaccgaaacgttaacgtacggtcggtacgtaccgactaaccgtacg

SEQ ID NO: 136524 - DNA, 613 bp, Homo sapiens
  misc_feature: GYAE6OF02HK82W.47.48.E04.1.454.CMB.1.raw
  modified_base (150)..(150): a, c, t, g, unknown or other
  misc_feature (150)..(150): n is a, c, g, or t
  modified_base (230)..(230): a, c, t, g, unknown or other
  misc_feature (230)..(230): n is a, c, g, or t
  modified_base (299)..(299): a, c, t, g, unknown or other
  misc_feature (299)..(299): n is a, c, g, or t
tcagagctcacgtacacgaccggtgctcgatttagagagcgtcacagagagaaggggaggaatcagtcccactcaggacacagcatggacatgagggtccccgctcagctcctggggctcctgctgctctggttcccaggtgccagggtntgacatccagatgacccagtctccatccctccctgtctgacatctgtacggagacagagtcaccaatcacgttgccgggngagtcagggcttggcaaatgcttggcctgttcagcagacacaggaacgccctaagcgctgatctatggngctaatactactttgacgtaaaggtcgggtaccctagtcaaaggttcaaggccgagaaggttacggtacgttacgggagtagtacggttactaccgttctacgaaccttataccgaggtaccggcccttaggcgaacgccgttagtaaagtacgtttttacggaaactttatttaactagttaaccaacggtaaggttaaccgtaacggtttcccgtataccctaccggttcggacgggtacgggacaagggtggtaacgagtaacggaaaagtacgtaggtacggtccgagtacccgaactaccgtcgttacg

SEQ ID NO: 136525 - DNA, 562 bp, Homo sapiens
  misc_feature: GYAE6OF02HCB3C.47.48.E04.1.454.CMB.1.raw
  modified_base (199)..(199): a, c, t, g, unknown or other
  misc_feature (199)..(199): n is a, c, g, or t
  modified_base (225)..(225): a, c, t, g, unknown or other
  misc_feature (225)..(225): n is a, c, g, or t
tcagagctcacgtacacgaccggtgctcgatttagagagcgtcacagagagaaggggaggaatcagtcccactcaggacacagcatggacatgagggtccccgctcagctcctggggctcctgctgctctggttcccaggtgccaggtgtgacatccagatgacccagtctccatcctccctgtctgcatctgtagganacacagtccaccatcacttgccgggnagtcaggacattagctaattattagcctggtatcagcagaaaccagggaacgttacctaagctcctgatctatgttacatcctactttgactaagttcgggtccctagtcttcggttcagtggactaggtgatcgtgggactagtatttcactctacaccatcagctacgtctcgacctaaccgttgtaagttatttcgactaacttactactcgtacaacgtacgtacgttaccggttacccttacgtacgtttcggaccgtaacgggacctaacgtggtaacctaactaacgaaaccgtacttggacggtactacggacctaccgtatcttaccg

SEQ ID NO: 136526 - DNA, 883 bp, Homo sapiens
  misc_feature: GYAE6OF02G9INO.47.48.E04.1.454.CMB.1.raw
  modified_base (100)..(100): a, c, t, g, unknown or other
  misc_feature (100)..(100): n is a, c, g, or t
  modified_base (193)..(193): a, c, t, g, unknown or other
  misc_feature (193)..(193): n is a, c, g, or t
tcagagctcacgtacacgaccggtgctcgatttagagagcgtcacagagagaaggggaatcagtcccactcaggacacagcatggacatgaggtccccgntcagctcctgggctcctgctgctctggttccaggtgccaggtgtgacatccagatgacccagtctccagtcctcctgtctagcatctgtaganacagatcaccatcacttcggccgggacgtaggtccgaaggggtccgtttagaccgtaaaacgttcggtacccgttttcgggaccccgttgggtttttaccgaaacggttccgtaacggtaaaccctaacccgggaaaacgggggtaaaccggtaaccccccccgtttaaaagggcccggtaaccccgtttaggtaacgtttacccgtttaaagttccgggttaacgtaccgtaacgtttaaccttaccgttttacggaacgttaaaacgggttcgggggttaaccccaagttaccggtaaacggtttaccgaacgggttacgggaaccgtacgggttaaaccgggttccgttacggggaaacccgttagggttaaccgtttacccgtaaacggtttcccttaacccgtaaacgttaagttaccccggaacgggtacccggtacccgtacggttaccgtaaaccggtcccgttaaaggtaaacgttaaccgtttacgtaaccggttacgttaaaacctttaccgtttaaactaccgggttaacctcccgttaaagttacgttcggtaacgtttacggttacctttaaacccggtcgggttaccgtttacggaaccgtaaaccgggtaccgtaagttacgggtaaactacgaaaccgttacggcggtacggacccttagacctaccgtaacg

SEQ ID NO: 136527 - DNA, 572 bp, Homo sapiens
  misc_feature: GYAE6OF02FNEO0.47.48.E04.1.454.CMB.1.raw
  modified_base (195)..(195): a, c, t, g, unknown or other
  misc_feature (195)..(195): n is a, c, g, or t
  modified_base (221)..(221): a, c, t, g, unknown or other
  misc_feature (221)..(221): n is a, c, g, or t
  modified_base (307)..(307): a, c, t, g, unknown or other
  misc_feature (307)..(307): n is a, c, g, or t
  modified_base (402)..(402): a, c, t, g, unknown or other
  misc_feature (402)..(402): n is a, c, g, or t
tcagagctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctcctgtctgcatctgtaganacagagtcaccatcacttggccgggngagtcgagggtccgttgcaaatgtctttggcctggtttcagtcagacaccgagggaacggcccctaaggcgcctgatctagtggtncagtactacttgactaaaggtcggggtccagtacgtaaggttcagcggacgtaggtagtcgtagggacaggtacgttcacttacctacgactacncgtacggccgtcctacggcacgccgtagtaacgtacttctcgtacttaactttacgttactcgttacctcgtagtatacgtatcgtaccttaccgtcgttacgttccggaccgtaacggaccgtaggtaacgaaagtaccaacgtacgtcggtacgtcgacgactctacg

SEQ ID NO: 136528 - DNA, 734 bp, Homo sapiens
  misc_feature: GYAE6OF02IBM3Q.47.48.E04.1.454.CMB.1.raw
tcagagctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacgttcggccgggcgagtcgaggggtcgttgacgaaatgtacgtttggccgttggtttcacgcacgtacaccgaggggaacggccccgtaaggccgcctagactctagtggtgactatactactttgacgtaaacggtcggggtaccctagtacgtaacggttcgagacgggacaacggttacgggtcgtagggactaggtacggttcctaccgttctactaaccgttaataccgtaacggtcccggtaccgtcggcccgtaacggtccgttaacggtaacgtacgttacgttaccggtacttaaaccgttttacttaccggttacgttacccttacgtaagtttacggttacgttaacgttccggttaacccgtttaccccgttaccgggtttacccggtttaccgggacccggtaaacgggggacccggttaaaacgggttaacggtaaaccgttaaaccggtaaaccgggttaaccggttcgggtacgggtaccgtacggtaaccccgtacttaacccgg

SEQ ID NO: 136529 - DNA, 747 bp, Homo sapiens
  misc_feature: GYAE6OF02HZXKH.47.48.E04.1.454.CMB.1.raw
tcagagctcacgtacacgaccggtgctcgatttagagagcgtcacagagagaaggggctcagagaggagccttagccctggactccaaggcctttccacttggtgatcagcactgagcacagaggactcaccatggaattggggctgagctgggttttccttgttgctattttagaaggtgtccagtgtgaggtgcaattggtgcaatcgtgggggaggcttggtccagccgtggggggtccctcagactctcctgtgcagcctctggtattctacctttagttccttcgtttggatgtaagtttcgggtcccgccgagtaccgtccgaggggaacggggtcgtgggtaggttgggttggacaacgtaagtaaacgtccgaaggaagttagggaagttacgaaagtaaaaaccgttagtacgtaggaccttcgtacgtagggaacgggtacctaagtttccgaaccctattcccgtacccgaaggtaaccgaaaccgaaccgaccctaaaacggtaacccttaccgttactttacggttttacctacggaaaccctaaagttccgggaaacgtaacggtcccgtaaggaacggtacggttaccggaaaacggaccgaaccgggttcgttaaggtttacgttaacgtttacgttgggtttcggttcggtttcccgtaccgttacggacccggttccccggttcccggggaccccgggttacgttttccggggtccttttacccggggg

SEQ ID NO: 136530 - DNA, 562 bp, Homo sapiens
  misc_feature: GYAE6OF02JAF6T.47.48.E04.1.454.CMB.1.raw
  modified_base (390)..(390): a, c, t, g, unknown or other
  misc_feature (390)..(390): n is a, c, g, or t
  modified_base (406)..(406): a, c, t, g, unknown or other
  misc_feature (406)..(406): n is a, c, g, or t
  modified_base (430)..(430): a, c, t, g, unknown or other
  misc_feature (430)..(430): n is a, c, g, or t
tcagagctcacgtacacgaccggtgctcgatttagagagcgtcacagagagaaggggaggtctcagagaggagccttagccctggactccaaggcctttccacttggtgatcagcactgagcacagaggactcaccatggaattggggctgagctgggttttccttgttgctattttagaaggtgtccagtgtgaggtgcaattggtgcaatcgtggggggaggcttggtccagccgtggggggtcccctcgagactcctcctgtgcagcctctggacttcacctttagttcctcttggatgtaagttcgggtccgccagactccgagggaggggctggagtgggttgcaacataaatcagatgaatcaagaaactagtgtcgactctcngaggcctatcacatcncagacgacacgacaagactctctnttctgactaagtcggactacgcgtagagtagtacggaacgacgacggtcgtagttcgttaagttccgttaggttcgtttgtccttcgtcggacccgtcccgttccggggaccccgttacgttccggttccgg

SEQ ID NO: 136531 - DNA, 884 bp, Homo sapiens
  misc_feature: GYAE6OF02JWZ0H.47.48.E04.1.454.CMB.1.raw
tcagagctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatcgacccagtcctccactccctccctgtctgcatctgtaggagacagacgtcaccatcacttcggccgggacgaggtcgagggtcgttagactaaagtgtcgtttcggtaccgttcggtttacacggtacgacggtaaccgaaccggtaacgggggtaaacccggacccccgttaaacggcccgtccgttacggtaaccgttccgttaacggttcgggttagtacccgtaacttaaccgttacgtttttacggaaccggttaaaacggggttacccgggggtacccttaaagttaccggttaaacggggttaccgtacggggtaccgggtaccggtaagggttacgggttaccgggtacgggggtaaaccgttacggtaacggtttccctaaccgtttacgtaccgtaaacgttacgtaacccgtacgggtacccggtaccgtaccggtccggtaaccggttccgttaacggtaaacgtttacgttccgttaaccggtaactttaaaccttttaacgttacgtttcctaccgttaaccgttagttaacgtcggtaactttcccgttaacccggtttaacccgttccgggttaacccggtttacccggtaaccgggtaaaccgggtaaaccggttaaccgggtttaacggtaaaacccgttaaccggtaaacggttacccggttacggttaccgggtacctaccggtaccgtaacccgtttaaccgg

SEQ ID NO: 136532 - DNA, 550 bp, Homo sapiens
  misc_feature: GYAE6OF02F4MKL.47.48.E04.1.454.CMB.1.raw
  modified_base (197)..(197): a, c, t, g, unknown or other
  misc_feature (197)..(197): n is a, c, g, or t
tcagagctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtagganacagagtcaccatcacttgccgggcagtcagggcgttgcaaatgctttggcctggtttcagcagacaccgagggaacggcccctaagcgcctgatctatggtgcatactactttgcaaagtcggggtcccatcgaagttcagcggcagtaggtctggggacagagttcactctcactatcagcggcctgcacgcctagaagtattctgtactaactttacttactgttacctaccgtagttagtgtattcgtacctttacccgttcgggtaccgtttcggacccgaacgggtaacctaagggtacggtaaactaccgaaacgtaacgttggtacggtccgtagtcctactacg

SEQ ID NO: 136533 - DNA, 590 bp, Homo sapiens
  misc_feature: GYAE6OF02FY3D7.47.48.E04.1.454.CMB.1.raw
  modified_base (265)..(265): a, c, t, g, unknown or other
  misc_feature (265)..(265): n is a, c, g, or t
  modified_base (309)..(309): a, c, t, g, unknown or other
  misc_feature (309)..(309): n is a, c, g, or t
tcagagctcacgtacacgaccggtgctcgatttagagagcgtcacagagagaaggggaggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttcgccgggcgagtcgaggggtcgttgcaaatgctttggccttggtttcngcagacaccgagggaacgccccgtaagcgcctgatctagtggtncatactacgtttgacgtaaaggtcgggtaccctatacgtaacggttcaggcggacgaggtaggtcgtaggggacaggtagttcactctacactatccgaggccgtccgtgccagtcccgtaggaaacttattccgtactaccttaactttacgtttacctcgttacctccgttaagtagttgtattcgtcctttacccgtcgttaccgttccggaccgtaaacgggaccgtaacgggtaagaacgtaacgtaacggacgttaggtcgacgtcgactaaccg

SEQ ID NO: 136534 - DNA, 776 bp, Homo sapiens
  misc_feature: GYAE6OF02JL0GK.47.48.E04.1.454.CMB.1.raw
tcagagctcacgtacacgaccggtgctcgatttagagagcgtcacagagagaagggctcagagaggagccttagccctggactccaaggcctttccacttggtgatcagcactgagcacagaggactcaccatggaattgggctgagctgggtttccttgttgctatttagaaggtgtccagtgtgaggtgcaagttggtgcaatcgtggggagcgttggtccagccgtgggggtccctcagactcgtcctgtgtagtctcgtggaatctacgtttcagttaccgttctggtatcgtactacgtcgggttccccgacctaaaaccgtccgtaacggggtaacggggtccgtgggttcggtacgggttccttacgaccgttagtaccgtaacgttcccgtaggtagtcggtctaacggttagtttaaacttaaaagtttacgttacgggtaccggtaacccgttccggtaggtaccgggggtacccgtagtttaccggagtaccgtacgtacccgttaccgaaacgggttaacgaaaccgtaaaccgggtaagaaacggtaacgttaaacgttaaccgtaaggttaaccttaacggtaacggtaaaagttaccggaaaacttaacgttacgtaaggaacggttaacgtaccggaaacgtaccgttaaccgggtattaccggttactaaacgttacgtttacgtttacgtttccgaaacgttccgttacccggttcccggttaccgggtaccgggttaccgttacggtaaccccgggg

SEQ ID NO: 136535 - DNA, 849 bp, Homo sapiens
  misc_feature: GYAE6OF02IUM3Z.47.48.E04.1.454.CMB.1.raw
tcagagctcacgtacacgaccggtgctcgatttagagagcgtcacagagagaaggggctcagagaggagccttagccctggactccaaggcctttccacttggtgatcagcactgagcacagaggactcaccatggaattggggctgagctgggttttccttgttgctattttagaaggtgtccagtgtgaggtgcaattggtgcaatcgtgggggaggcttggtccagccgtcggggggtccctcgagactctcctgtgcagtcctctggtattctaccttttacgttcctcgttggacttggtaagtttcggggtcccgccgtacggaccgtcccgaagggggaacggggtcgtggggtaagggttggggtttacgggacctaaaacggtaaacgttaaaacgtacccgaaaggtaagtacggggtaaacgttaaccgtaaaacggtaaaaaacccttagttacgggtaacgggtaaccttccgttaccgttaaggggaaccggggtaccgtaacttttacccgaacccgtaacttaccgtacccgaaagggaaccgtaaacccgaaacccggtaacccgaaaaacggtaaccctttaccgttaccgttttacggttttacctaacggtaaacctaaaacgggtttccggaaaccggtaaccggtaccccggttaagggaacggtaaccgggttaaacggaaaccggaaaccggtacccgggtacgttttagggttaggtttaaccttttacggttaggtttcgggttagttcccgttacgtaccggtacccgtcccggttcccggggttaccccggtcccggtttcgggtacccttttcccggggg

SEQ ID NO: 136536 - DNA, 714 bp, Homo sapiens
  misc_feature: GYAE6OF02G0EP5.47.48.E04.1.454.CMB.1.raw
  modified_base (294)..(294): a, c, t, g, unknown or other
  misc_feature (294)..(294): n is a, c, g, or t
tcagagctcacgtacacgaccggtgctcgatttagagagcgtcacagagagaaggggaggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacgttggccgggcgagtcgagggtcgttgcaaatgctttggccttggttcagcagaccaccagggaacgcccctaaggccnccgtgactctagtggtgctatacctactttgactaaaggttcgggtacccagtccgtaaggttcaggtctagtcgtaggtacggtcgtaggggacaaggtacgttaccaacgttcctacgtaaccttacgtaccgacgggtccgtcccgttacggcctaacggtcccttaggaaacgttactttccgtacggtacctttaaaccgttttacttttaacccgttcggttaccctttacccgtaaggtttacgttacgtaaccgtttacgtaccccgttttaccccgtacgggtttaacccgttttacccggggaacccggtaaaccgggggtaacccgtaaaacggggtttaccggtaaaacttaaccccgggtaaaacggtaccggtttacggtaccgggttaccttacgggtaaccccg

SEQ ID NO: 136537 - DNA, 737 bp, Homo sapiens
  misc_feature: GYAE6OF02H9NT8.47.48.E04.1.454.CMB.1.raw
  modified_base (644)..(644): a, c, t, g, unknown or other
  misc_feature (644)..(644): n is a, c, g, or t
tcagagctcacgtacacgaccggtgctcgatttagagagcgtcacagagagaaggggctcagagaggagccttagccctggactccaaggcctttccacttggtgatcagcactgagcacagaggactcaccatggaattggggctgagctgggttttccttgttgcttattttagaaggtgtccagtgtgaggtgcaattggtgcaatcgtgggggaggctttggtccaggccgtggggggtccctgagactctcctgtgcagccttctggacttctaccttttagttccttctttggattagaagtttcgggtcccgtccgagaccgttccgaagggggaaggggcgtgggaggttcggggttggacaacaataaaactccaagagtagggaagtacgaacgtaaaaaccttagttggtacgtaacttcgtcgtaggaacgggtccgtaattaccaaccctagttccctaccgaaggaacgaaccctaaaccggacctaaaacggtaacccttcgtttaccgtttgttttccgtacggaacctaaaaaacggttcgggaaacctaggtccccttagggaaacggtaacggttaccggaaaaccgaacgaccgggtacttgggttacgttaactttttaccgngtttaggttcgttaccgtttccgtacgggtaccgtcccccggttaccgggggtacccccggttaaccgtttttcggggccccttttaccgggg

SEQ ID NO: 136538 - DNA, 763 bp, Homo sapiens
  misc_feature: GYAE6OF02JM0GJ.47.48.E04.1.454.CMB.1.raw
  modified_base (206)..(206): a, c, t, g, unknown or other
  misc_feature (206)..(206): n is a, c, g, or t
  modified_base (221)..(221): a, c, t, g, unknown or other
  misc_feature (221)..(221): n is a, c, g, or t
tcagagctcacgtacacgaccggtgctcgatttagagagcgtcacagagagaaggggaggaatcagtcccactcaggacacagcatggacatgagggtccccgctcagctcctggggctcctgctgctctggttcccaggtgccaggtgtcgacactccagatcgacccagtctccatccctcctgtctcgcattcgtgtacgganacgagacgtcaaccntacacgttggcccgggtcacggtcgacggggtccgttcgacgtaaacgtcgttcgtttacggtccgttcgggtttacacggtcgacgaccgtacccgaacggggtaaaccggtacccccgtaaacggcccggtaccgttacggaacgtttaccgtacgttacgggtccggaccgttaacgttaaccgttacttttacgggaccgtaaagggtaccggggttcccgtaagttaacggtaaccggtttaccggtaacggccgggtaacgttacgggtcgggttaccgtacgggacgtaacgggtcgttaccgaccttacctacaaccgtagtacccgtacggccggtccgtcgaccgtacgcggtacgtaaacgtcttaccgttacggacttaaaccgttcgtttaccgtacggttcctacgtactacgttgaaccgttcgttacccttacggtccgttaccgttaccggaccggtaaccgggtagtaaacgggtacgtaaccgttaacgtaacgaccgttaggtacgttccgtacgcctaacg

SEQ ID NO: 136539 - DNA, 658 bp, Homo sapiens
  misc_feature: GYAE6OF02F1Q23.47.48.E04.1.454.CMB.1.raw
tcagagctcacgtacacgaccggtgctcgatttagagagcgtcacagagagaaggggaggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaaccatcacttcggccgggcgacggtacgaggggtcgttgacaaatcgtctttggccttggtttcagcagacaccgagggaacggcccctaagccgctcgatctagtggtcgctatactacgtttgacgaaacggtcggggtacccagttacgtaacggttcgagccggactagggttacggttcgtaggggaacaggtaacgttccgacttcctacacttatcgacgtaccgggccttacggctaccgccgttacggaacgttacttccgtagtaccttaaactttacttaccgttcgttacctaccgtaagttacttacgggtaattccgtacccgtttacccttaaccgggttaccgttttacccgggaccggtaaacgggtaaccggtaagggtaaccggtaaacgtaacgaaaccgacgttacggtaggaccgttacgacctaccg

SEQ ID NO: 136540 - DNA, 797 bp, Homo sapiens
  misc_feature: GYAE6OF02IFZKP.47.48.E04.1.454.CMB.1.raw
tcagagctcacgtacacgaccggtgctcgatttagagagcgtcacagagagaaggggaggaatcagtcccactcaggacacagcatggacatgacgggtccccgctcagcctccgtggggctcctgctgctctcggttcccaggtgccgaggtgtgacatccagatcgacccagtcctccactcctccctgtctgcatcgtcggtagagacagacgtccacctactctacgttcggccgggacgtacggtccgaggggtccgtttgaaccgtaaagttcgtcgtttacggccgttggtttcagtcaacgtaaccgaccggaaggggaaccgaccccgtaaaggcccgtaccctgacttccgtagtcgggtacgcaattaccgtacgtttcgaacggtaaacgggtcgggttacccaagtccgtaaaggttccaacgggccgggtatacgggttacggtcggtcggggaacctagggttcgttactacccttcgtaacctacgttaacgtccgacggtcccggcgtaccgacggtacgtcccggttaagtaacgtacgttttaccacggtaaaccttaaccgtttaacgtttaccggttaccggttaaccctaacccgggtttaagtacgttaacggttcttaacccgttccgttttaaccccggtccgggttttacccgtttaccgggtaaaccggtaaccgggggttaaaacctaaacgggggttaaaccgtaaaccgttaaaaccgggtaacgtaacgttttccgggaccgtaccgtaccggtaccttaaccggg

SEQ ID NO: 136541 - DNA, 747 bp, Homo sapiens
  misc_feature: GYAE6OF02FPZTM.47.48.E04.1.454.CMB.1.raw
  modified_base (242)..(242): a, c, t, g, unknown or other
  misc_feature (242)..(242): n is a, c, g, or t
  modified_base (392)..(392): a, c, t, g, unknown or other
  misc_feature (392)..(392): n is a, c, g, or t
tcagagctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatcgacccagtctccatccctccctgtctgcatctgtaggagacagagtcaccatctacttcggccgggcgagtcgagggcgttnacaagtgtcgtttcggtccgtggtttacagcacgacgaccgagggacggaccctaacgaccaccgtgacttacgtagtcggtgacacttaccgtacttttagacgtaacgggttcggggtaccctagtacgtaaggttcgacggaccggngtaggttacggtcgtacgggacgtaggtacgttacctaccgttcgtaccaacgttacgtcccgaggtcccggtccgtacggtaccgacggtaccctaacgggtaacttacgtttacgtaccggtaacctttaaaccttttacgtttaaccgttacgttacccgttacgtaacgtttacgtacggttacgttaccgttaccccgttttaacccggtccccggtttaacggttaccccgggtaaccggaaaccggggttaacccgggtaacgggttaacccggtaaacgttaacccggtaaaacggtacggtttacgggtaccggtaccgtttaccggacccgttacccgttaccgg

SEQ ID NO: 136542 - DNA, 800 bp, Homo sapiens
  misc_feature: GYAE6OF02HY27Q.47.48.E04.1.454.CMB.1.raw
tcagagctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatccctccctgtctgctatctggtaggagacagacgtccacctatacacgttcggccgggacgaggtcgaggggtcgttacgactaaatggtaccgtttgggccgtttggtttacaacggtacgaacggaacccgaacccggaaacggggtaaaccggaccccccgtaaacggtccggtacccgttagacgttaccgttaagtcgggtacgtaccgtaacttaaccgttacgtttacggaacgtaaaacggggttccggggtaacccacgttaccgtaaagggttccgaacgggaccggtacgtaacgggttaacggtaccgttacggggaacgtagggttaccgtttaacctacgttacgtacccgtaactttaaacgttccgaacggtcccgggtacctccgggaccgtacggtaccgtaaggtaaacggttactttcccgtaggtaaccttaaacgttttaactaccgttgttaccctcgtaagttagtacgtattccgttacccgttacccgttacgttaccgttaccggaaccggtaaacggtaacgggtaaacggttagggtaaaacctacccgtaaaaggtacccgttagggtaccggtacttaaccggacctacgttaacg

SEQ ID NO: 136543 - DNA, 686 bp, Homo sapiens
  misc_feature: GYAE6OF02GGKF5.47.48.E04.1.454.CMB.1.raw
  modified_base (204)..(204): a, c, t, g, unknown or other
  misc_feature (204)..(204): n is a, c, g, or t
tcagagctcacgtacacgaccggtgctcgatttagagagcgtcacagagagaaggggaggaatcagtcccactcaggacacagcatggacatgagggtccccgctcagctcctggggctcctgctgctctggttcccaggtgccaggtgtgacatccagatgacccagtctccatcctccctgtctgcatctgtaggagacagngtcaccatcacttgccgggacgagtcgagggcgttgcaaatcgtctttggccttggttcagcagacacagggaacgcccgtaagcgcctgactctagtggtgctatactactttgactaaaggtcgggtacccaagttacgaacggttcgaagggtcggtacgtaaggttacgggtacgtacggggtaacgtaacggtacggttacaccgttcctactaacttacgtacgtacggccgggtaccgtggacccgtacggaccgttaaggaacgttacgtttccgacggttacctaaaccgttttacgtttaaacgtcgttaccgttacctaacggttactaaggtacttacggttaaccctttacccggtaccggtttaccgtttaccggaccggtaaacgggtaacccgtaaagggttaaccggtaaacttaacccggtaaaacgacggttacggtacggtaccgtacggtaccgtaaccgg

SEQ ID NO: 136544 - DNA, 664 bp, Homo sapiens
  misc_feature: GYAE6OF02G5C3T.47.48.E04.1.454.CMB.1.raw
  modified_base (344)..(344): a, c, t, g, unknown or other
  misc_feature (344)..(344): n is a, c, g, or t
tcagagctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatcgacccagtctccatccctccctgtctgctatcgtggtaggagacagagtccaccatctacttaggccgggcaggtcgagggtcgttgactaatgtccgtttggtccgttggttacagcacgaacctaccggaagggaaccggtaccccgtaaggcccggtacctgtaacttcgtagtgggtacnctactactagtttacggaacgtaacgggtccggtacctagtaccgtaaggttcgaacggtaccggcgtaacgggttacggtacggtacgggaactaggttaccgttcctacgttccgtactaccttaacgtcgagtccgttaacgtccgtacggtacctaaccgtaggtaactttacgtttacgacttacttacgtatcgtaacacgtacgtacggttaccgtacccgttagttccgttacggacgaccgtaccgtacgtacgactacggtaaaccacgtacgtacggtcgaccgtcgaacctacgtacttccgtcttac

SEQ ID NO: 136545 - DNA, 564 bp, Homo sapiens
  misc_feature: GYAE6OF02I68LD.47.48.E04.1.454.CMB.1.raw
  modified_base (410)..(410): a, c, t, g, unknown or other
  misc_feature (410)..(410): n is a, c, g, or t
tcagagctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatccctcctgtctgcatctgtaggagacagatcaccatcacttggccgggcgagtcgagggtcttgcaaatgcttggcctggttcagcagacacgaggacgccctaagcgcctgatctatggtgcatacactttgacaaggtcgggtcccatcgtaagttcgagcggactaggtaggtccgtagggactaggtacgttcactctactaactatccgagccgctgcacgcctagaacgtnttccgagtactaactttataccttgtcctaccgtagttacgtgtacgttcgtacccttacccgtcgttccgttcggaaccggtaacgggtaaccgtaagggtagtaaaccgtacaaacggttaacgtggtaccgcgaccgtacctaccgttacg

SEQ ID NO: 136546 - DNA, 596 bp, Homo sapiens
  misc_feature: GYAE6OF02F70QI.47.48.E04.1.454.CMB.1.raw
  modified_base (309)..(309): a, c, t, g, unknown or other
  misc_feature (309)..(309): n is a, c, g, or t
tcagagctcacgtacacgaccggtgctcgatttagagagcgtcacagagagaaggggaggtctcagagaggagccttagccctggactccaaggcctttccacttggtgatcagcactgagcacagaggactcaccatggaattggggctgagctgggttttccttgttgctattttagaaggtgtccagtgtgaggtgcaattggtgcaatcgtggggggaggcttgggtccagccgtggggggtccctcagactctcctgtgcagcctctggattcacctttagttcctcttgatgaattgggtccnccgagacgtccgaggggacggggctgggagtgggttggcaacgataaactccagatggaacgtcaaagaaaaccttagtgtcggactctacgtacgaacggggcctaagttcacctactcctccagtacgaaccaaccgaccaaagaacctcttacgttgtttactacgactaaacgtcggacacgcctagacgagtacgaagacgagtcctggttactagttcgtgttacggtcgtcttcgtacggtccgtccggttcccgggtccccgtaccggttggttcccgg

SEQ ID NO: 136547 - DNA, 689 bp, Homo sapiens
  misc_feature: GYAE6OF02FXD4V.47.48.E04.1.454.CMB.1.raw
  modified_base (104)..(104): a, c, t, g, unknown or other
  misc_feature (104)..(104): n is a, c, g, or t
  modified_base (200)..(200): a, c, t, g, unknown or other
  misc_feature (200)..(200): n is a, c, g, or t
  modified_base (213)..(213): a, c, t, g, unknown or other
  misc_feature (213)..(213): n is a, c, g, or t
tcagagctcacgtacacgaccggtgctcgatttagagagcgtcacagagagaaggggaggaatcagtcccactcaggacacagcatggacatgagggtccccgntcagctcctggggctcctgctgctctggttcccaggtgccaggtgtgacatccagatgacccagtctccatcctccctgtctgcatctagtagganacagacgtcaccntcacgttcggccggggtcgaggtcgagggtcgttgaccaaatgtcgtttcggccgttcggtttcagtcctacgacctaccgacgggaaccggcccccgtaaggccgcctcgactcgtagtcggtgcgtactacctctttacggactaaacgggttccgggtaccctagtaccgtaaggttcgacggtccgggtacgtacggtacgggtacgtaggggaccgtaggtaacgttccaccttacctactacgtacgtcgacgccggtcctgccgacgtccgtagagtacgttccgtgtacctaactttagttaccgttacgttccgtaacctaaggtttactacggtacttccgttaccgtttacccgttaccggttaccgtttacccggaaccggtaaacggggtaaccgtaaacggggttaacgaaaccgttaacggaaacgttacgttacggtaccggtcgtaccgaccgtaaccg

SEQ ID NO: 136548 - DNA, 708 bp, Homo sapiens
  misc_feature: GYAE6OF02G5TBB.47.48.E04.1.454.CMB.1.raw
tcagagctcacgtacacgaccggtgctcgatttagagagcgtcacagagagaaggggaggtctcagagaggagccttagccctggactccaaggcctttccacttggtgatcagcactgagcacagaggactcaccatggaattggggctgagtcgtgggttttccttgttgtctatttagaaggtgtccagtgtgaggtgctaattggtgcaatcgtgggggaggtcttggtccagtccgtcggggggtccctcacgactcctcctgtgcagcccttgtggtacttctaccttttacgttccttcttaggtataggtaacggtttcggggttcccgacctacggacccgtaccgggaagggggtacggggtacggtagggtggggttcggggtggaacctaaacgtaaactaaacgttaacccgaaggtaacgtaagggtaaacgtaacgtaaaaacgtaaaaccgtaagttcggtacggtaccttcgtacggtaggaaccggggtcctacttaccgaaactcgtcctacgacgaacgaaccaaccgaccaacggttaacttcccttgttccgttacgtaaccgaataacggtggaaccgacggtcttaagggacgttaacgaaccggaaagtccgacgtctagtatttacgtcgttgtcgtgtacctcggtctaccggcccgttacggccggttacgtcgtaccgg

SEQ ID NO: 136549 - DNA, 715 bp, Homo sapiens
  misc_feature: GYAE6OF02HHRKL.47.48.E04.1.454.CMB.1.raw
tcagagctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcacctatccacgttggacccgggcgagtcgaggggcttgacaatgtcgttggctgttcagcagacacgaggacgaccctaagcgcgtagactctagtgtgactatactactttgacgtaaacggtcgggtaccctagtaccgtaacggttaccgaaggccggtacgtacggttagggtcgtacggggaacgtacggtacgtttactaccgttacctacctacgttaacgtacgtacggcccggtccgttacgaccgtacggtacccgtaggtaaccgttattacgtacgtaaccttaactttaacgtttaaccgttacgttacccttaccgttaacgttacttacggtaacttacggttaccccgtttaaccccggttaccggttacccgggtttaccgggaacccggtaaaccggggtaacccggtaaggggttaaaccggtaaacgttaacccgtaaaaccggtacgttacgggtaaccgtccggttaaccggtaccgtaacccgtacg

SEQ ID NO: 136550 - DNA, 827 bp, Homo sapiens
  misc_feature: GYAE6OF02GTH3W.47.48.E04.1.454.CMB.1.raw
  modified_base (205)..(205): a, c, t, g, unknown or other
  misc_feature (205)..(205): n is a, c, g, or t
tcagagctcacgtacacgaccggtgctcgatttagagagcgtcacagagagaaggggaggaatcagtcccactcaggacacagcatggacatgagggtccccgctcagctcctggggctcctgctgctctggttcccaggtgccaggtgtgacatccagatcgacccagtcctccactccctccctgtctgctatcgtgtagganacagacgtcacctatctacgttcggccgggacgtaacggtcgaggggtcgttacgacctaaagttcgttaccgtttcgggtcccgtttagggtttaccacggtaccgtaacggtaaccccgaacccgggtaacgggggtaaaccgggtaccccccgtaaaggccccggtacccgtaggtaaccgttaccgttaggttacggggtcggaaccttaacgttacccgttaacgtttacggaaccggttaaaacggggttcccggggttacccctaacggttaaccggtaacggtttacggaacggtccgggtaacggttacgggttacgggttacggtaacggggtaacgtaccggttaaggtttaccctaccgtacccttaccgtaacgttacgtacggacgggtcccgtacgtacgtacgaccggttacgaacggtaacgttacgttaccgtacgtacctttaactttacgttacgttaccgttcctacgttaagttacgtcgtaacgttccgttaacccgttcccgttaccgggttaccgttaccgggaaccggtaacgggtaacgaacgggttaacgaaacgtaacgtaacggtacgttgtaccggtactacgtacctacg

SEQ ID NO: 136551 - DNA, 731 bp, Homo sapiens
  misc_feature: GYAE6OF02HH68X.47.48.E04.1.454.CMB.1.raw
tcagagctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatcgacccagtctccatccctccctgtctgcatctgtacggagacagagtccaccatcacgttcggccgggcgtaggtcgaggggtcgttacgacaaatggtactttggtccgttggtttcacgcacgaccgacgaacgggaacggaccccgtacggccgtccgtagtactaccgtagttcggtcgtacgtaacttacctacgtttagaccgtaaacgggttcggggtaccctaacgtaccgtaaacggttacgacgggtaccggtacgtaacggttacgggtcggttaaggggaaccgtaggtacggtttcctaaccgttcgtaccgtacgtaacgttacgacgggtaccccggacgtaccgacgtaccggtaccgtaggtaaacgtatttacccgtagtaacctttaacgtttacgttaacgttcgttacccttacggaacttagtacgtacgtttaaccgtccgtttaacccgtcggttaccgtttcccgggaacgtaaccggggtaaccggtaagttacgggaaaccttaacgtaacgtacggtggaccgtacgacctacgtaccgtacg

SEQ ID NO: 136552 - DNA, 836 bp, Homo sapiens
  misc_feature: GYAE6OF02HYQ78.47.48.E04.1.454.CMB.1.raw
  modified_base (270)..(270): a, c, t, g, unknown or other
  misc_feature (270)..(270): n is a, c, g, or t
tcagagctcacgtacacgaccggtgctcgatttagagagcgtcacagagagaaggggaggaatcagtccactcaggacacagcatggacatggagggtccccgctcagctccgtggggcctcctgctgctctcggttcccaggtcgccaggtgtgacatccagatcgacccagtcctccactccctccttgtctgcatcgtggtaggacgacagacgtccaccatctacttggtcggcgagtcgaaggggtattagactaagttggtacncgtagtacacgaacaacgaaaccgaacgggaaaacctacccctaacctacctacctaactctacctacgtacgctacttacctaactttagaaccgtaaaggttcccgggtaccaagttacgtaacggttccgacgggtcgtacggtaggttaggaacttcggtaacggggaactaacggttcgtttaccaccgttaccttacgtaacttacgtaccgaacgtaccgacggtacctacggtacctaacggtacccgttaaggtaaaccggtttttaaggttttaagggtaaaacctttttaagttaacggtttaaccgttaaacggtaaaacccgggtttaaacgggtttaaaaccccgtttccgggtttttaacccccgtaccgtttaacccgttaacccccgggtttacggggaaaacccgggggaacgggtttaaccgggaaacggggtttacgggaaaccgggtaaattaaaaccggggaaaccggttaaaggttacgggttaccgggtacctacgggtaaccccgtaaacccgttaggtttaccggttccgtttaacccgg

SEQ ID NO: 136553 - DNA, 800 bp, Homo sapiens
  misc_feature: GYAE6OF02JD0G8.47.48.E04.1.454.CMB.1.raw
tcagagctcacgtacacgaccggtgctcgatttagagagcgtcacagagagaaggggaggtctcagagaggagccttagccctggactccaaggcctttccacttggtgatcagcactgagcacagaggactcaccatggaagttgggctgagcttgggtttccttgttgtcttatttagaggtgtaccagtgtgaggtgactaattggtgacaagtcgtagggggcggtacgttcggtccacggtccggtcggggggtaccctcgacgtaccgtcctccgtgttgaccacggtcctcgtggtacttacctaccgttttagttcccttcgttagggtattacgtaacggtttcgggtaccccgccaacggtaacctacccggaaggggtaacggggtccgtagggtaacggtcgggggtttacgacgaaaacgttaataaaacggtccgtaaggtaaccgttaggtaaacgtacgtaaaacggtaaaaccttacggtaggttaccggaaccgttaccgtaccggttaacgggaaaccggggtacccgttaaacgttacccgaaaccctacgttacccgttaaacccgaagggttaaacccggaaaccgtaaacccggacccgaaaacggttaaaccctcgttacgttaccgtttacgtagtaacccggtaaagtcgaaccgtacgtaccgttaaggaactacggtaagaaaccgtaccgacgttacgtgacgttaagttccgtagtagttcgtacgttacgagtacccgtacggtcccgggacgttacgttcggtaccgg

SEQ ID NO: 136554 - DNA, 940 bp, Homo sapiens
  misc_feature: GYAE6OF02JHGD0.47.48.E04.1.454.CMB.1.raw
tcagagctcacgtacacgaccggtgctcgatttagagagcgtcacagagagaaggggaggaatcagtcccactcaggacacagcatggacatgaggtcccgctcagctctggggctcctgctgctctcggttcccgaggtgccgaggtgtcgaacatcccagactgacccagtcctccacttcctccctgtctgctattcgtaggtacgagacgagtacgtaccacctaactcctacgttccgggaccggggtaccggaagttccggaacgggggtccgtttacggaccgtaaaagttcggttaccgttttcgggttacccgtttacggttttaccgaacggtaccgaacggtaacccgaaccggaaaccggggtaaacccggtaccccgtaaaccggccgtacccgtaggtaacttaccgtaacgttggttacgaactaacgttaaccgtaacgtttttacggaacgtaaacggggttaccgggttaccccgtaagttaaccggttaaccgggttccgtaaccggtacggtaccggtaaaggtttaccgggttaccgggtacgggtaaaccggttagggttaacgtttacccgtaaccttcccgtaaccgtaacgtttaaccgttaccgaacccgggttaccggggccttacccggtaccgttaaccggtacccgtaaggtaaacccgtttacggtttaccgtaaccggttaacgttttaaaccttttaacgtttacccgtttaccggttacccttaaccgttagttaacgttacggttacttacccggtttaaccgtttaccccggtaccccggtttaccggtttaaccggtaaccggtaaacccgggttaaccgtaaaacggggttccgtaaaaccgttaaacccgtaaacgggttacggttacgggttacgaccggtttaccgaccgttaacccgg

SEQ ID NO: 136555 - DNA, 530 bp, Homo sapiens
  misc_feature: GYAE6OF02FHZMS.47.48.E04.1.454.CMB.1.raw
  modified_base (303)..(303): a, c, t, g, unknown or other
  misc_feature (303)..(303): n is a, c, g, or t
  modified_base (414)..(414): a, c, t, g, unknown or other
  misc_feature (414)..(414): n is a, c, g, or t
tcagagctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttggccgggcgagtcgagggcgttgacaaatgctttggcctggtttcagcagacaccgagggaacggccctaagcgcctgatctatggtncatactactttgactaaaggtcgggtcccatacgaaggttcagcggacgagtaggtcgtaggacagtacgtcactctacactatcaggcgcctgcacgcctgaagactttnagcctaatttacttactcgtctactagttactgtatctaccttccgtcgtacgttccggaccgtaagggaaccaagggtacaaacgtacaaacgagtggtacgctacgactactac

SEQ ID NO: 136556 - DNA, 563 bp, Homo sapiens
  misc_feature: GYAE6OF02F48C0.47.48.E04.1.454.CMB.1.raw
  modified_base (339)..(339): a, c, t, g, unknown or other
  misc_feature (339)..(339): n is a, c, g, or t
  modified_base (344)..(344): a, c, t, g, unknown or other
  misc_feature (344)..(344): n is a, c, g, or t
  modified_base (347)..(347): a, c, t, g, unknown or other
  misc_feature (347)..(347): n is a, c, g, or t
  modified_base (349)..(349): a, c, t, g, unknown or other
  misc_feature (349)..(349): n is a, c, g, or t
  modified_base (355)..(355): a, c, t, g, unknown or other
  misc_feature (355)..(355): n is a, c, g, or t
  modified_base (376)..(376): a, c, t, g, unknown or other
  misc_feature (376)..(376): n is a, c, g, or t
  modified_base (397)..(397): a, c, t, g, unknown or other
  misc_feature (397)..(397): n is a, c, g, or t
  modified_base (415)..(415): a, c, t, g, unknown or other
  misc_feature (415)..(415): n is a, c, g, or t
  modified_base (496)..(496): a, c, t, g, unknown or other
  misc_feature (496)..(496): n is a, c, g, or t
tcagagctcacgtacacgaccggtgctcgatttagagagcgtcacagagagaaggggctcagagaggagccttagccctggactccaaggcctttccacttggtgatcagcactgagcacagaggactcaccatggaattggggctgagctgggttttccttgttgctattttagaaggtgtccagtgtgaggtgcaattggtgcaatctgggggaggcttggtccagccgtggggggtccctcagactctcctgtgcagcctctggattcacctttagttcctcttggatgtaattgggtccgccagacctccgagggagggctggagtgggtgcaanataancanangacgtnaagaaactatgtagactctcngagggcattcacatctcaganaccgacacgaagaccttntactcgtttcacgtacaaaggtgactcgacctggaagacgtacgaaacgacgaacgggtcttacggtgttaactacggttntacggttcgtctacgttaccgggccgtcccgtaccgggtacccggtccgtttcgggaccttccgggg

SEQ ID NO: 136557 - DNA, 664 bp, Homo sapiens
  misc_feature: GYAE6OF02HPNSS.47.48.E04.1.454.CMB.1.raw
  modified_base (459)..(459): a, c, t, g, unknown or other
  misc_feature (459)..(459): n is a, c, g, or t
  modified_base (506)..(506): a, c, t, g, unknown or other
  misc_feature (506)..(506): n is a, c, g, or t
tcagagctcacgtacacgaccggtgctcgatttagagagcgtcacagagagaagggggaggtctcagagaggagccttagccctggactccaaggcctttccacttggtgatcagcactgagcacagaggactcaccatggaattggggctgagctgggttttccttgttgctattttagaaggttgtccagtgtgaggtgcaattggtgcaatcgtgggggaggtcttggtccagccgtggggggtccctggagctctcctgcgcagcctcgtgattcctcctttagtagttatcgccagtgtacgttcgggtcccgccgacggcctccggagggggaacggggcgttgggaggttggggtcctacgagggtctagttgggtgggtaggtgggtcgccgaggacactaagttaaccggtaaacgttcccgtgaccgagggtccgtatttcttttaacncctccgaagtacgacctaattccgaggtaaactattacttgatttcngacgtaggttacgaacctagtacgtagacgtacgggttacggaacggtaccgtaccgggtaccgttaatttagtttaagtttaggttaaggttaaaggtgggtagttgggtacggtaccgttaacggaccgtttcgggtaccggggggtaaccccggg

SEQ ID NO: 136558 - DNA, 616 bp, Homo sapiens
  misc_feature: GYAE6OF02IZ3TB.47.48.E04.1.454.CMB.1.raw
  modified_base (502)..(502): a, c, t, g, unknown or other
  misc_feature (502)..(502): n is a, c, g, or t
  modified_base (525)..(525): a, c, t, g, unknown or other
  misc_feature (525)..(525): n is a, c, g, or t
tcagagctcacgtacacgaccggtgctcgatttagagagcgtcacagagagaaggggaggtctcagagaggagccttagccctggactccaaggcctttccacttggtgatcagcactgagcacagaggactcaccatggaagttgggctgagcttgggttttccttgttgctatttagaagtgtccagtgtgaggtgcaattggtgcaatcgtgggggagtcgttcggtccagccgtgggggtccctcagctcctccgtgtcgcacgcctctggtacttctacctttacgttcctcgttgatagtacgttcggtccgccgtacgacgtaccggaaggggaacggggtctagggtagggttgggttacggacgtaaacgtaactaaacgtaccgaagtaaggtaggaacgttacaaagtaaaacctagtcgtaggactactacgtaggaacggtcctatccacatccacagacgaacaaccgacaagactcgtctgtttacngaactaagtgacacgtctagganacgtagaaacgtcgaagtcgttagtagttaacttcggtagtcgtcgtcttacgcggtccgtccgtccggccggttaccgttcggttacccg

SEQ ID NO: 136559 - DNA, 784 bp, Homo sapiens
  misc_feature: GYAE6OF02HNWO5.47.48.E04.1.454.CMB.1.raw
  modified_base (269)..(269): a, c, t, g, unknown or other
  misc_feature (269)..(269): n is a, c, g, or t
tcagagctcacgtacacgaccggtgctcgatttagagagcgtcacagagagaaggggaggtctcagagaggagccttagccctggactccaaggcctttccacttggtgatcagcactgagcacagaggactcaccatggaattggggctgagctggtttccttgttgctatttagaaggtgtccagtgtgaggtgcaattggtgcaatcgtgggggaggcttggtccagccgtggggggtaccctcgagactctcctgtgcagcctgnggtacttcctaccttttagtccttcgtggataggtaagttcgggtcccgccgagtaccgtccgagggggaacggggtcgtagggacggttggggttcggacgaacctaagttaaacctccgaaggtacgtagggaaacgtcgtaaacgtaaaaccgttagttcggtaggtaaccttacgtacgttacggggaacggggtccctaacgtttaccccgaacctacgttaccctaccgaacggtaacgaacccgtaaacggaccccaaaaggttaacccgttaccttccgtttttacgttaccgttactaaccggttaaaggtaccgggtaaacgtaccggtcccctaaaggggtaccgtaaaccgggttaaccgggaaacggtaacccgtaacgggttacctttagggttaacgttttaaccggtttaacgttggtttcggtaccgtttacggtccttacggtaaccccggtccgttaccccgggggtcccggttacccggttttgggttaccccgg

SEQ ID NO: 136560 - DNA, 768 bp, Homo sapiens
  misc_feature: GYAE6OF02H5APE.47.48.E04.1.454.CMB.1.raw
tcagagctcacgtacacgaccggtgctcgatttagagagcgtcacagagagaaggggctcagagaggagccttagccctggactccaaggcctttccacttggtgatcagcactgagcacagaggactcaccatggaagttggggctgagctgggttttccttgttgctattttagaaggtgtccagtgtgaggtgctaattggtgcgaatcgtgggggaggcttggtccagccgtggggggtccctcagctctctgtgcacgcctcgtggtattctaccttttagttccttgtttcggatacgtaagtttcgggtacccgacaggtacccgtaccggaggggtaacgggggtcgttaggggtacggtcggggtttacggaccgtaaacgtaattaaaccggtcccaaggtaaggtacggaaacggttccaaaaacggtaaaaccttagtagggtaacggtaccttacgtccggtacgggtaacggggtacccgtagttaccccgaaccgtacgtttccgaccgtaaggtacgaaccgtaacccgtaccgaaacgtaaccttccgttacggttacgtttcgacgtacgtaaacgtcgaaccgtaccgggtacgttacgggaacgtaccggtaacggtaaacgacggttaaccgggcttttagggactttaacgtttacggtggtttcgttaccgttcggtttaccgacggttacccggtcccggttacccggggtaccccgggtacctttcgggacccgtttccgggg

SEQ ID NO: 136561 - DNA, 735 bp, Homo sapiens
  misc_feature: GYAE6OF02JZG9D.47.48.E04.1.454.CMB.1.raw
  modified_base (170)..(170): a, c, t, g, unknown or other
  misc_feature (170)..(170): n is a, c, g, or t
  modified_base (228)..(228): a, c, t, g, unknown or other
  misc_feature (228)..(228): n is a, c, g, or t
  modified_base (265)..(265): a, c, t, g, unknown or other
  misc_feature (265)..(265): n is a, c, g, or t
tcagagctcacgtacacgaccggtgctcgatttagagagcgtcacagagagaaggggaatcagtcccactcaggacacagcatggacatgagggtccccgctcagctcctggggctcctgctgctctggttcccaggtgccaggtgtgacagtccagatcgacccagtcnccatcctcctgtcctgctatcgtgtaggagactaggcgtcaccatcacttggccgggnagtcgagggtcttagctaatgcttggccgttgttacngcagtacacggaggacggcccgtacgccgctgacgtctagtcgtagctacgtacttactttgaacgtaaggtccggggtacctagttaccgtaacggtttcccgaaggtacccggtaagtacggtttacggggtaccgtacgggggtaaacgtaggtttaccgggttaccctacgttaacccttccggtaattacccggtttaaccggaccgggttacccgggccctttacgggaccgtttacccgggaccgttaaggtaaacggttcccttttaacgccgttaaaccgtttagtttaacttttacccgtacggttacctttaccggagtttacggttcggaacttttcgggtaaaccctttccgggtaacgtttacccgttagggtaacccgtaagggacccggttaaggtaacgtaaaccctaggtaaaccgtcgttacgggtaccgtacgtggtaccctaaccgtcg

SEQ ID NO: 136562 - DNA, 784 bp, Homo sapiens
  misc_feature: GYAE6OF02I642T.47.48.E04.1.454.CMB.1.raw
tcagagctcacgtacacgaccggtgctcgatttagagagcgtcacagagagaaggggaggaatcagtcccactcaggacacagcatggacatgagggtccccgctcagcctcctggggctcctgctgctctggttcccaggtgccaggtgtagacatccagatgacccagtctccatccctccctgtctgctatctggtaggagacagacgtccaccactcctacttcggcccgggcgacggtcgagggtcgttgacaaatgtcgtttggtccgttggtttcacgctagacgaccgagggacgaccccgtaagaccgccgtagactcgtagtgtacgcaagttactacgtttagactaaacgggttcgggtacccctagtacgtaacggttccacggtcggaccgaaggttcgggtaccggttacgggaacgtaacggtacggtttaccaaccgttcgtacccaaccgtttactaccggtacggtcccgggtaccggttacgaccgacgggtacccgttaaggaaacggttttacgttttcgtaacctttaaccgttttaacgtttaccgtttacgtttacccgttaacgtacggtttaacgttacttacggtttacggttacccctttaaccccggtttaccgggtttaaccccgggttttcggaaccccggtttaaccggggaaaccggtttaaacggggtacggttaaaccggtaaaccgttaaaccgggaaccgttacgggttaccggtaccggttccgtaacccgtacccggtttaccg

SEQ ID NO: 136563 - DNA, 859 bp, Homo sapiens
  misc_feature: GYAE6OF02IB1IU.47.48.E04.1.454.CMB.1.raw
tcagagctcacgtacacgaccggtgctcgatttagagagcgtcacagagagaaggggctcagagaggagccttagccctggactccaaggcctttccacttggtgatcagcactgagcacagaggactcaccatggaattggggctgagcttggttttccttgttgcttattttagaaggtgtccagtgtgaggtgctaattggtgcaagtcgtgggggaggtcttggtccgaggccgtcgggggggtcccctcgacgtacctcctccgtgtcgctacgcctcgtcggtactttcctaccttttacgttccttcgtttaggtaagttggtaacgttttcgggggtcccgtaccgtaacggtaccgttaccggaagggggaaacgggggtccgttaggggtacgggttagggggttttcggaaccgtaaacgtaaacttaaaacgttacccgtaaggtaggttaacgggaaaacggttaccgaaaacggtaaaaaacccttaggttaggttacggaaccgtttccgttacggttaacgggaaccgggggttaccctagtttacccgtaacccctaacgtttcccgtaacccgtaaaggtacgaaacccgtaaaccggaccgaaaacgttaaacccttacctttccgttacggttttacacgttaacgtaaaacgttcggtaacgtaccgtaccgtaggtaaacggacggttaaccgaaacggtaccaaccggggttcttacggtttacgtttaaactttaccgttcgggttaacgttcggttcccgttacgttcggaacccggttcccggttcccgggtaccccggtttacgtttaccgggttccgtttaccccgggggg

SEQ ID NO: 136564 - DNA, 743 bp, Homo sapiens
  misc_feature: GYAE6OF02FJLI0.47.48.E04.1.454.CMB.1.raw
tcagagctcacgtacacgaccggtgctcgatttagagagcgtcacagagagaaggggaggaatcagtcccactcaggacacagcatggacatgagggtccccgctcagctcctggggctcctgctgctctggttcccaggtgccaggtgtgacatccagatgacccagtctccatcctcctgtctgcatctgtagaagacagagtcaccatccacttcggccgggcgagtcgaggggtagttggacaaagtgtcttttagggccgtttaggtttccagctaagaccgaacccgaaggggaacggacccccgtaaaggcccggaccgtagtaacgttctaggttcggtcgactacgtaacctactttcgacgtaaagggtcgggtaccccagtacgtaacggttacgaggccggtactaacgggttacggtccgtaggggactaggtagttaccgtacttactactactactaccgacggtccggtaccttacgccgtaacgtacccgttaggaaacgttacgtttaccgtacttaccgttaaacctttacgtttaaccgttacgttacccgtttacgtaacggtttacgttacggttaccttaccggttacccgttaacccggttaccgtttacccggtttaccgggacccggtaaaccgggggtaccgtaaacggggttaaccgaaaaccgttaaccgtaaacggtaacgttacggtacggttacctacggaccttaacccg

SEQ ID NO: 136565 - DNA, 767 bp, Homo sapiens
  misc_feature: GYAE6OF02I4VVN.47.48.E04.1.454.CMB.1.raw
tcagagctcacgtacacgaccggtgctcgatttagagagcgtcacagagagaagggggaatcagtcccactcaggacacagcatggacatgagggtccccgctcagctccgtggggctcctgctgctctggttcccaggtgccaggtgtgacatccagatgacccagtcctccatcctccctgtctgaccattctgtaggagacagagtcaccatcacttcggccgggacgagtcgagggtcgttcgacgtaaagtcgtcgttttgggcccgttaggggttttccaacggtacgtaacggtaaccgtaacccggaaacgggggtaaaccgggaaccccccgttaaaacggcccggaccggttacgtaaacgttcgttaaacggttcgggtacgtaccaaacgttacccgtaacgttttcgaacggtaaaacggttcgggggtaccctaagttaacgtaaacggttacgaacgggttaccggaacgtacggtaacgggtccgttacggggaccgtaaggtacgtttaccgtaacgttccgtactaacgttacgttacgacgacccggtcgtacgaccgacgtaccgtacggtaagtacgttacgcggtaacctactttagttacttcgttacctactaaacgttcgttacgtagttcgtacctttacccggtcgttaccgttacggtaccggaaacgggtaacggtaaccggtagtaaaccgtaagtaaaccgacgttacgggaccgttaggtcgtacgtacctaacg

SEQ ID NO: 136566 - DNA, 753 bp, Homo sapiens
  misc_feature: GYAE6OF02JQKF7.47.48.E04.1.454.CMB.1.raw
  modified_base (202)..(202): a, c, t, g, unknown or other
  misc_feature (202)..(202): n is a, c, g, or t
  modified_base (229)..(229): a, c, t, g, unknown or other
  misc_feature (229)..(229): n is a, c, g, or t
  modified_base (374)..(374): a, c, t, g, unknown or other
  misc_feature (374)..(374): n is a, c, g, or t
tcagagctcacgtacacgaccggtgctcgatttagagagcgtcacagagagaaggggaggaatcagtcccactcaggacacagcatggacatgagggtccccgctcagctcctggggctcctgctgctctggttcccaggtgccaggtgtgacatccagatcgacccagtcctccactccctcctgtctgcatctgtagganacagactcaccatcacgttcgccgggngagtccgaggggtcgttgacaagtgtcgttggccttggttcagcagacaccgaggacgaccccgtaagccgtccgtgactacgtagtggtacactatactacgtttacgacgtaaacggtccggtaccaagtacgtacgttacgngtacggagtacggtgtcgtacggacgtagggtacttacgccgttacctacgtaactacgttaccggacggccggtacctagaccgtacgtaccgtaaggtaacgttcgtttaccgtacgttaaccttaaaccggttttacttaccgtttaccggtttcccttaaccggttaaaggtttaccgttaacgggttacgtttaccccggttaacccttttaaccccggggttacgggttttacccccgggttaacggttaacccccgggtaaaaccggggttaaacccgggtaaaggggtttaaaccggtaaacgttaaacccggttaaaccgggtaaccggttacggttaccgggttaccgtaaccggtacgttaaccccgg

SEQ ID NO: 136567 - DNA, 765 bp, Homo sapiens
  misc_feature: GYAE6OF02GNDWN.47.48.E04.1.454.CMB.1.raw
  modified_base (197)..(197): a, c, t, g, unknown or other
  misc_feature (197)..(197): n is a, c, g, or t
tcagagctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtagganacagatccaccatcacgttcggccgggcgagtcgaggggtcgttagacctaaagtcgtcgtttggccttggtttcagcagaccaccgagggacggacccctaagccgtcctgactctagtggtgcatactactttgacgtaaaggtcgggtaccctagtacgtaaggttccaggcggtacgtaggttacggtaccgttaggggaacgtaggtacgtttaccgacgttactaccgtacttactcgacgggtcccggtccgtacggaccgtaccggtacccgttaagggtaaacgttaccgttttacccgtacgtaaccctttaaaaccttttaaccgtttacccggttcgttaacccgtttacccgtaagtttaaccggttacgttaaccgtttccggttaacccccgtttaacccggttacccgggtttaacccgttttaccccggggaacccggttaaaccgggggtaacccggtaaagggttaaccggtaaaacgttaaaccggtaaaaccggttaacggttacgggttaccggtaccgttaccggtaacccctaccgttaaccgg

SEQ ID NO: 136568 - DNA, 699 bp, Homo sapiens
  misc_feature: GYAE6OF02J2M5K.47.48.E04.1.454.CMB.1.raw
  modified_base (158)..(158): a, c, t, g, unknown or other
  misc_feature (158)..(158): n is a, c, g, or t
  modified_base (277)..(277): a, c, t, g, unknown or other
  misc_feature (277)..(277): n is a, c, g, or t
  modified_base (568)..(568): a, c, t, g, unknown or other
  misc_feature (568)..(568): n is a, c, g, or t
  modified_base (623)..(623): a, c, t, g, unknown or other
  misc_feature (623)..(623): n is a, c, g, or t
tcagagctcacgtacacgaccggtgctcgatttagagagcgtcacagagagaaggggaatcagtcccactcaggacacagcatggacatgagggtccccgctcagctcctgggctcctgctgctctggttcccaggtgccaggtgtgacatccagatnacccggggggatctccatccctcctgtctgctagtctggtagacgtacagatcgaccatctacgtcgccggcgagtcgagggtccgttgacaaagtctccgttaggccttggttcacgntacgaaccgaccgagggtaccgacccgtaaggccgtaccgtgacgtacgttagtgggtcgtacctaacgtactaaccgtttagaaccgtaacgggtccgggtacctagtaccgtaaggttccgagccggtaagtaacgggtgtccggtaggaccgtacggacgtttaccgtactctaactacgttactaccggaccgtcggttccgtagacccgtaacggtcccgtaaaggtacgttaacgtttcccgaagttaccctaaacctttacggtttcacgttcctagttacgtntaccggtataccggtccttaacccgtacggtccgttaccgggtactaaacccggnggttaaacggtacgaaacggttaccgaaacggttaccgtcggtaaccgtaccggttcctaccgtaaccgttaaccg

SEQ ID NO: 136569 - DNA, 769 bp, Homo sapiens
  misc_feature: GYAE6OF02G1DZ5.47.48.E04.1.454.CMB.1.raw
tcagagctcacgtacacgaccggtgctcgatttagagagcgtcacagagagaaggggaggtctcagagaggagccttagccctggactccaaggcctttccacttggtgatcagtcactgagcacagaggactcaccatggaagttgggctgagcgttcgggttttccttgttgtcttattttagaaggtgtccagtggtgaggtgctaagttggtgctaagtcgtgggggacgtacgttcggtccgacggccgtcgggggtcccctcgacgacctcctccgtgtcgccacggtcctgtggtacttcctaccttttacgtcctcgttaggtacttacggtaacggttcgggtcccgtaccgacggtaccgtaccggtaaaggggtaacggggtccgtaggggtacggttcggggttacggaactaacgtaaacgttaaaccgtacccgaagtaacggtacgggtaacgtacgaaaacggtaaaccgtagtacgggtcgtaacttcgtacgttaacgggtacgggtactactttaccgaaccgtagttcccgtacggtaaacgtaccggtaaaccaaccggtacgtaaaccgttaccgttacgtttacgttacggtttcaacggtaacgtaaacgcggtaaaccgacgtaccgtaaggaacgtagttaaccgaacgttaaccgacggttcgtagttacgttactacggttggtaccgtacgtctcggaccgtaccgtccggttaccggaccgtttacgtcggttaccggg

SEQ ID NO: 136570 - DNA, 550 bp, Homo sapiens
  misc_feature: GYAE6OF02HJ8LN.47.48.E04.1.454.CMB.1.raw
  modified_base (224)..(224): a, c, t, g, unknown or other
  misc_feature (224)..(224): n is a, c, g, or t
tcagagctcacgtacacgaccggtgctcgatttagagagcgtcacagagagaaggggaatcagtcccactcaggacacagcatggacatgagggtccccgctcagctcctggggctcctgctgctctggttcccaggtgccaggtgtgacatccagatgaccctagtctccatcctccctgtctgcatcgtgtaggagacagacgtcaccatcacgttgccggnagtcaggcgtgcaatgcttgctgttcagcagacacgaggacgccctaagcgcctgatctagtggtgcaatactacttgactaaaggtggggtaccctatacgtaaggttcacggcggtacgagtaggcgttgggacagacgtttcgactcgtacactatcagaccgtctgcagcctagagacttctagactaactttatacttgtaccgtctagtactagtacttcgtcttacccgtcggtaaccttcggaacgtacgggacgtaaacgggtcggtaaaccgtacgtaaaccggtacgtacggtcggtaccgtcgacgtcctaacg

SEQ ID NO: 136571 - DNA, 838 bp, Homo sapiens
  misc_feature: GYAE6OF02GR51W.47.48.E04.1.454.CMB.1.raw
  modified_base (209)..(209): a, c, t, g, unknown or other
  misc_feature (209)..(209): n is a, c, g, or t
tcagagctcacgtacacgaccggtgctcgatttagagagcgtcacagagagaaggggaggaatcagtcccactcaggacacagcatggacatggagggtccccgctcagctcctgggctcctgctgctctggttcccaggtgccgaggtgtgacatccagatcgacccagtcctccatccctcccttgtctgctatcgtaggtacgganaccaggactaccaacctagtcctacggttcgggccgggtcgaacgtccggaggggtccggtttacgacaaagtcgtcgtttcggtccgtttcggttacaggccgaacgaaccaacccggtaacggggaaccggtacccccgttaaacggccggtacccgtacggtacgttaccgttaggtacgggttcacgtaacttacgttaccgtttaggaccgtaaacggtccgggtaccaacgttacgtaacggttacgacggtcggtacgtaaggttacggttacggtacgggtaacggtacgtaacggttcgttaaccgttaccgtacctaccgttaacgtaccggaccggtaccggtcgttaccggaccgtacggtaccgttacgggtaaacgttacgttaccgttaccgtaaacgtttaacctttaacgtttaacccgtacgttacccgtttaccttaacggttacgttacgtaaccggttcgttaacccgtttacccgttaaccggtttacccgggttcccgtaaccgggtaaaccgggttaaaccggaaccgggttaacggaaaaccgttacccgaaaacgggtttaaccgtaccggttaggttacccgtacggttaaccctaacccgg

SEQ ID NO: 136572 - DNA, 730 bp, Homo sapiens
  misc_feature: GYAE6OF02I1IBX.47.48.E04.1.454.CMB.1.raw
  modified_base (251)..(251): a, c, t, g, unknown or other
  misc_feature (251)..(251): n is a, c, g, or t
tcagagctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacactccagatcgaccctagtctccactcccttccctgtctgcctatctgtaggagacagacgtcaccatctacgtcggccggcgacgtcgacgggtcgttnacgtaaagttcggtccgtttcggccgtttcggtttcacgtaccaagaaccaaccgggaacggggaacccggtaccccctaacggccgtccgttaggaaccttccgtaagttcgggacgtctaacttaccgttaccgttacgacgtaaacgggtccgggtacctacgtaacgttaacggtccgaggtaccggacgtaacggttaggtcgtagggacctaggtcgttccaccgtcctaactactctacgccggaccgtcctacggcaccggtaccgtacgtaacgtattaccgtacgtaaccttaacttaccgtttacttccgttaccgttaccgtagttactagttaccttacgtcccgtttaacccgtccgggttacccgttaccggtaccggttaaacgggaaccggttaacgggtaaacggtaaacgtaacccgtaaaacggtcggttacggtagttccgacgtaccgacgttaacc

SEQ ID NO: 136573 - DNA, 902 bp, Homo sapiens
  misc_feature: GYAE6OF02GKRSV.47.48.E04.1.454.CMB.1.raw
tcagagctcacgtacacgaccggtgctcgatttagagagcgtcacagagagaagggggccttagccctggactccaaggcctttccacttggtgatcagcactgagcacagaggactcaccatggaattggggactgagctgggttttccttgttgctatttagaaggtgtccagtgtgaggtgcaattggtgcaatcgtggggaggcttggtccagccgtggggggtccctcagactctccgtgtgacacgtcctctggattctacctttagttcctcttcggtatacgaagttcgggtccgccgtaagtaccgtacccgaagggggaaacgggggtccgtagggtaggtgggggttcggtaccgaaacgtaagttaaaaacttccgtaaaggtaagttacgggtaaaacggttaccgaaaggtaaaaaacccgttaagtacgggtaacggtaacctttaccgtacgttaacgggaaacgggggtacccgttaaacgttaccaaaccctaactttcccgtaaccgaaggtaaacggtaaacccaacccggtaaccccgtaaaacgaaaccgttccgtaaccgtttaggttttaacccgtaggaacttaaaaacgtgggtaaacccacggttcccggtaagaacgggtaaccgtaaggaaacgggtaacccgtaacggggtacctttagggttaacgttttaaccgtttaaacggtttcggggttaccggtttacgttaccgtttacgggtaaccgggtaacccggtacccccgggtttacccggggtaaccccgggtttacccgttttacggggggttaccctttttaccggggccccggggggggttttaacccgtacccgggggttaacccccgggtttagggtttaaccccccccggg

SEQ ID NO: 136574 - DNA, 865 bp, Homo sapiens
  misc_feature: GYAE6OF02IQY84.47.48.E04.1.454.CMB.1.raw
tcagagctcacgtacacgaccggtgctcgatttagagagcgtcacagagagaaggggaggtctcagagaggagccttagccctggactccaaggccctttccacttggtgatcagcactgagcacagaggactcaccatggaattgggctgagctgggttttccttgttgctattttagaaggttgtccagtgtgaggtgcaattggtgcaatcgtgggggaggcttggtccagccgtggggggtccatcagactctcctgtgcagcctcgtggtacttcctaccttttagttccttcgtttggattggtaagtttcgggggttcccgcctaaggacccttccggaagggggtaaacggggtccgttggggagggttacggggggttacggaccgaaacgtaacttaaaactcccgaaggtagtacgggaacgttacgtaaacggtaaaaaccgtagtaggtacgggtaaccttccgttacgtagggtaaacgggggtccccgtaaacgtttcccgaaaccctaacgttcccgtaacccgaagggtaaccgaaacccgtaaaacccggtacccgtaaaaccggtaaaccctttaccctttaccgtttaccggttttttaccctaaggttaacccgttaaaacgttacgggaaacccgtacgtaccccggttaagggaaaccggttacgggtaaacccggtaaacggaacccggtacggggtacccgtttaggtttacggtttaacgttttaacccgtggggtttttcccgttacggtttacccgtttcccgggttaaccggttaccccggttaccccgggttaccccggggttaccccgggggttaccccccgttttaccggggg

SEQ ID NO: 136575 - DNA, 841 bp, Homo sapiens
  misc_feature: GYAE6OF02HDSYJ.47.48.E04.1.454.CMB.1.raw
  modified_base (190)..(190): a, c, t, g, unknown or other
  misc_feature (190)..(190): n is a, c, g, or t
tcagagctcacgtacacgaccggtgctcgatttagagagcgtcacagagagaaggggaatcagtcccactcaggacacagcatggacatgagggtccccgctcagctcctggggcctcctgctgctctcggttcccaggtgccaggtgtgacactccagatcgacccagtcctccactccctcctgtctncacttcgtgtaggagaccgagtacgtaccaacctacgtacgtaccgttcgggcccggggtacgtaacgttccggaacggggttccggttacggtactaaaaggttcgtttccggtttcggtacccggtttcggtttccgacggtaccgaaacggaacccggaaccgggtaacggggaacccggtacccccgtaaacggtcccgtacccggtagtaaccgttccgttacggtcggttacgtaccgtaaacctaccgttacgtttacggaacggtaaacgggttccgggacccttaagtaaccggtaacggttacgacggtcggtacgtagggtacggttacgacgggtaatacggttaccgtctaccttcaccgtaccttaagccgtacggtccgtcggacgcgttaaccgcggttaacgtaacgttccttaaacggtccgtaaaccttaagttttaaccgttaccttacgttacccgtcgtttaacttaggttaccgtacgtttaaccgttcccttaaccggttaccgttaaccgggtttacccggaaccggttaaacgggtaccggtaaacggttaaccggtaaaccgtaaaccgggtaacgttaaccgttagggttacccgacccttaggtacccgttacgttacccgg

SEQ ID NO: 136576 - DNA, 637 bp, Homo sapiens
  misc_feature: GYAE6OF02HCCFO.47.48.E04.1.454.CMB.1.raw
tcagagctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatccctccctgtctgcatctgtaggagacagagtcaccatcacttcggccgggcagtcgagggtcttagactaaagtgtctttcggtccttggtttcagcacgacaccggaagggaaccggacccctaagccgccgtagacgtactagtcggtgaccgtacttacctactttacgaccgtaaacggtccgggtaccctagtaccgtaacggttcgaggtcggacgtaaggttacggtcgtagggaacctaggtacgttccgtactctactactacgtcgacggtccgctcgactacgtcgtagtaaagtcttacgtagtaccttaactttaccgtttatccgttcctaaccgtagttactgttactccgttaccttacccgtcgttccgttaccgggaccgtaacgggaccggtaagttacggaaactaccgaaagtacgttggtacgtcgtacgtacctagtacg

SEQ ID NO: 136577 - DNA, 725 bp, Homo sapiens
  misc_feature: GYAE6OF02JCZMY.47.48.E04.1.454.CMB.1.raw
tcagagctcacgtacacgaccggtgctcgatttagagagcgtcacagagagaaggggaggtctcagagaggagccttagccctggactccaaggcctttccacttggtgatcagcactgagcacagaggactcaccatggaattggggctgagctgggttttcctgttgctattttagaaggtgtccagtgtgaggtgcaattggtgcaatctgggggaggcttggtccagccgtgggggtccctcgagacgtctcctgtgcagcctctggattcgacctttagttcctcttggtatgaagttgggtccgccagacctccggagggacgggtctgggaggtgggtttggcaacgtataaatcccgaagattgggaagttccgaaggtaaaacctagtcgtacggtaacctcgttacgtacggtaacggggtcccgtaatttcccgaaccctagtaccctcccgaagaacggtaaccgaacccgtacccgaaacggttaactcccgttacgttacggtttacctaacggtccgaaaacgttcgggaaccagggtacccctaggtaacgggtaacggttaacccggaaacggtaaccgaccgggtacccgttagggttacgtttaacggtttaaccgttggttaggttacccgggtactttacccggtacggttaacccggtccccggttaccggggtaccccgttaccggttccgggtttacccgg

SEQ ID NO: 136578 - DNA, 722 bp, Homo sapiens
  misc_feature: GYAE6OF02IQ8NG.47.48.E04.1.454.CMB.1.raw
  modified_base (202)..(202): a, c, t, g, unknown or other
  misc_feature (202)..(202): n is a, c, g, or t
tcagagctcacgtacacgaccggtgctcgatttagagagcgtcacagagagaaggggaggaatcagtcccactcaggacacagcatggacatgagggtccccgctcagctcctggggctcctgctgctctggttcccaggtgccaggtgtgacatccaagatgacccagtctccatcctcctgtctgctatcgtagtagganacgagacgtccaaccatcacgttcggccgggcgtagtcgagggtcgttgacaaatgcgttttcggccttggtttcacgcgtagaccaccgaagggaaccggccccgtaaggccgccgtgactctacgtggtcgacgtacttacgtacgtttacgacgtaaaggtcgggttacccagttacgtaacggttcgacggcggtacgtaagggttacggtacggttggggaactaacgggtacgtttaccgtaaccttcgttaaccaacgttaactaccggacggtcccggcccgttaggcccgtaacggtcccgttaggtaaagttacccgtttagtacgtaaccttaaaccttttacgttaaccttcgtttacccgtacgttaaggttatcgttaacgtacgttaccgttacccgttaaccgggttccgtttaccggacccgggtaaacggtaacccggtaagggtaacgtaaaccgttaacgaaaccgtaacggtcggtacgtacgtaccggacctaacccg

SEQ ID NO: 136579 - DNA, 769 bp, Homo sapiens
  misc_feature: GYAE6OF02I2A20.47.48.E04.1.454.CMB.1.raw
tcagagctcacgtacacgaccggtgctcgatttagagagcgtcacagagagaagggctcagagaggagccttagcccctggactccaaaggcctttccacttggtgatcagcactgagcacagaggactcaccatggaattgggctgagcgtggttttccttgttgcttattttagaaggtgtccagtgtgaggtgcaattggtgcaagtcggtgggggagtcgttggtccgacggtcccggtcggggggtcccctcgacggaccttccgtccgtgtcgcacgtccctccgttggtacttcctaccgttttacgttccttcgttggtattgtaacggttcgggtcccgacctacggaccgtccggaaggggtacggggcgtgggtaggttgggttggaccgaacgtaataacgtaccgagaagtaggtaacgtacgtaaacgtaaaacgtagttaggtacggtactcgtacggtacgggtaacggaccgtacgttacccgacctaacgttcctaccggaacggtaaccgaacccgaaacccggaaccgaaaccgttaaccttacgttaccgttttcgtttaccgtaccgtagtaaaccggtacgccgacgtccgagggtaacggtacgtaacggaaaccggtcggaccgttggtacgttacgttaacgtttacggttggttaccggttcttaccgttaccgttacggtaccccgttcgggttccccgggtaccccggttacggttttcccggccggttttacccggggg

SEQ ID NO: 136580 - DNA, 770 bp, Homo sapiens
  misc_feature: GYAE6OF02ISSGV.47.48.E04.1.454.CMB.1.raw
tcagagctcacgtacacgaccggtgctcgatttagagagcgtcacagagagaagggggccttagccctggactccaaggcctttccacttggtgatcagcactgagcacagaggactcaccatggaattggggctgagctgggttttccttgttgctattttagaaggtgtccagtgtgaggtgcaattggtgcaatcgtgggggaggcttggtccagccgtgggggtccctcagactctcctgtcgcagcctctggtattctacctttacgttccttcgttggattagtaagttcgggtcccgccacgacttcccgaagggggtaacgggggtcgtaggggaggttgggggttcggaccgaaacgtaacgttaaaacgtcccgaaggtaacgtagggtaaacgtacgaaacgaaaaacccgttagtacggtaggtaccttacgttaccgtagggtaaacgggcccgtaagtttacccgaacctaacgtcctacccgagtaacggaaccaaccgaaccaaacgtaaccttccttacttcgtttaccgtagtaacctaaagtcggaacctacgtaccgtagtaacggtaacgtaacggaaacgtaccgtacggtacgttacggttagttacgtttacggtgttcggttactcgttaccgttacgggaacccgtccggttacccgggaccggttaccccggtttaggtacccggtttacggggtacccggggttcccggttaccggggtaccccttcggggttaacccccgg

SEQ ID NO: 136581 - DNA, 744 bp, Homo sapiens
  misc_feature: GYAE6OF02G5K6C.47.48.E04.1.454.CMB.1.raw
tcagagctcacgtacacgaccggtgctcgatttagagagcgtcacagagagaaggggaggtctcagagaggagccttagccctggactccaaggcctttccacttggtgatcagcactgagcacagaggactcaccatggaagttggggctgagcgtgggttttccttgttgtcttattttagaaggtgtccagtgtgaggtgcaagttggtgcaagttcgtggggggaggtcgttcggtacccgaggtcccggtcggggggttcccctcgaggaccttccgtcctggtcgccgacgtccgtcgtacggtacttaccttaccgttttaccgttccttcgttggtagttaggtacggttcgggtcccgtaccgaacgtaccgtaccgggaagggggtacggggtcggttaggggtagggttcggggttacggaaccgtaaacgtaacgttaaacgtaccgtaagtaggtaacggtaacgtaacgaaaacgtaaaccgttagtacggtacgtacgtaccgtacgtacgggacggtaccgtactaccaacctactaccgacgacgaacgaaccaaccgtaccgaaacgtaccttccgttacgttcgttactacgtaacgtaacgtcgaacgcgtacgtaggacgtacgtaacgaacgtacgtacggtcgttagttagttacgttgttcgttgtcgttcgtaccgtaccggtaccggtccgtacccggtcccggttcgttccggtcgg

SEQ ID NO: 136582 - DNA, 702 bp, Homo sapiens
  misc_feature: GYAE6OF02JAVSP.47.48.E04.1.454.CMB.1.raw
  modified_base (168)..(168): a, c, t, g, unknown or other
  misc_feature (168)..(168): n is a, c, g, or t
  modified_base (200)..(200): a, c, t, g, unknown or other
  misc_feature (200)..(200): n is a, c, g, or t
tcagagctcacgtacacgaccggtgctcgatttagagagcgtcacagagagaaggggaggaatcagtcccactcaggacacagcatggacatgagggtccccgctcagctcctggggctcctgctgctctggttcccaggtgccaggtgtgacatccagatcgacccngtctccatcctccctgtctgcatctgtagganacagacgtcaccatccacgttggccgggcgagtcgacggtcgttgaccaaatggtctttggtcctttgttcagtcagacacgaggacgcccagcgctgactcgtagtggtcgatactaccttactttcgacgtaaaggttccgggtacccctagttacccgtaaaggtttcgacggtacgggtctaagggttacggtacggtaggggtaccgtaaggttacgtttaccgaacccgttcgttaaccacgttaactcggtaccggtaccggtccgtcgtaccgaaccgttcccgtaaggtaaacgttactttccgaacgttacctaaagttttaccgttacgttacgttcccgtaccgttaaggttatttacggacttaccgttaaccgtttccccggttacgttacccggttttcccggaaaccggttaacggtaaccggtaaggtaacggtaaagtacccgtaaaacggttcgtacggttacgtacgtaccggccttaaccg

SEQ ID NO: 136583 - DNA, 897 bp, Homo sapiens
  misc_feature: GYAE6OF02HMVCY.47.48.E04.1.454.CMB.1.raw
tcagagctcacgtacacgaccggtgctcgatttagagagcgtcacagagagaaggggaggaatcagtcccactcaggacacagcatggacatgagggtccccgctcagctccgtggggctcctgctgctctcggttcccaggtgccaggtgtgacatccagatcgacccagtctccactccctcctgtctcgcatcgtggtaggacgacaggacttaccgacctactaccaaccgttcgggacccgggtcggtacggtacggtacggggtcgttggacctaaagttcggttaccgtttcgggtcccttaggtttaccgacgtaccgacgaaccgaacccggaacggggaacccggtaccccgtaacggtcccgaccgtacggtacttaccgtaggtcgggtacaccgtaactaccggttaacgtttacggaaccgtaaacggggttccggggtaccccctaagttaccggaaacggggtttccaaccggggtccgggacgttaaaccggggttacgggttcccgggaacgggggtaccgtaaacgggtttaccggttaccccgtacgtttacccgtacctaaacggttaaccccgttgggaacccgggttcccgggtaccgttacgggaaccgttaacccgggtaccggttaaacgttaaaccggtcgttttaaacccgggtctaaaacccgttttaactttaaccccgggtttagttaaccggtacccttaaccgggttacttaacgtcgttaaaccgttccggtaacccggttttacccgtaccgggtttaccgggttacccggaacccggggtaaacggtaaccgggtaaacgttaacgtaaaccggaccgtaaaaggtccggttacggtaccgccggtttacacccgttaacg

SEQ ID NO: 136584 - DNA, 631 bp, Homo sapiens
  misc_feature: GYAE6OF02F9BYV.47.48.E04.1.454.CMB.1.raw
  modified_base (451)..(451): a, c, t, g, unknown or other
  misc_feature (451)..(451): n is a, c, g, or t
  modified_base (498)..(498): a, c, t, g, unknown or other
  misc_feature (498)..(498): n is a, c, g, or t
  modified_base (616)..(616): a, c, t, g, unknown or other
  misc_feature (616)..(616): n is a, c, g, or t
tcagagctcacgtacacgaccggtgctcgatttagagagcgtcacagagagaaggggaggaatcagtcccactcaggacacagcatggacatgagggtccccgctcagctcctggggctcctgctgctctggttcccaggtgccaggtgtgacatccagatcgaacccagtctccatccctcctgtctgcatctgtaggagacaaggctcaccatcacgttcggcccgggcgaaggtcgacggggtcgtttcgaccgaaaatcggtcctttcggccgttggtttcagcagtaccaccgaagggacggacccctaaggccgtcctgtactactactggtcgactatactacgtttgacgtaaaggtcgggtaccctagtacgtaacggttacgacgtcggtacgtacgggttaggttcgtagggactagtacgttacacttcactaactacncgacgcgctcgactacgccgtagacgttactcgtctaactaactttntaacccgttcgttacgtcctagttctacgtacgtcgttaacccttacccgtaccggttaccttaccggaccggtaacgggaaccgtagggtaacgaacttaacggaacgagttacggngtactacgactaccg

SEQ ID NO: 136585 - DNA, 682 bp, Homo sapiens
  misc_feature: GYAE6OF02JIG9H.47.48.E04.1.454.CMB.1.raw
  modified_base (605)..(605): a, c, t, g, unknown or other
  misc_feature (605)..(605): n is a, c, g, or t
tcagagctcacgtacacgaccggtgctcgatttagagagcgtcacagagagaagggctcagagaggagccttagccctggactccaaggcctttccacttggtgatcagcactgagcacagaggactcaccatggaattgggctgagctgggttttcctgttgctatttagaaggtgtccagtgtgaggtgctaattggtgactaagtcgtgggggagtcttacgggtccaggccggttcggggggtccctcacgacctctccgtgtcgtcgacgtccgtcgtggtattccgtaccgttttacgtccttcggttagacttacgtaggttccggtcccgactacgtaccgtcggtaggggtaacgggtcgtacgggtagggttcgggtggaacctaaacgtaattaacgccgtaagtagtaggtaacgtaacgaacgtaaaacgtgtaggtacgtactcgtcgtaggtaacggtacctatacccgactacgttacgcctaaaggaccgtaacgaccgacctaagtaaccttccgttacgttcgttacgactacgtaacgtcgtacaccggtactaggacgtaccgtaagaacctaggccgtacgtntttaccgtatttacggtcgttagtcgtacttcggacgttccgacggttccggtaccgttagttcgggtccttcgggg

SEQ ID NO: 136586 - DNA, 753 bp, Homo sapiens
  misc_feature: GYAE6OF02JVMYF.47.48.E04.1.454.CMB.1.raw
  modified_base (297)..(297): a, c, t, g, unknown or other
  misc_feature (297)..(297): n is a, c, g, or t
tcagagctcacgtacacgaccggtgctcgatttagagagcgtcacagagagaagggaggaatcagtcccactcagacacagcatggacatgaggtcccgctcagctcctgggctcctgctgctctcgttcccgaggtgccaggtgtgacatccgagatcggaccctagtcctaccatcccgttcccgtgtcctgcctatccgtagtaggacgactagtcgtaccacacgtctaccgttgaccggtcgagtcgaggtcgttgactaagtcgcgtttaggtcgttcggttacacgcganacgacccgtaaggggtaaccgtacccgaacggccgtccgtacgtaacgttccgtaaggttggtcgtaacccgttaacgtaacccgttaacggttttcgaaacgggtaaaacgggttcccggggttaaaccctacgtttcgggtaaaacgtttccggtaaccggaccggtccgtaaagggttccgggtttacgacggggtcgaacgttacgtttccgacctacctacgttaactacgttacgacggttaccgtccggtagccggtaagcccggttaaggtacgttaagttccgttacgaccgtttaacgttactttacggtacggttacctaaccggttactacgtacgttaacttcggaccgtttccgtaccggttcgtaccggtaccgaacgggtacgttaacggtgaaaacttcccggaaaatccggtagtacggcgttacgaccttaacccgg

SEQ ID NO: 136587 - DNA, 815 bp, Homo sapiens
  misc_feature: GYAE6OF02HNHRZ.47.48.E04.1.454.CMB.1.raw
tcagagctcacgtacacgaccggtgctcgatttagagagcgtcacagagagaagggggaatcagtcccactcaggacacagcatggacatgagggtccccgctcagctccgtggggctcctgctgctctggttcccaggtgccgaggtgtgacatccagatcgaccagtctccatcctcctgtctgactatcgtggtaaggagacaggtacgtccaccatcgacttcgggccgggagtagtcgagggtcgttagactaaattggtcgtttcggtccgtttacgggtttcaacgtccgaaggaacccgtaaccggaacggggaaaccggacccccgtaaaggcccggtacccgttagtaaaccgttcttaacggttacggtcgtacctaaaccgttacgttaacgtttaacgaacggtaaaacgggttaccggggttacccctagttaccggtttaccgggttacgacggttcgggacgtacggttacggtaacgttacggtacgggtaaacgtaacggtttacttttaccgacgtttaccctaacgtaaccgttaaccgtacgtaacggacctaccgtcccggaagtaccgaacggttaccgttaagaaccggttagttacgttaaccgaactttaactttaacttaaccgtaagtaaaacctaaaacgttaacgttaaaccgtcggtaacccgtcccgttaccgtaccggtttaccggtacggtaccgggaaacgggtttaaccgggaaggttacgggaaacgacgttaaaccggtaaacggacggtttacgtcgggtaccgtacgttaacccg

SEQ ID NO: 136588 - DNA, 781 bp, Homo sapiens
  misc_feature: GYAE6OF02II27N.47.48.E04.1.454.CMB.1.raw
tcagagctcacgtacacgaccggtgctcgatttagagagcgtcacagagagaagggggaatcagtcccactcaggacacagcatggacatggagggtccccgctcagctccgtgggcctcctgctgctcgtggttcccaggtgccaggtgtgacatccagatcgacccagtcctccactccctcctagtcctgactattcgtaggtaaggacgacgagtacgtccaaccattccgtacgttcgggcccgggagtacggtacgaggggtccgtttagacgtaaactggttcgtttacggtccgtttggtttacgacgccgtaagaacccgtaccggaacggggaaccggtacccccgtaaaggtccggtaccttaggacttaccgttagtacggggtacgactaacgttacgttacgtttcggaaccgttaacgggtcgggtaccctagtaaccgtaaggttccgaaggcggtacgtaaggttcgggtacgttaggggaacaacggtttacgttacccgtaacgtttacctaccgtaaccttaacgtacgtacggacccggttcacgtaccgtacgtaccgtaacgtaacgttactttcgtacgtacgttaaaccgtttacgttccgttacgttacccgttacgtaacgttactacgttacgtttaccgtacccgttacccgttccgttaccgttaccggaacggtaaccgggtaacggtaacggtaacggtaaacgtaccgtaaacggtcgttacggtaggaccgtcgaccgtacgtaccg

SEQ ID NO: 136589 - DNA, 587 bp, Homo sapiens
  misc_feature: GYAE6OF02I870V.47.48.E04.1.454.CMB.1.raw
tcagagctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacgttcgccgggcgagtcgagggcttgcaaagtgtcgtttggccgttcggtttcagcagacaccgagggaacggccccgtaagccgcctgacttctagtggtgactaatacctacgtttagactaaaggtcgggtaccagtacgaaggttcacgcgtaacgtagtacggtcgtagggacgagtacgttcactctactactagtccgagccggtctcgcgacgcctaggaacgtacttcgactacttaacttattactcgtacctacgtaagttatacgtatcgtccttaccgtaggtaccgtttacggaccgtaacggggaacctaaggtaggtaaactaccgaaacgtacgtaggtacgcgtacgtccacctacg

SEQ ID NO: 136590 - DNA, 739 bp, Homo sapiens
  misc_feature: GYAE6OF02HO14R.47.48.E04.1.454.CMB.1.raw
tcagagctcacgtacacgaccggtgctcgatttagagagcgtcacagagagaaggggaggaatcagtcccactcaggacacagcatggacatgagggtccccgctcagctccgtggggctcctgctgctctggttcccaggtgccaggtgtgacatccagatcgacccagtctccactccctcctgtctgcatcgtgtaggacacaggactccaccatccacgttggccgggcgagtcgagggtcgttgactaattcgtcgtttcggtccgttggttcagccacgaaccgaccggaacggggaccgtccccgtaagccgccgtagtactcgtagtggtacgactaacgtacctacgtttagacgtaacgggtccggtacccaacgttcgtaaggttacgacggtcggacgtaggtacggtacggtcgggaacaggttacgtacctacgttacctacctaacgttacgtcgaccggtcggaccgtcgaccgtacgaccggttagtaagtccgtttacgtacgtaacctttaacgtttacgttaccgttaccgttacccgtaccgtaacgttaacgttacgtaccgttacccggtaccccgtttacccgttaccgggtttacccgtttcccgggtaaacccgggtaacggggtaaaccccggtaaggggttaaccgtaaaaccgtaaccggtaaaccgtaaccgggttcgggtaccggtacgtacccggtacccgtaaccg

SEQ ID NO: 136591 - DNA, 738 bp, Homo sapiens
  misc_feature: GYAE6OF02G6WK8.47.48.E04.1.454.CMB.1.raw
tcagagctcacgtacacgaccggtgctcgatttagagagcgtcacagagagaaggggaggtctcagagaggagccttagccctggactccaaggcctttccacttggtgatcagcactgagcaaagaggactcaccatggaattggggctgagctgggttttccttgttgctattttagaaggtgtccagtgtgaggtgcaattggtgcaatcgtgggggaggcttggtccagccgtggggggtccctcacgactctcctgtgcagcctctggtattctacctttagttcctcttcggattggaagtttcggggtcccgtccgacggaccgtccggtaaggggaacggggcgtgggaggttggggttgggcaaacgtagtaaaacgtacccagtagtacgggaagtaccgaaacggtaaaaaccgttaagttggtagggtaaccttcgttccgtaggaaaccgggggtaccgtaacgtttaccccgaacctaacgtacccttcccgaaacggaacgtaacccgaaaccggaacccaaaacggtaaaccttcccgttccgtttacgttttcctaagtactaaacgttcggtaacgacgtcccgtaaggaggtaacggtacgaaagacccgaacggtcgttacggtagtttaacgttcggttagttggtttacgttcttcgttacggacccggttcccgttccgggtaccccggtacccgtttgggtcccgtttccgggg

SEQ ID NO: 136592 - DNA, 811 bp, Homo sapiens
  misc_feature: GYAE6OF02IN0NR.47.48.E04.1.454.CMB.1.raw
tcagagctcacgtacacgaccggtgctcgatttagagagcgtcacagagagaaggggaggaatcagtccccactcaggacacagcatggacatgagggtccccgctcagctcctgggctcctgctgctctggttcccaggtcgccaggtgtgacatccagatcgacccagtcctccatcctcctgtctgcatctagtaggcgacagagtccaccatcctacgttcggccgggcgtacgtacgaggggtccgttagactaaagttcgtacgtttacgggcccgtttgggtttaccaacggtaccgtaccggaaccgtaaccccgggaacggggtaaacccgggtacccccgttaaacgggccggtacccgttacggtaaccgttaccgttaaggttcgggtaccgtaccgttaaacgttaaccgttaaccgtttacggtaaccggttaaaacgggggttccccgggttaccccgtaaagttaacccggttaaccggggtttaccggaacgggtaccgggtacggtaacgggtttaccgggttacggtaacggggtaacgtaacgggttaacccgtttaccgtaaccgttacccgttaacctaacgttacggtaccggtaaccggttacccggtccggtaaccgtaccgaccggtaccgttaagggtaaccttgttaccgtacgtaactaacgtttacttacgtcgtactacgtagtactcgtatcgttaccgttccgtacgttacgtacgacggtaacggtaactaaggtaacgtactaacgtaacgtacgtcgacgacttacgacgtaccc

SEQ ID NO: 136593 - DNA, 577 bp, Homo sapiens
  misc_feature: GYAE6OF02GM8MI.47.48.E04.1.454.CMB.1.raw
  modified_base (140)..(140): a, c, t, g, unknown or other
  misc_feature (140)..(140): n is a, c, g, or t
  modified_base (223)..(223): a, c, t, g, unknown or other
  misc_feature (223)..(223): n is a, c, g, or t
  modified_base (298)..(298): a, c, t, g, unknown or other
  misc_feature (298)..(298): n is a, c, g, or t
tcagagctcacgtacacgaccggtgctcgatttagagagcgtcacagagagaagggggaatcagtcccactcaggacacagcatggacatgagggtccccgctcagctcctggggctcctgctgctctggttcccaggtnccaggtgtgacatccagatgacccagtctccatcctcctgtctgcatctgtagagacagagtccaaccatcacttggcccggngagtcagggccttagcaatgcttggccgttggttcagcagtacaccgaggacgccctaagcgctgatctagtgtncatactactttcgacgtaaaggtcgggtaccagtacgaagttcacggcggtactagtacgtcgtaggacgagtacgttcacgttctcgatacgtacacgcgtacctcgaccagacctagaaagtcttcgtcgtactaactttagtacttgtctacgtattatacgtattcgtaccgtttaccgaccggttaccgttacggaccgtaaagggtccgtaaaggttacggtaaagttacccgaaacggttacgtcggttaccgtacgtacgtacaccgtacg

SEQ ID NO: 136594 - DNA, 760 bp, Homo sapiens
  misc_feature: GYAE6OF02JNMW1.47.48.E04.1.454.CMB.1.raw
  modified_base (177)..(177): a, c, t, g, unknown or other
  misc_feature (177)..(177): n is a, c, g, or t
  modified_base (195)..(195): a, c, t, g, unknown or other
  misc_feature (195)..(195): n is a, c, g, or t
  modified_base (217)..(217): a, c, t, g, unknown or other
  misc_feature (217)..(217): n is a, c, g, or t
tcagagctcacgtacacgaccggtgctcgatttagagagcgtcacagagagaagggggaagtacagtcccactcaggacacagcatggacatgagggtccccgcgtcagctcctggggcctcctgctgctctcggttcccgaggtgccaggtgtgacatccagatgacccagttccnccatccctccctgttctntcactctggtaaggagtacganagtcaccctactcctacgttcggcccgggtcgacgtcgagggcgttagaccaaatcgttcgtttcgggtccgttacggttttaccacggtacacggaaccgaaccggaacggggaaaccggtaccccggtaacgccggtaccgtgtacgtacctagtttggcgtacgtaacttacgttacgttacgtaagtaaacggttcgggtaccctacgtacgtaacggtcgtacgcggtacgtacggtacgggttcgagggtacgagtacggttacctaccgtactaccgtactacgttcgacggtacggtccctacggctaccgtcgtacgtaacgtacgtttcgtacctaactttactttaaccgttcgtaaccttccgttaaccgtaagttaccgttagtcgttaccgttaaccctttccggtacgtttaccccgtttacgggaacccggtaacgggaaacccggtttaggggaaacggttaaaccgtaaccggtaaattaccgggttacggtacccgggttactccggtaacccgtaccctacgg

SEQ ID NO: 136595 - DNA, 776 bp, Homo sapiens
  misc_feature: GYAE6OF02GKYP6.47.48.E04.1.454.CMB.1.raw
  modified_base (187)..(187): a, c, t, g, unknown or other
  misc_feature (187)..(187): n is a, c, g, or t
tcagagctcacgtacacgaccggtgctcgatttagagagcgtcacagagagaagggctcagagaggagccttagccctggactccaaggcctttccacttggtgatcagcactgagcacagaggactcaccatggaagttgggcgtgagcgttgggttttccttgttgtcttagttttaagaaggtntccgtagtagtggaggtgctaagtttggtcgctaagttcgtggggggtaggtcgttcggtccgtacggtccggttccggggggtcccttcgtaacggtcctccgttccgtcgtcggctacgtacccgttgtaggttactttccgttaccgttttacgtttcccttcgtttcgggtagttacggttaacggttttccgggtccggtacctaacggtaccgttccggaaagggggtaacggggtccgttggggtaaccggttggggtttaccggaacgtaaacgtaacgttaaactccgaagtaggtaggtaaacgtacggaaacgttaaaaccgtagtacgtaggtaaccttcgtaccgtaggaacgggtcctaacgtttaccaccgtattaccgtacgacgacgtaaccgaacggaccaaagtacgttccttagtttcgttaccgtagacgtaaacgtcgaatcgcgtacgagaaccggttaagacgacgttacggcgtacgttacgttattacggttgtacgtttaccgtcgttacgacggttaccggtcccgtaaccggtccgtccgtttacgggtcgtttaccggg

SEQ ID NO: 136596 - DNA, 538 bp, Homo sapiens
  misc_feature: GYAE6OF02HCE2D.47.48.E04.1.454.CMB.1.raw
  modified_base (199)..(199): a, c, t, g, unknown or other
  misc_feature (199)..(199): n is a, c, g, or t
  modified_base (396)..(396): a, c, t, g, unknown or other
  misc_feature (396)..(396): n is a, c, g, or t
  modified_base (401)..(401): a, c, t, g, unknown or other
  misc_feature (401)..(401): n is a, c, g, or t
  modified_base (411)..(411): a, c, t, g, unknown or other
  misc_feature (411)..(411): n is a, c, g, or t
tcagagctcacgtacacgaccggtgctcgatttagagagcgtcacagagagaaggggaggaatcagtcccactcaggacacagcatggacatgagggtccccgctcagctcctggggctcctgctgctctggttcccaggtgccaggtgtgacatccagatgaccccagtctccatcctccctgtctgcatctgtaggnacagagtcaccatcacttgccggcagtcagggcgttgcaaatgcttggcctggtttcagcagacaccagggaacggcccctaaagccgcctggatcctatggtgcatacactttgacaagtgggtcccatcgaaggttcagcggcagtggtctgggacaggagttcacgtctcactatcagcgcctgcagccttganattcngactaacttnttacgtgtcctacctagttactgacttcgaccttaccctcggtaccttcggacccgtaacgggtaccaacgggtaaggtaaacctacgaaaacccggtacgtacggtacggtctacgacctaacccg

SEQ ID NO: 136597 - DNA, 837 bp, Homo sapiens
  misc_feature: GYAE6OF02I1SQ5.47.48.E04.1.454.CMB.1.raw
  modified_base (615)..(615): a, c, t, g, unknown or other
  misc_feature (615)..(615): n is a, c, g, or t
  modified_base (664)..(664): a, c, t, g, unknown or other
  misc_feature (664)..(664): n is a, c, g, or t
tcagagctcacgtacacgaccggtgctcgatttagagagcgtcacagagagaaggggaggaatcagtcccactcagacacagcatggacatgagggtccccgctcagctcctggggctcctgctgctctgttcccaggtgccgaggtgtgacatccagatcgacccagtcctccactccctccgtagtcctgacctatccgtggtaacggacgaccaggacgtaccaacctatcccgtacggttcgggcccggtacggtacggtccgaaggggtccggttagaccgtaaagtcggttcccgtttacggggtcctttacgggtttaccgacggtaccgtaaacgggaccctaacccgggaacggggggaaacccgggtaccccctaacgggcccgtaccccggttaacgaccgtttacccggtttaaggttccggggtactaaccgttaacgttacccgtttacttttacccgggaacgttaaaccggggttacgggttacccctaacggttacggtaaaccggtttccgaacgggtacgtaacgtacggggttaaggccggtaacgggaaccgtaacggtttccgttacctaccgttacctaccgtaacgttacncccgggtaaccggtcgcccgtagcccgtaacgtcgtaaggtactacgtnacgtaacttacttacgttacgtaccttaccagtacggttatccgttaacttcccgtaacccgttccgttaaccggttccgtaacccggaacggtaacccgggtaagtaaaccgggtaagttaaaccgggaaccttaaacgggtccgttaacggtggacctaccggtactaccg

SEQ ID NO: 136598 - DNA, 879 bp, Homo sapiens
  misc_feature: GYAE6OF02H5YBG.47.48.E04.1.454.CMB.1.raw
tcagagctcacgtacacgaccggtgctcgatttagagagcgtcacagagagaaggggaggaatcagtcccactcaggacacagcatggacagtgacgggtccccgctcagctccgtgggctctgctgctctcggttcccgaggtcgccgaggtgtgacatccagatcgacccagtcctaccactcccgtccctgtcctgctatcgtggtaaggagacgacgtacgtacacccgtatacctaacgttcgggaccgggtacaagtacgaagacgtaactaaacgttaacgaacggtaacgttaaagttttaaagacggtaactaaccgaaaccggaaaccggtaaaaaccggaacgggtaaaaccctaccccccctttaaaccgttaccgtaacgtaaccttaacgttacgaccggttacaccgtaacttaccgttactttaacgggtttcaacggttaaccggttacggggtaaccccggttacgttaacgttttaaccgggtaacgggtttcggtaaacgggttcgtaaaccggttcggtaaggttaccggttacgggtaaacgggtacgttaacgtttaccgtttaaccctaccgttaccctaaccgtaacctacgttacgggtacctaaccgggtaccgtaaccgttaccggaaaacgttacggtaacgtttagggttacccttttaacgacctttaaacgtaccgtttaccgtaagtaaccaaccgggttaacgtacccggttaaacccgttccgttaaacgtccgggttaacggaaccgtaaccgggtaacctaacgggtcgtaaaccgagttaaacccggtaaacgtacggttacggtaccgtaccgaaccgtaccttaccggttacttaccgg

SEQ ID NO: 136599 - DNA, 694 bp, Homo sapiens
  misc_feature: GYAE6OF02FJ9ZD.47.48.E04.1.454.CMB.1.raw
  modified_base (232)..(232): a, c, t, g, unknown or other
  misc_feature (232)..(232): n is a, c, g, or t
  modified_base (311)..(311): a, c, t, g, unknown or other
  misc_feature (311)..(311): n is a, c, g, or t
tcagagctcacgtacacgaccggtgctcgatttagagagcgtcacagagagaaggggaggaatcagtcccactcaggacacagcatggacatgagggtccccgctcagctcctggggctcctgctgctctggttcccaggtgccaggtgtgacatccagatcgacccagtctccatccctccctgtctgcatctgtaggagacagacgtcaaccatcctacttggcccgggngagtcgagggtcgttgacaatgtctttggccttggttcagcagacacgaggacgccctagccgctgactcgtatggacncgacttaactacgtttagacgtaaaggttccgggtaccaatacggtaacggttccacgggtcggtacgtagggttaggtccgttaggggactaggtacgtttccacgttacctcaacgttacgtacgtacggtccggcctacggcccgaggtctaacggtaagttcttacgtagtaaacctttaactttaacgttacgttacgttacccgtacgttaagttacgttacgttacgttaccgtttaacccttaccccggtttaccggttacccgtttaccgggaaccggtaaaccgggtaacccgggtaaagggtaacggtaaaaccggtaacggtaaaacccgtgggttaccgggttagtacccgttacgtacccgttaaccgg

SEQ ID NO: 136600 - DNA, 747 bp, Homo sapiens
  misc_feature: GYAE6OF02JM6EN.47.48.E04.1.454.CMB.1.raw
  modified_base (161)..(161): a, c, t, g, unknown or other
  misc_feature (161)..(161): n is a, c, g, or t
  modified_base (189)..(189): a, c, t, g, unknown or other
  misc_feature (189)..(189): n is a, c, g, or t
  modified_base (196)..(196): a, c, t, g, unknown or other
  misc_feature (196)..(196): n is a, c, g, or t
  modified_base (203)..(203): a, c, t, g, unknown or other
  misc_feature (203)..(203): n is a, c, g, or t
tcagagctcacgtacacgaccggtgctcgatttagagagcgtcacagagagaaggggaggaatcagtcccactcaggacacagcatggacatgagggtcccgctcagctcctggggctcctgctgctctgttcccaggtgccaggtgtgacagtccagatnaccagtctccatcctcctgtctagcatncgtaggntacaagngtcaccatctacgtcgccgggcgacgttacaggggtcgttgacaatgtcgtttggccttggtttccaaggtcaacgtaccaaccggaaggggtaaccggaaccctaacggccgtccgacggtacttacgtacggtcggtactaccgtaacgtaactaccggttttacgaacggttaaacgggtccgggtaacccgtaactttaccggtaaacggtttcccgaaaggtccgacggttacggtaggttaccgtacgggagtaacggtagttcgtaacctcgtactacccgtatacctacgtacgtacgtcgtaacccgtacgtaaacggttacgttaacgttacgtttacgtaacgttaaacttaacgtttaacgtactaaaccgtaaccgtaaaagtttaactaaacgttacgttaacctttaaaccgttaacttacccgttaaccgttacccggtaacgtaaccgggtaaccgtaagtaacccgtagggtaacgtaaaccggtaacggttaacgacggtttcggaaccggttcgacccttaccg

SEQ ID NO: 136601 - DNA, 770 bp, Homo sapiens
  misc_feature: GYAE6OF02G8TLL.47.48.E04.1.454.CMB.1.raw
tcagagctcacgtacacgaccggtgctcgatttagagagcgtcacagagagaagggggaatcagtcccactcaggacacagcatggacatgagggtccccgctcagctcctggggctcctgctgctctggctcccagataccagatgtgacatccagatgacccagtctccatcctccctgtctgcatctgtaggagacacagtccaccatccacgttcggccgggcgagtcgaggactattagactaattatttacgccgtaggtactcagaccaaacgaaacccgaagggtaaacgttccgtaaacgtcctaccgttgaacttacgttagtacgtttaacacttaccctacgttttcgacgtaaccggtttccgggtaccctacgtttcgttaccggtttcgtaggttcggacgtaaggtcggtacttcgggtagggtaacctacgggtttaactttccgtaaccttccttaaccaaccgtaagttacccgtaggaccctacggtccctacggtaaccgacggtacccgttaagaaaggttactttacgggtaccgttaaaccttaaaccgtttttacgttaaaccgttaaacggttaaaacctaaaaacttaccggttaaaaccttacggtacccgtaccccgttaccgtaccgtttaacccggtttccggggaacccgggtaacgggttaaccgtaagggtacgggtaaagtaacccggtttaacccaaacgggttaccttaacggggtaccggtaccgtaaccgg

SEQ ID NO: 136602 - DNA, 778 bp, Homo sapiens
  misc_feature: GYAE6OF02ISJK0.47.48.E04.1.454.CMB.1.raw
  modified_base (159)..(159): a, c, t, g, unknown or other
  misc_feature (159)..(159): n is a, c, g, or t
  modified_base (235)..(235): a, c, t, g, unknown or other
  misc_feature (235)..(235): n is a, c, g, or t
  modified_base (749)..(749): a, c, t, g, unknown or other
  misc_feature (749)..(749): n is a, c, g, or t
tcagagctcacgtacacgaccggtgctcgatttagagagcgtcacagagagaagggggaatcagtcccactcaggacacagcatggacatgagggtccccgctcagctccgtggggcctcctgctgctctcggttcccagggtcgccgaggtgtgaccntccgagatcgaccccagtcctcctaactcccgtccctgtctgacctagtcgtggtaggacgacagacgtccaaccnctacctacgttccgggccggggtacgacggtaccgagggggtcgttacgactaaagtcgttcgttcggtccgtttggttacagtaccgaacgacccgtaacggaaccgggaaaccggacccccgtaaggtcccggtacccgtagtaaccgttacgtgttcggtacacctaacgtaacttacgttagaacgtaaacgggtccggtaccaagtacggtaacggttcgaaggtcgggtacgtaacggttacgggtaccggttacggggaagttccggttaacgttcccgtacttaccgaactaacgtacgtacccggtacgggtcccgtaccgaagtcccggtaaagtcccgtaaggtaccgttattctaacggtactaaccggttacttcgtcgtaacctttacggtataccgtgttaccgtcgttacccggttaccgttacgggttaccgttaccggaacggttaaccggaaccgggttaacggaacgtaaactaacccggaagttacccgggtnttaccggtcccgtacgaccgttactacgg

SEQ ID NO: 136603 - DNA, 656 bp, Homo sapiens
  misc_feature: GYAE6OF02GWRW7.47.48.E04.1.454.CMB.1.raw
  modified_base (198)..(198): a, c, t, g, unknown or other
  misc_feature (198)..(198): n is a, c, g, or t
  modified_base (297)..(297): a, c, t, g, unknown or other
  misc_feature (297)..(297): n is a, c, g, or t
tcagagctcacgtacacgaccggtgctcgatttagagagcgtcacagagagaaggggaggaatcagtcccactcaggacacagcatggacatgagggtccccgctcagctcctggggctcctgctgctctggttcccaggtgccaggtgtgacatccagatgacccagtctccatcctcctgtctgcatctgtagganacagagtcaccatcacttcggccgggcgtagtcgagggtcgttgacaatgtcttggtctggtttcagcagacaccgagggacgacccgtaagccgtccngatcgtatggtcatatactcgttagacgtaacggtcgggtacccagttacgtaaggttcgacggcggtacgtaggttaacggtcgtagggtacaaggtacgtacgactccgtacacgttactacgtacggcgtcctacgtcgacgtacgtacggaacgttcttacgtcgtaccttaaacgtttacgttaccgttcgttaccctaccgtaggttactaggtcctttacgtacccgttacccgttacgggttacccgtttaccgggacccgggtaaacgggaaccgttaacggggtaacgaaaaccgttaaccgaaaccgggtacgttacgggtaccggtaccgtacggtaccctaaccgg

SEQ ID NO: 136604 - DNA, 844 bp, Homo sapiens
  misc_feature: GYAE6OF02FG4OK.47.48.E04.1.454.CMB.1.raw
tcagagctcacgtacacgaccggtgctcgatttagagagcgtcacagagagaaggggaggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgacgtcagggcgttgacaaatgtcgtttaggccttggtttcaggtacagacaccgagggaacggtcccctaagccgcctgtactccgtaagttgggtcgacgtaataccgttaacttttacggacgtaaaccggttggggtaccccaagttacgtaaacgggtttcgaacggtccgggtacgtaacgggtaacgggttccgttagggggtaaccgtaacggtaacggtttaccgtaccgttaaccgttaccctaaccgttaaacgtacccgtaagggccccgggtcccgttacgggacccgtaacggtacccgttaacggggaaacggttacgtttaccgtacggtaaccctttaaaaccgttttacgtttaaccgttacggtttacccgtaacccgttaacggtttaaccgttacggtaacgtttaccggtttacccccgttttaacccggtttacccggggtttacccgtttaacccggggttaaccccgggtaaaacccgggtaaccgggttaaaccgggggttaaaccggttaaaaaccggttacccggttaaaaaacccggttaccggttaaccgggttaccggtaccgttaacccggtacccgttaaaccccgg

SEQ ID NO: 136605 - DNA, 697 bp, Homo sapiens
  misc_feature: GYAE6OF02F57GT.47.48.E04.1.454.CMB.1.raw
  modified_base (202)..(202): a, c, t, g, unknown or other
  misc_feature (202)..(202): n is a, c, g, or t
  modified_base (521)..(521): a, c, t, g, unknown or other
  misc_feature (521)..(521): n is a, c, g, or t
tcagagctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatcgacccagtcctaccatccctaccctgtctgcatctgtagganacagacgtccaaccatcctacttcggaccgggcgaagttccgaaggggtcttgactaaatcgtcgtttggccgttggtttcacgcgacgaacgaccgagggaaccggccccgtaagccgtccgtagataccgtagttgggtcgactactaactacgttttacgactaaagggtcggggtacccaagtaccgtaaaggttcgacggtcggacgtaggtaacgggtcgtaggggaacctaggtacgtttacccgacttaccgtctaaacgttactaccgacggtccgggtcctacgccgaacgtcccgtaagtaaaccgtnttactacgactaaacttttacgttaacttcgtaccttaccgtaagttatagtatccgttacccgttacccgtcggttaccgttaccggaccgtaaaccgggtaacgaacgggtacgtaaaacttaccggtaaacgtaccggtacggtccgggtactaccggtaccgacccgttacg

SEQ ID NO: 136606 - DNA, 786 bp, Homo sapiens
  misc_feature: GYAE6OF02IX7OA.47.48.E04.1.454.CMB.1.raw
  modified_base (316)..(316): a, c, t, g, unknown or other
  misc_feature (316)..(316): n is a, c, g, or t
tcagagctcacgtacacgaccggtgctcgatttagagagcgtcacagagagaagggggaatcagtcccactcaggacacagcatggacatggacgggtccccgctcagctccgtggggctcccgcgtcgtcgtctcggttccgtaccggtggtccgaccgtggttggtacgactactaccagtacgtaccgacccgtacgttccctacctaccttcccctccggtcgtcctcgtacgtactcggtaggtacggacgacgaggttaccaccacctactacgtcggtccgggaccggtacgtcggtacggtcgggttntacgactagtcgttcgtcgtcggttggtacgacgacgtaccgacgaacgggaccggtacccggtacccgtacgccgtacgtacgtaacctcgtaggtacgtacgtaaccgtaccgttacgttaacgtaccgggtaaacggtcggggttaacccggtaacctacggttaccggtaacggttccggacgggacggtacggtagggttacccggtacgggtaacgtacggtacgttacgttcgaacgttaccgtactacgttacgaccgtcggccgttacgcttccggacgtagacggttctcgttacctacgtaacttacttacggttactaccgggttccttaaagtcttaacggtacttaaccgttacccgttacgtttaccgaccggtttccggaaccgtaccgggtaaccgtaaggtaacggtactaaaccgacgtaagtacggtacgtcgacgtacacgtctaacgg

SEQ ID NO: 136607 - DNA, 775 bp, Homo sapiens
  misc_feature: GYAE6OF02JFQVX.47.48.E04.1.454.CMB.1.raw
tcagagctcacgtacacgaccggtgctcgatttagagagcgtcacagagagaaggggctcagagaggagccttagccctggactccaaggcctttccacttggtgatcagcactgagcacagaggactcaccatggaagttgggctgagcgttgggttttccttgttgcttatttagaaggtcgtcagtgtggaggtgctagttggtgctaagtcggtagggggacgtcgttcggtaccacggtccggttcggggggtccctcgacgtaccgtcgtccgtggtcgtcgacgtccgtcgtaggtacttccgttaccttttacgttccttcgtagtattacggtaacgttccgggtcccgtaccgacgtaccgtaccggaagggggtacgggtcggtacgggtaagggttgggtacggacgtaacgtaacgtaaacgtaccgaaggtacgtaggtaacgtacgtaaaacgtaaaaccttagtaggtacgtacttacgtacggaaggtaaccggtcgttaacctaccgacgtaacgtcctaccggaaaggtacaacccggtaaaccgaccgaaactaccgttaccgtttacgttactttaccggaactaacgtaaccgtacggaccgttaaccacggttaaggacgtaaccggtacgaacgtaccgcgttacgtagttaacgttacgttagttcggtacgttggtaaccctttccggaaaccggtcccggttccggttaccggcccggtttaccggttaggttcccgggttaaccggg

SEQ ID NO: 136608 - DNA, 834 bp, Homo sapiens
  misc_feature: GYAE6OF02JYHZQ.47.48.E04.1.454.CMB.1.raw
  modified_base (172)..(172): a, c, t, g, unknown or other
  misc_feature (172)..(172): n is a, c, g, or t
tcagagctcacgtacacgaccggtgctcgatttagagagcgtcacagagagaagggggaatcagtcccactcaggacacagcatggacatgagggtcccccgctccagcctcctggggctcctgctgctctcggttcccaggtcgccaggtgtgacatccagatcgaacccngtctccagtccctccctgtcctgacctagtgtcggtaaggacacgagacgtcccaacctatacctacggttcgggccccgggaggtaacggttacgacggggttccggtttaacggtacctaaaaggttccggttcgttttaccgggcccgttttagggttaccacggccgaacggaccgtacccggaaacgggaacccgggaaccccctacggaccgtcccgttagaaccttaccgtaaggtcggtacgacctaactaccgttacctttaggaccgttaaagggtcccgggtacctaagtaccggtaagttcgacggtcggacgttaggttacgtcgggtacggagtacgtccgtacgtacctaccgtacgtactactcggaacggtccgtaccgtacggtacgtacctaggtcgttaaacggtcctttaacgtacggttaactaacggttttaccctttacgttccgtttaccgaaccgttaacgttacggacttaacggtttacccttaccgttaacccgtttacccgggtttaacgggtttacccgggaaccggtaaccgggttaaccgggttaaacggttaacgggttaaacccgttaaacgggtaaaccgttacggttacgttaaccggtacgtaccgttaacgtaccctttccgg

SEQ ID NO: 136609 - DNA, 614 bp, Homo sapiens
  misc_feature: GYAE6OF02HQQW2.47.48.E04.1.454.CMB.1.raw
  modified_base (447)..(447): a, c, t, g, unknown or other
  misc_feature (447)..(447): n is a, c, g, or t
tcagagctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgaccgggcagtcgagggcgttgcaaatgctttggccttgggtttcagtcagacaccgagggaaggcccctaagccgcctgatctaacgtggtgctaatacactttcgactaaaaggtcgggggtacccaattccgtaaggttcacggcggtacgaggttaggtccttaggggacctaggacgtttcgactcgtctacgtaatcgagccggtactgcacgtcctaggaaagtntctcgactaaacttactttacgtcgttctaccgattacgtgtaatgtaccttacccgttacggtaccgtttacggtaccgtaaacggggaaccgtaacggttaaggaaacgttaccgaaaacggttaaccgtacggttacggaccgttaggaccctaaccgtaaccg

SEQ ID NO: 136610 - DNA, 815 bp, Homo sapiens
  misc_feature: GYAE6OF02GELUW.47.48.E04.1.454.CMB.1.raw
tcagagctcacgtacacgaccggtgctcgatttagagagcgtcacagagagaaggggaggaatcagtcccactcaggacacagcatggacatgagggtccccgctcagctcctggggctcctgctgctctggttcccaggtgccaggtgtgacatccagatcgacccagtcctccactccctccctgtctgctatctgtaggagacagacgtccacctatccacgttcgaccctagggccgtagtccgaggaactattacgctaaacttatttaaattggtatcagacaacgaaacgaagggaaaccgccctaagctaccgtgaactcacgaagtgactactacctaagtttacggaaaccgtcggggtacctagtacgaaggtttcgaggtaggtaacgtcggtacgtacgtacgggaactaggtttaacgtttttaccctttacgtaacctaacgttaccgaaacgtccgtaaaccggtcccgttagggtacctaaccgggtccctaaagggttaaacgttaccgtttaccgttaacgggttaacctttaaaccttttaaaccgtttacccgggtttaacccggttaccccgttaacgttaaccggtttacgttaacggttaccgtttaccggtaacccccggttttttaacccccggaacgggggttttaaccccgttaccgggggtaaccccgggaaaaccggggttaaccgggttaaacggggttaaaccgtaaaaccggtaaaccgttaaaaccggtacgttaccggggtccgtaccgtacccgtaacccgttaccgtactttacccgg

SEQ ID NO: 136611 - DNA, 673 bp, Homo sapiens
  misc_feature: GYAE6OF02GM1Z3.47.48.E04.1.454.CMB.1.raw
  modified_base (346)..(346): a, c, t, g, unknown or other
  misc_feature (346)..(346): n is a, c, g, or t
tcagagctcacgtacacgaccggtgctcgatttagagagcgtcacagagagaaggggaggaatcagtcccactcaggacacagcatggacatgagggtccccgctcagctcctggggctcctgctgctctggttcccaggtgccaggtgtgacatccagactcgacccagtcctccactccctccctgtctgcatctaggtaggagacgagacgtaccaccagtctacgttcggccgggacgcggtcgaggggtcgttgacaaagtcgtacgtttgccgttggttcacgcgacgaccacgagggaaccggcccgtaagccgccgtacgtactcgtacgttggtacnctaacttacctacgtttcgaacgtaacggggttcggtaccctagtaacgtaaggttcaggcgacgtaggtagcgtaggacagtacgtactacttcctagtactacgcgacggcggtaccgcgacgacgtcgtacgagttacttcgtacgtacctttaacgtttacttaaccgttcgtacctcgttaagtacgttagtaccgtccgttaacccgtttcccgtacggtttacccggttacggtaacccgggtaacgggttaaacggtacgggttaaacgtaactaaccggtaaacgtacggtccggtacggtacgtacgaccttaaccg

SEQ ID NO: 136612 - DNA, 808 bp, Homo sapiens
  misc_feature: GYAE6OF02JGXRU.47.48.E04.1.454.CMB.1.raw
  modified_base (208)..(208): a, c, t, g, unknown or other
  misc_feature (208)..(208): n is a, c, g, or t
tcagagctcacgtacacgaccggtgctcgatttagagagcgtcacagagagaaggggaggaatcagtcccactcaggacacagcatggacatggagggtccccgctcagcctcctggggctcctgctgctctggttcccaggtgccaggtgtgacatccagactgacccagtcctccactccctccctgtctcgctatctaggtaganacgaagagtccacctatacctacggttccgggacccggggtacgtacggtcggtacgggtcggttacggaccaaaggttcggttacgtttaccgggtaccgtttacgggtttaccgaacggtaccgaacggaacccgaacccgggtaacgggggaacccggtaccccgtaaacgggcccgtaccgtagtaacggttaccgtacgggtcggtacggtactaacttaccgtacggtttacggaaccggtaaaacggggttccggtaaccaaggttaccggtaacggttaccgagggtaccggtaggtacggttaacggggttccgtaacgggtaccgttaacggttacgttacctaccgtttactaacgttaaccgttaacgtacggtaccggccggttaccgacgtaccgtaccggttacggaacttaacggttacttaccgtaacgttacttaaaccgtttagtaccttaccggtacctaacgtatttacgacgttacgttcccgttcccgtacgttaccggtccggtaaccggacggtaaccggtaagtacggaacgtaacgtacgaacgttcgtaccgtcggtactaccgtataaccg

SEQ ID NO: 136613 - DNA, 739 bp, Homo sapiens
  misc_feature: GYAE6OF02JN8F9.47.48.E04.1.454.CMB.1.raw
  modified_base (600)..(600): a, c, t, g, unknown or other
  misc_feature (600)..(600): n is a, c, g, or t
tcagagctcacgtacacgaccggtgctcgatttagagagcgtcacagagagaagggggaatcagtcccactcaggacacagcatggacatggagggtccccgcgtcagcttccgtggggctcctgctgctcgtcggttcccaggtgaccagggttgtgacatccgagtatgacccagtctccatccctcctgtctgactatcgtaggtaggagacctagaacgtccaactgtactacgttcggaccggtcgaagttcggagggttccgtttagaaccaagttcggtacgtttcgggtaccgtttcggtttacgaacgtcccgaacggtaacgacccggtaacggggtaaccgtaccccgtaacggacccggtcctacggacgttactaggtcggtagtacctagtaccgtacgtttacgaacgtaacgggtaccggccttaacgacgtttaacggtcacggacggtacgaggtcgtcggtacggaagtcgtaacgttccacgtttcgtaccgtaataccgacggtcggacctacgtcgccgacggtacagtacggtacttcgacgttactagtttaccttcacggttacctacgtaagtnttacggttacttccggtaacccgtttaccgacggttttaccgtccgtaaggtaacccgggtaaccggaggtttaacggtacctaaaacggtacccgtacggtcgggtacggtaccttaccggtacgtaacttacccggg

SEQ ID NO: 136614 - DNA, 916 bp, Homo sapiens
  misc_feature: GYAE6OF02HZE6N.47.48.E04.1.454.CMB.1.raw
tcagagctcacgtacacgaccggtgctcgatttagagagcgtcacagagagaaggggaggtctcagagaggagccttagccctggactccaaggcctttccacttggtgatcagcactgagcacagaggactcaccatggaattggggctgagtcgtgggttttccttgttgctattttagaaggtgtccagtgtgaggtgcaagttggtgacaattcgtaggggggacggcgtttcggtccgaggcccgttgggggggtccccttcgacggtaaccgttcctccgttggtcggcgtaacgcccgtccgttagggactttccgttaaccccgtttttaacgtttcccgttccgtttagggtaacttaggtaaaacggttttcggggtaccccggtacccggtaacgtaacccgtcccggtaacgggggtaaacggggggtccgttagggggtaagggtttcgggggttagggccgtaaaaaccgtaaagttaaaaacgttcccgaaggaacgttaggggaaacgttaccggtaaaacgtaaaaaacccgttaagttacggttacgggtaaccgttcccgttaaccgggtacggtaacgggggtaacccgtaagtttacccgaacccgtaacttacccgtaccgtaaacggtaacggaaaccgaacccggaacccgaaaacgttaaccgttaccgttacgtttaaccggtttacctaccgtaacgtaaacgtaagggtaccgtacggtacccgtacggaagtaaccggtaaccgtaaacggaaccgaccgggttacgttacgggttaagtttaacggtaaacgttttcggttacggttcgtttaccgttaccggttacggtacccggtaccccggttaccgggtacccccggttaccgggttccggtttacccgggg

SEQ ID NO: 136615 - DNA, 821 bp, Homo sapiens
  misc_feature: GYAE6OF02GL8JH.47.48.E04.1.454.CMB.1.raw
tcagagctcacgtacacgaccggtgctcgatttagagagcgtcacagagagaaggggaggaatcagtcccactcaggacacagcatggacatgacgggtccccgctcagcctccgtggggctcctgctgctctggttcccaggtcgccaggttgtcgacactccagatcgacccagtcctccacttccctccctgtcctgctatcgtggtaggacgacgaggtacgtaccaaccgataccgtacgttcgggccgggtacgacggtcgacgggtcgttacgtacgaaagtcggttaccgtttcggtccgtttcggttcgtacgacgaacgtaaccgacccgaacgggggaacccgggtacccccgtaacggaccgtacccgtagtacgttaccgttacgtacggtacgtacctaacttacctacgtttacgacgtaaacgggttacggtacccgtaacgtaccgtaaggttacgacggtccggtacgtacgggttacgggtccggttacgggtaacgtacggtttaacgttccgtaccgttacgttaacctacgttaccgtaaccgtaccggacccggttcgtaccggtaccgaccggtaccggtaacgtaaccgttacgtttaccgtcgtaaacccttaacgtttaaccgtttaacgttaccgttaccgtaacccgttaagttacttaccggttaacttccgtacccgtttaccgttaccgttccgttacccgggaacgtaaccgggtaaccggaacgggttaacggtaacgttaacccggtaacgacggttaccggtacgtcgttaccgaccgttaaccg

SEQ ID NO: 136616 - DNA, 697 bp, Homo sapiens
  misc_feature: GYAE6OF02FW9ZK.47.48.E04.1.454.CMB.1.raw
tcagagctcacgtacacgaccggtgctcgatttagagagcgtcacagagagaagggggaatcagtcccactcaggacacagcatggacatgagggtccccgctcagctcctggggctcctgctgctctcggttcccaggtcgccaggtgtgacatccagatcgacccagtcctccattccctccctgtctgcatctaggtaggagacagagtccaccatccacgttcggccggacgagtaccggagggtcgttgactaaatcgtattcggtcgttggttaccagacgacgaacctaccggaaggggaacccggtaccccgtaacgccgtcctagattcgtagtggacgtacgtaacttacctacgtttagaacgtaacgggtccggtacctagtaccgtaaggttccacgggtaccggacgttaggtacggtcgtacggacgtaacggtacgtactaccgtactacgtacgtactcgacgtccggtcctacggtaccacgtaccgtaagaacgtagttacgtcgtaaccttaactttacgttaccgtcgttacccttacgtaagtttcgtgtaacgttccgttaaaccgttaccggttaccgttaccggttacccggaacgtaaacgggaacgtaaaggtaacgtaaaccgtaacgtaaacgtacggtacggtaccgaccgtagtaaccacgtaccg

SEQ ID NO: 136617 - DNA, 761 bp, Homo sapiens
  misc_feature: GYAE6OF02G5FII.47.48.E04.1.454.CMB.1.raw
  modified_base (224)..(224): a, c, t, g, unknown or other
  misc_feature (224)..(224): n is a, c, g, or t
tcagagctcacgtacacgaccggtgctcgatttagagagcgtcacagagagaagggggaatcagtcccactcaggacacagcagtggacatggacgggtccccgctcagcctccgtggggctcctgctgctcgtggttcccaggtcgccgtaggtgtcgacatccagatcgacccagtcctacctacgttccctccctgtctcgactcgtcgtaggtacggaanacgaggtactccgaacctatccgaacggttcggaccgggtacgtagtaccggagggtcgttagacgtaaagtcgtacgtttacggtccgttacggtttacgaacgtacgacgaaccgaaccgtaacggggtaaccgacccgtaacgccgtactagtacgtacgtaagtcggtacgtacgtaacttaacgtacgtttacgaacgtaaacggttaccgggtacctaacgtacgttaaacggttccgaacggacggtacgtaacgggttacggtaccgtaagggacgtacggttacgtacgtacttacgtaacgtaactacgtaccgacggtcgtaccgtagaccgtacgtaccgttagaaacggttacttaccgtacgtaaccttaacggtttaattaccgttacgtaccgttaccgtaagtttacgtacaacgttccgttacctacccggtacgttaccgtacggtaaccgtaacgggtaacgtaacggtacgaaactaaaccgacggtaacttcggtagccgtacgacctagtaccg

SEQ ID NO: 136618 - DNA, 891 bp, Homo sapiens
  misc_feature: GYAE6OF02F4NY4.47.48.E04.1.454.CMB.1.raw
  modified_base (202)..(202): a, c, t, g, unknown or other
  misc_feature (202)..(202): n is a, c, g, or t
tcagagctcacgtacacgaccggtgctcgatttagagagcgtcacagagagaagggggaggaatcagtcccactcaggacacagcatggacatgagggtccccgctcagctcctggggctcctgctgctctggttcccaggtcgccaggtgtgacatccagatcgacccagtctccatccctcctgtctgcatctgtagganacagactcaccatctacgtcggccggcgtacgtcgacggggtcgttgactaagtcgtacgtttcggcctttcggtttacgacgacgtaacgacccgtacccggaacggggtaaccggtaccccgtaacgggccgtacccgttacggtacgtaccgttaggtcggtacggacctaacttaaccgttacgtttacgaaccggttaaacggggttccgggtaacccctagttaaccggttaacggttaccgacgggtcggtaacggtacgggttaggtaccgggttacgggaacgtacggtacgttaccgtaacccgttcgtaacctaaccgttcgtaaccgtccgggttaccggacccgtttacggcccgtaaccggttacccgttaacggttaaccgggtttacctttaccggttaacgttaacccgtttaacgtttttaaccgtttaccgtttaccgggttacccgttacgtttaaacccgggttaaacgttttccgttaacccgttacccggttttaacccccgtttccccgggtttaacccggggtttaacccgtttacccggggtaaacccgggtaaaccggggttaaccggtttaaacggggtaacccgggttaaaaccgtttaaacccggaaacggttaccgggttagggttccccggtacggttaccgtacccgtaaccccgg

SEQ ID NO: 136619 - DNA, 685 bp, Homo sapiens
  misc_feature: GYAE6OF02IR8CM.47.48.E04.1.454.CMB.1.raw
  modified_base (187)..(187): a, c, t, g, unknown or other
  misc_feature (187)..(187): n is a, c, g, or t
  modified_base (199)..(199): a, c, t, g, unknown or other
  misc_feature (199)..(199): n is a, c, g, or t
  modified_base (204)..(204): a, c, t, g, unknown or other
  misc_feature (204)..(204): n is a, c, g, or t
  modified_base (228)..(228): a, c, t, g, unknown or other
  misc_feature (228)..(228): n is a, c, g, or t
tcagagctcacgtacacgaccggtgctcgatttagagagcgtcacagagagaaggggaggaatcagtcccactcaggacacagcatggacatgacgggtccccgctcgagctcctggggctcctgctgctctggttccaggtgccaggtgtgacatccagatgacccagtcctccatcctcctgctncatctgtagganacagngtccaccatccgtcgtcgccgggnagtcggaggtcgtagacaatgtacgtttggtccgttaggtttcacgcgaacgtaccgaaccggtaacggaaccgggtacccgaacggtccgtcgtactactcgtacggtcgtagactataccgtacttacggacgtaagggtcggtacccgagttaccgtaacggttacgacggtacggtcgtaggtacggtacgtagggtaactacgggttacgtactaccgtcctacacttacgtacggacgtcggtccgtcgacgtcgtcggtaacgtacgttacgtcacggttacctaacgtttactacccgttagtcctaacgtaaccgttgtaccgttaacgttcccggtaacctttacccggtccgtttaccggttaccgggtaccgggtaaacggttaccggtaaaggtaacgtaaccgtaagaaaccggttcgtacgtacggtacacggtacctaacg

SEQ ID NO: 136620 - DNA, 674 bp, Homo sapiens
  misc_feature: GYAE6OF02JRO6Y.47.48.E04.1.454.CMB.1.raw
  modified_base (149)..(149): a, c, t, g, unknown or other
  misc_feature (149)..(149): n is a, c, g, or t
  modified_base (152)..(152): a, c, t, g, unknown or other
  misc_feature (152)..(152): n is a, c, g, or t
  modified_base (161)..(161): a, c, t, g, unknown or other
  misc_feature (161)..(161): n is a, c, g, or t
  modified_base (177)..(177): a, c, t, g, unknown or other
  misc_feature (177)..(177): n is a, c, g, or t
  modified_base (217)..(217): a, c, t, g, unknown or other
  misc_feature (217)..(217): n is a, c, g, or t
  modified_base (361)..(361): a, c, t, g, unknown or other
  misc_feature (361)..(361): n is a, c, g, or t
  modified_base (545)..(545): a, c, t, g, unknown or other
  misc_feature (545)..(545): n is a, c, g, or t
  modified_base (554)..(554): a, c, t, g, unknown or other
  misc_feature (554)..(554): n is a, c, g, or t
  modified_base (573)..(573): a, c, t, g, unknown or other
  misc_feature (573)..(573): n is a, c, g, or t
tcagagctcacgtacacgaccggtgctcgatttagagagcgtcacagagagaagggggaatcagtcccactcaggacacagcatggacatgagggtcccccgctcagctcctggggctcctgctgctctggttcccaggtgccaggtgngancctacagtntcgacctctcctaccnctccctcacttcgcgactctcgtaggaggacacgagttcnccactctccgttcgtccggggccggtacgtaggtaccgggtggtcgtcgaacgtacgttccgttcgttccggtcggttcggttacgacgacggaccgaccgacgggaacggacccggtaaccgtcgccgtacgtacgtacgttnaccgtggttagtcgattaacgacttaacgttcgaaccgtagggttacccgtacggttcacggtacggtcgacggtcgacgtaggggtactacgggacggtacgaggttacgtacctactcgtaccgtacgttcgtacgcggtccgtacgcgtagtaccgtacgtacggtacgttacgtacgttntactagttnttccgtacttacgtacgtnttacgcttacgttaccgtccgttacctcgggtaccgttacgggaaccgaacggtcccgaaagtacgaacgtacgtacgcgtaccgtacgctccgtattccg

SEQ ID NO: 136621 - DNA, 674 bp, Homo sapiens
  misc_feature: GYAE6OF02GPVQ5.47.48.E04.1.454.CMB.1.raw
  modified_base (190)..(190): a, c, t, g, unknown or other
  misc_feature (190)..(190): n is a, c, g, or t
  modified_base (228)..(228): a, c, t, g, unknown or other
  misc_feature (228)..(228): n is a, c, g, or t
  modified_base (480)..(480): a, c, t, g, unknown or other
  misc_feature (480)..(480): n is a, c, g, or t
  modified_base (650)..(650): a, c, t, g, unknown or other
  misc_feature (650)..(650): n is a, c, g, or t
tcagagctcacgtacacgaccggtgctcgatttagagagcgtcacagagagaaggggaggaagtcagtccactcaggacacagcatggacatggagggtccccgctcgagctccgtggggctcctgctgctctcgggttcccaggtcgccgtaggtgtcgacatccgagatcgcccgagtctcacttccncctgtctgctagttctaggtacgacgacagctcaaccnttcaggttcggggaccggcgtaggttacgaggggtcgttcgacaaagttcgtcgttcgtcgtttcggttacgagcgaacgacgaccggtacggtaaccggacccgtaacgcgaccgtacgtatccgtagtgtacgctaatagtaccttaggactaaggttcggtccaattaccgggtaagttcggacgacggtacacgggtaagtccgtagggactagacttcgtactcgtactcgtaacttcgagtcccgngttaccgacgacgtcgtaccggtagttaccgttacgtagtaccttaaaccgtttacttacgaccgttttaccgactacggtatttacggaacttggtacccttaacgttccggttactaccggtaccgtaacgggtaactaacggtaacgtaacgtaacgtaccggtaanacggtcggtactacggataacccg

SEQ ID NO: 136622 - DNA, 858 bp, Homo sapiens
  misc_feature: GYAE6OF02G56D8.47.48.E04.1.454.CMB.1.raw
  modified_base (184)..(184): a, c, t, g, unknown or other
  misc_feature (184)..(184): n is a, c, g, or t
tcagagctcacgtacacgaccggtgctcgatttagagagcgtcacagagagaaggggccttagccctggactccaaggcctttccacttggtgatcagcactgagcacagaggactcaccatggaatgggctgagcttggtttctgttgctattttagagtgtccagtgtgagtgctaattggnacatcgagggggagtcttggtaccaggccggtcgggggtccctcgacgtacgtcctaccgtgtcgcacgtccgtcgtggtacttcctaccgttttacgttcccttcgttaggtatacggtagtttcggggtcccacgaacgtaccgtaccggaagggggtaacgggtccgtagggtacggtggggttacggaactaacgtaaagtaaccgtcgaacgtaagttacgggtaaagtacctaaacggtaaaccttgtacggtcgtaacttcgtacgagggtaccgggtactacttacccgaaccttaccgttaccgtaacgtaacggaccgaaacccgtaaaccggaacccgtaaacggttaaaccccttaccgtttacgttaccggtttttaaccggacgtaaaccgttaaaaacgggtccgggtaaacccgtaccgtttaaccggaaacgggtaacgttaaacccgggtaaacgggtaaacccggaccggttaaccgggttagtttaaccggtttaagttaaccgttttaccggtgggtttacgttacgtttacccgtcggtaaccggggtccgtttacccccgggaaccggggttaccccttcgggtttaccggtcccgtttacgggggtaccggttaccccggtacgggttacccccggttgggtaccccccg

SEQ ID NO: 136623 - DNA, 665 bp, Homo sapiens
  misc_feature: GYAE6OF02J0ZXY.47.48.E04.1.454.CMB.1.raw
  modified_base (100)..(100): a, c, t, g, unknown or other
  misc_feature (100)..(100): n is a, c, g, or t
tcagagctcacgtacacgaccggtgctcgatttagagagcgtcacagagagaaggggaatcagtcccactcaggacacagcatggacatgagggtcccgntcagctctgggctcctgctgctcgtcgtccaggtcgcctaggtgtacgactatccagtacgtccgacctgtcctctctcctccctgtctcgacgattgtggtaggacgaccaggtatccactatcgtacgttcggccggtggtaggtccggtagggtccgttgactaacgtcgtcgttcggtcgtgttacgacgacgacgacgtacgggacgaaccggtcccgtacggcgctagtactacgttaggtcgtcgtaacctacgttaaccgttgttaacggaacggtacggttaccggaccttagtaccggtacgttcgaccgtacgtacgtaggtacggtcgacgggtacgtagtcgttacgacttactccagttacgtcggtaacggtccgtcgacgtcacggtactaacggttactcgtactaccgtacgttaacctgtttaacgtcgttacctacggtaattcgtacgttaccgtcgttaccctcgttacgtaccggtacgaccggtacgtaacgagtacgtaagtacccgagaccggttgtacgtccggtacgacctattacg

SEQ ID NO: 136624 - DNA, 651 bp, Homo sapiens
  misc_feature: GYAE6OF02FUU18.47.48.E04.1.454.CMB.1.raw
  modified_base (100)..(100): a, c, t, g, unknown or other
  misc_feature (100)..(100): n is a, c, g, or t
  modified_base (158)..(158): a, c, t, g, unknown or other
  misc_feature (158)..(158): n is a, c, g, or t
  modified_base (327)..(327): a, c, t, g, unknown or other
  misc_feature (327)..(327): n is a, c, g, or t
  modified_base (440)..(440): a, c, t, g, unknown or other
  misc_feature (440)..(440): n is a, c, g, or t
tcagagctcacgtacacgaccggtgctcgatttagagagcgtcacagagagaaggggaatcagtcccactcaggacacagcatggacatgagggtccccnctcagctcctggggctcctgctgctctggttcccaggtgccaggtgtgacatccagancgacccagtctccactccctcctgtctgcatctaggtaggagcagatcaccatcactcggccggcgagtcgagggtcgttagactaaagtcgtcttcggtccttggtttacacgcaacgacgaccgaacgggacggacccctaaggccgacgtgactctaagtcggtcncacttactcgtttagacgtaacgggtcgggtacccagtacgtaacggttcagggccgagtaacggtaggtacgtacgggaactcggtactcgtacgtctactactagtaccgngacccggtcctagcacaccgttagaagttcttagacgtaacttacttaacgtttacgtacttactacgtattacgtacgtacttccgtaccgttccgttaccgggttacgttcccgggaactaaccgggtaacggttaacggtaacggtaaaaccgttacgtaaaccgttacggtcggttaacggccgttaacggtaccgtaccctaacgg

SEQ ID NO: 136625 - DNA, 172 bp, Homo sapiens
  misc_feature: GYAE6OF02F1OP0.47.48.E04.1.454.CMB.1.raw
  modified_base (136)..(136): a, c, t, g, unknown or other
  misc_feature (136)..(136): n is a, c, g, or t
  modified_base (147)..(172): a, c, t, g, unknown or other
  misc_feature (147)..(172): n is a, c, g, or t
tcagagctcacgtacacgaccggtgctcgatttagagagcgtcacagagagaaggggaggaatcagtcccactcaggacacagcatggacatgagggtccccgctcagctcctggggctctgctactctgttcccnggtgccaggtnnnnnnnnnnnnnnnnnnnnnnnnnn

SEQ ID NO: 136626 - DNA, 732 bp, Homo sapiens
  misc_feature: GYAE6OF02GJHLO.47.48.E04.1.454.CMB.1.raw
  modified_base (709)..(709): a, c, t, g, unknown or other
  misc_feature (709)..(709): n is a, c, g, or t
  modified_base (726)..(726): a, c, t, g, unknown or other
  misc_feature (726)..(726): n is a, c, g, or t
tcagagctcacgtacacgaccggtgctcgatttagagagcgtcacagagagaagggggaatcagtcccactcaggacacagcatggacatggagggtccccgctcagctccgtggggctcctgctgctcgtcggttcccaggtcgaccaggtgtagacatccagactcgacccagtcctccactccctccctgtctgctatcgtaggaggacacagacgtccaccatcctaccgtcggccgggtacgacgtcggacgggtcgttgaactaagtcgtccgtttcggccgtttggttacacggtacacggaacccgaacggtaacgggggaaccgtaccccgtaacggccggtacctaggtactcgtacggtcggtcgactacttaccgttacgtttacggaacgttaacggggtcccgggtacctacgttaaccggtaacggttccgacgggtacgtacggtaagggttcggtaccggtagggtaaccgaacggttacgtttccaccgttaccgtaacgtacgttaacgtcggaaccggtccgtcgacggaccacggtacctaagtaacgttcgtacgtacgtaccttaacgtttccgtacgtcgttacccttacgtaagttctacgtacgtacctttccggttaaccgcgtacgttaccggaaccgtacgggaacgttaaggaactaaccggtagtaaccgtacggttnaccggttacacgttacncgtacc

SEQ ID NO: 136627 - DNA, 585 bp, Homo sapiens
  misc_feature: GYAE6OF02GJI07.47.48.E04.1.454.CMB.1.raw
  modified_base (293)..(293): a, c, t, g, unknown or other
  misc_feature (293)..(293): n is a, c, g, or t
  modified_base (421)..(421): a, c, t, g, unknown or other
  misc_feature (421)..(421): n is a, c, g, or t
  modified_base (425)..(425): a, c, t, g, unknown or other
  misc_feature (425)..(425): n is a, c, g, or t
  modified_base (435)..(435): a, c, t, g, unknown or other
  misc_feature (435)..(435): n is a, c, g, or t
  modified_base (453)..(453): a, c, t, g, unknown or other
  misc_feature (453)..(453): n is a, c, g, or t
tcagagctcacgtacacgaccggtgctcgatttagagagcgtcacagagagaagggggccttagccctggactccaaggcctttccacttggtgatcagcactgagcacagaggactcaccatggaattggggctgagctgggttttccttgttgctattttagaaggtgtccagtgtgaggtgcaattggtgcaatcgtgggggaggcttggtccaggccgtggggggtccctcagactctcctgtgcagcctctggattcacctttagttcctcttggatgaattgggccncagactccgagggagggctggagtgggtggcaacgataaatccagatggaagtcaagaaaacctatgtaggactctctggaacgggccattcaccatcctaccagacacaacgaccaagacctctctnttcnataagtgacngcctagagagtacggaanacgacggcttaggtagtatttacgtggttagtcgttctcggtcgtaaccgtcccggttaccgggccccggttaccgttggtcccgtttcgggtccggggtcccgtaccggggtacccgttcggttaccccgg

SEQ ID NO: 136628 - DNA, 695 bp, Homo sapiens
  misc_feature: GYAE6OF02GYYWA.47.48.E04.1.454.CMB.1.raw
  modified_base (203)..(203): a, c, t, g, unknown or other
  misc_feature (203)..(203): n is a, c, g, or t
  modified_base (232)..(232): a, c, t, g, unknown or other
  misc_feature (232)..(232): n is a, c, g, or t
  modified_base (501)..(501): a, c, t, g, unknown or other
  misc_feature (501)..(501): n is a, c, g, or t
tcagagctcacgtacacgaccggtgctcgatttagagagcgtcacagagagaaggggaggaatcagtcccactcaggacacagcatggacatgagggtccccgctcagctcctggggctcctgctgctctggttcccaggtgccaggtgtgacatccagatgacccagtctccatccctcctgtctcgctattcgtgtagganacagagtcaccagtcacgttcggccgggngagtacgagggtcgttagactaatcgtcgtttcggtccttggtttcagcgaacgaccgaccgaacggggaaccgacccccgtaacggccgtccgtagtacgtacgttagtggtacggaccttaataccgtacgtttacggaacgttaaaggggttccggtaccctacgttaccgtaacgggttcaacgggtcgggacgtacgggtacggttcggacgggtacgtaaggtacgttaccactaccgtactactactccggacgccgtccgngcctacgtcgtagtaacgttcttcgtacgtaccgttattacgttacgtccgttactcctagttaactcgtacgttaccgttaccgttacccgtacgggttaccgttcccgggaaccggtaaccgggtaacggtaaacggttaacgaaacgttaaccgtaacggtaacgtcgggtaacgtcgtacgtaccctacg

SEQ ID NO: 136629 - DNA, 759 bp, Homo sapiens
  misc_feature: GYAE6OF02GAW09.47.48.E04.1.454.CMB.1.raw
  modified_base (674)..(674): a, c, t, g, unknown or other
  misc_feature (674)..(674): n is a, c, g, or t
tcagagctcacgtacacgaccggtgctcgatttagagagcgtcacagagagaaggggaggtctcagagaggagccttagccctggactaccaaggcctttccacttggtgatcagcactgagcacagaggactcaccatggaattggggctgagcgtggtttcgtgtgctatttagaggtgtcacgtgtgacgtgcgtaattggtgctaagtccgtgggggaggtcgttcggtccaaggccggttcgggggtcccctgacgacttcgtaccttggtagcctaggccttacgtggtattcctaccgttttacggttcctttacggtacgtagttagaacgttcggggttccaccgtacgtaccgtaccggaacggggtacgggacgttacggagggttccgggttagtaaccgaacgtaataaccgtaccgagtagaggtaaccggttcgaaacgaaaaaccgtggttacggtacgtaaccgttcgtaccgtaagggtaacgggtaccgttaacggttacccaactaaacccgtcgttaacccgagggtaacaacccgaaaccggaccgtaaacggttaccgtacttacttagggtttccacggtaacctaggttaccgggacctacgggaaacccttgggaaccggaagttaccgaaaccgggtacgtacccgngttacgtaccgttaagtcccttaggttccgtcgttactaggccgttaccgaccgggtaccggccggtttaccggtgttacccggg

SEQ ID NO: 136630 - DNA, 892 bp, Homo sapiens
  misc_feature: GYAE6OF02HYCGX.47.48.E04.1.454.CMB.1.raw
  modified_base (226)..(226): a, c, t, g, unknown or other
  misc_feature (226)..(226): n is a, c, g, or t
tcagagctcacgtacacgaccggtgctcgatttagagagcgtcacagagagaaggggctcagagaggagccttagccctggactccaaggccttttccacttggtgatcagcactgagcacagaggactcgaccatggtaagttggggctggagcgtttcgggtttttccgttgttgtcttaatttttaggaaggtgtcctagtgtggtaggtgactaagttggtnacgaattcgtggggggacgttcgttcggtccgtaggtccgggttcggggggtccctcgtacgtaccttccgttaccgttggcgtccgacgttccctcgttgggttacttaccgtttacccttttaggttccctttcggtttagggtagttacggttacggtttccgggtcccgaccgtaacggtaccgtacggagggggacgggtgtcgggtagggttcgggttcgaactaacgtaaactaacgtacgtaggtacggtaggtaacggttaaccgtaaacgtaaaaccgttgtagggtaccgtttaactccggttacggtagggtaacccgggtacgtttaaccgtaccgtaacccgttacttacccggttaccgtaaacgaacgttaaacccgaaaacccgggtaaccctaaaaacggttaccctttccgtttaaccgttttaccggttacgttaacgaaccgtttaaacgtaacggtaactacggtacccgtagtaacggaacgttaaaccgggaaccggtaacggtaccggtcgttaaagttttgttaaccgttttacgggctttagggttcccgttacgttcccgggtaccggtaaccgggttttccccggtccggggttaaccccgggtttcgttttccggggttcccggtttacccggggg

SEQ ID NO: 136631 - DNA, 740 bp, Homo sapiens
  misc_feature: GYAE6OF02IEQLR.47.48.E04.1.454.CMB.1.raw
  modified_base (175)..(175): a, c, t, g, unknown or other
  misc_feature (175)..(175): n is a, c, g, or t
  modified_base (206)..(206): a, c, t, g, unknown or other
  misc_feature (206)..(206): n is a, c, g, or t
  modified_base (506)..(506): a, c, t, g, unknown or other
  misc_feature (506)..(506): n is a, c, g, or t
tcagagctcacgtacacgaccggtgctcgatttagagagcgtcacagagagaaggggaggaatcagtcccactcaggacacagcatggacatgacgggtccccgctcagctcctggggctcctgctgctctcggttcccaggtgccaggtgtgacatccagatcgacccagtccnccatcctccctgtctgctatctaggtagganacgagagtaccaccatctaccttggccggggacgtaggtccgaagggggtcgttgaactaagtcgtcgttttcggccgttggttcacgcgaacgaccgaacccggaaggggaacccgtaccccgtaaacgtcccgaccgttacgtacttacgttagttcgggtacgtacgtaaccttaccgttaacgtttacggaacgtaaacggggttccggtacccctagtacggtaacggttacgacgggacgtacgagggttaacgggtcgtacgggaactaggttcgttacctacttcgtaaccncgttaataccggacgttaccggactccgacggtaaccgtcgtaaggtaacgttcgttactcgtaaaccgtaattttaaccgtgttcctaccgtaccgttaggtacttagtccgttaccgtacccttttaccgtcggttaccgttacccgggtaacggtaaacgggtaaccggtaaggttaacgggaaacccttaacggaacgttacggttggtaccggaccgtccacggttacc

SEQ ID NO: 136632 - DNA, 941 bp, Homo sapiens
  misc_feature: GYAE6OF02F061W.47.48.E04.1.454.CMB.1.raw
  modified_base (167)..(167): a, c, t, g, unknown or other
  misc_feature (167)..(167): n is a, c, g, or t
  modified_base (187)..(187): a, c, t, g, unknown or other
  misc_feature (187)..(187): n is a, c, g, or t
  modified_base (202)..(202): a, c, t, g, unknown or other
  misc_feature (202)..(202): n is a, c, g, or t
tcagagctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccgagatcgacccngtcctccatcctccctgtcngcatcgtagtagganacgagtacgtaccacctatcacgttcggccgggacgtagtaccggagggtcgttagactaaagtgtcggtttcggtccgttcggtttacaggtacctagaacccgaaccggtaacggggaaccggtacccccgtaacggccgtaccgttacggaccttctaacggttcggtcgtacctacgttaaccgttacgttttacggaaccggtaaaacgggttccggggttaaccctaacgttacggtaacggtttaccgacgggtaccggtacggtaacggttacgggtccggttacgggaaccgttacgtacgtttacctacgttacctacgtaacgtaccgtacggacggttaccggtacccgttacggacccgtaaaccggtaccggttaacggtaaaaccgttacgttttacccgggtaacgttaaacccctttaaaccgttttaaccgtttaaccggtttacccgttaaccgtttacccgttaaacgttaaccgtttaccggtaaccgggttttacccgttaaacccccggttttaaccccgggttacccgggtttaaccccggtttacccggggtaaaaccccggttaaaccgggggttaacccgggtaaaccggggtttaaaaccgggtaaaaaccggtttaaaccccgtaaaaacccggggtttaacggtttaaccgggggttacccggtttaaccgtaccccgggttaaccccgttaacccgtttaaccccggg

SEQ ID NO: 136633 - DNA, 829 bp, Homo sapiens
  misc_feature: GYAE6OF02JYTPJ.47.48.E04.1.454.CMB.1.raw
  modified_base (199)..(199): a, c, t, g, unknown or other
  misc_feature (199)..(199): n is a, c, g, or t
  modified_base (439)..(439): a, c, t, g, unknown or other
  misc_feature (439)..(439): n is a, c, g, or t
  modified_base (811)..(811): a, c, t, g, unknown or other
  misc_feature (811)..(811): n is a, c, g, or t
tcagagctcacgtacacgaccggtgctcgatttagagagcgtcacagagagaaggggctcagagaggagccttagccctggactccaaggcctttccacttggtgatcagcactgagcacagaggactcaccatggaattggggctgagcgttgggttttccttgttgcttatttaggaaggtgtccagtgtggaggtncgtagttggtgactaatcggtgggggacggtcttgggccacggccggtcgggggtccctacgacgtacctccttccgtcgtcgacgtaccgtcttcgtcggtacttccgttaccgttttacgttccttacggttggtacttagggttaacgggttccgggtacccgtcgtaaccgtccggtaccgggaagggggtacgggtcgtagggtacggttggggtacgacgtaacgagtaaaccncgtaaggtacgtaaggtaacgtaaccggtaaacgtaaaaccgtagttacgggtaacgttaccgttaccgttacggaacgggtaacccggtaccggttaaccttacccggtaacccgtaaccgttaaccgtacccgggtaaacgttaaaccgggaacccttaaacccggaacgttaaaacccggttaaccgttcccttttacggttttaaccttcggtaaacgttaacccgttaaaggttacccggaacggtttacccgtacggtaaaccggttagaaacgttacccgggaaagtacccggtaggtacgtttacgttagtttacgtaccggttgtaaccttgtaccgtctacggtccgtacgcgggttacccngttcccggtagtcccggg

SEQ ID NO: 136634 - DNA, 671 bp, Homo sapiens
  misc_feature: GYAE6OF02JC11W.47.48.E04.1.454.CMB.1.raw
  modified_base (393)..(393): a, c, t, g, unknown or other
  misc_feature (393)..(393): n is a, c, g, or t
  modified_base (528)..(528): a, c, t, g, unknown or other
  misc_feature (528)..(528): n is a, c, g, or t
tcagagctcacgtacacgaccggtgctcgatttagagagcgtcacagagagaaggggaggaatcagtcccactcaggacacagcagtggacatggacggggtccccgctcagcctccgtggggcctcctgcctgctctcggttcccaggtcgccaggtgtgacatccagtatcgaccccagtcctccactcctccctgtcctgctactcgtaggtaaggacgacagtacgtccaccactctacgtcggccgggcacgtcgagggcgtagacaagtcgtcgttcggtccgttcgttcgagacacgtacaccggaacgggaaccggtaccctaaggccgacctcggtatctaggttcgacgtacatacgtacttacgacgtacggtcggtacctntacgtcgtacggtacgcggaacgtcgtacggtacgtagggacgtacgtacgttacgacgtaccgtactaacgtctacgaccgtcggactcgctacgaccgtacggtaactattcggtaacttaccgtaaactttntcggttctaccgtccgaaagttgtacttacgtcgttaccctaccggttaccgtacgtttacccggacggtaacgggaccgttaacggtaaacgttaaccgaacgtaccggttagtacccggcttaacgttccacgttaacccg

SEQ ID NO: 136635 - DNA, 871 bp, Homo sapiens
  misc_feature: GYAE6OF02JEBYZ.47.48.E04.1.454.CMB.1.raw
tcagagctcacgtacacgaccggtgctcgatttagagagcgtcacagagagaaggggctcagagaggagccttagccctggactccaaggcctttccacttggtgatcagcactgagcacagaggactcaccatggaattggggctgagctgggttttccttgttgctattttagaaggtgtccagtgtgaggtgcaattggtgcaatcgtgggggaggtcgttggtccagccgtcggggggtccctcgagactctcctgtgcagcctctggcttctacctttagttccttcgttggtatgtaagtttgggtcccgcctacgaccgtacccggaagggggaacgggggtcctggggtaggttggggttcggaccgaacgtaacgtaaaacgtcccgaagacggtacgggtaaacgtacgaaacggtaaaaacccttagtacggttacggtaaccgttaccgtacgttaacggggtaacgggggtaccctaacgtttacccgaaccccgtaagttaccccgttaccgaacggtaacggaaaccccgtaaacccggaaccccgaaaacggttaacccttacccgtttacgttttaccggtttttacccgacggtaacccgtaaaacgtttaccgggaacccgttaacggtccccggttaaggtaaacggttaaccgggtaaaccgggaaaccggaacccgggtaaccgggtaccgtttacggttacggttttaaccgttttacggttcgggtttaccggtttcggtttacccgttacccgggttacgtaaccccggggttcccggtttacccccggggggtaccccggtttaccccgggttttccggggttaccccggttttaccccgggggg

SEQ ID NO: 136636 - DNA, 842 bp, Homo sapiens
  misc_feature: GYAE6OF02G8ESS.47.48.E04.1.454.CMB.1.raw
  modified_base (825)..(825): a, c, t, g, unknown or other
  misc_feature (825)..(825): n is a, c, g, or t
tcagagctcacgtacacgaccggtgctcgatttagagagcgtcacagagagaagggggccttagccctggactccaaggcctttccacttggtgatcagcactgagcacagaggactcaccatggaattgggctgagctgggttttccttgttgcttattttagaaggtgtccagtgtgaggtgctaagttggtgcaatcgtggggaggcgttggtccagccgtcggggggtccctcgagactctccgtgtgcagcctcgtggtattctaccttttacgttccttcgttggacttagtaagtttcggggtccgaccgtacgaaccgttccgaaggggtaacgggggtcgtggggtaggttggggtcggtacgaaactaacgtaaaacgtccgtagtaagttacgggaagtactaaagaaaaccgttagttgacggtaacttctacgtacgggtaaacgggccgtaacttaccaaccctacgttacctaccggtaaagaacgaacccgtaaaccgaaccctaaaaggttaaccccttctttacggttaccggtttttacctaagaaaccgttaaaacggtttaggaaacccgacgggtttacccaaggggtaacgggtaaccgttaaggaaaaaccgggtcccgtaaacccggggttcgtttaagtttaacggtttaacggttttaccgttggttacgttaccgttccgttacgggtcgtaaacccccggggttcccggttacccggtaccccggggtttaccgtttccgggttcgtttcccgggggttaccggggttccccgtaaccggggggtttaacccccgngggttttaaccccccgg

SEQ ID NO: 136637 - DNA, 1200 bp, Homo sapiens
  misc_feature: GYAE6OF02IG5NS.47.48.E04.1.454.CMB.1.raw
tcagagctcacgtacacgaccggtgctcgatttagagagcgtcacagagagaagggggaatcagtcccactcaggacacagcatggacatggacgggtccccgctcagcctccgtggggcctccgtgctgctcgtcggttcccaggtcgccgtaggttcgtacgactactccgagtactcggaccctagttaccgtcctacttccccgtcccttgtccgtcgacctacgttacgttgggtaacggacgaaccgaaggtaccggttaacctaacccgtaacgttacccgttacgggtttaccggggaccccggggtaacggttacggtaccgggtacggggttaccggttacggaactaaaccggtttcggttaccggttttaccggtcccggttttacgggttaccgtacggaacccgtaaccggtaaccggaaccccgggaacggggtaaacccggggtaacccccggtaaccgggttacccggtacccggttaaccgtaacggtttaccgttacggttacgggtttacgtaaccgtaaccgtttaacgtttaacccggtttaaccggttaaaccggttaaaccggggttaccggggttaccccgttaaaccggttaaccgggttaacggggtttaaccgggtaaccggtacccggggttaacccgtaagggggtttacccggttaaccgggttaaccgggtaaccgggttaaccggttaacccgggttttaaccgttaccccggtttaaaccgttaaccccggttaacccgtttaaacgggtaaccccggtacccgggggttacccggttacccggtacccgggtaacccgggtttaacccggtaaccccggttaaacgggtttaaacccggtttaaccgttttaacccgggtaaccccgtttaacccgtttttaaaacccgttttaaaccccgggtttttaaacccggtttaccccgggtttttaaaacccccgggtttaccgtttaaaacccggggtttttaaccggtttaaaaacggggttttttaccccccgggttttaaaaccccccggggttttttaacccccgggtttttaaaaacccccggggggttttttaaaccccccccgggggtttttttaacccggggggtttttaaaaaaccccccccgggggtttttaaaacccccccgggggggggttaaaaaccggggttt

SEQ ID NO: 136638 - DNA, 741 bp, Homo sapiens
  misc_feature: GYAE6OF02IYUOY.47.48.E04.1.454.CMB.1.raw
  modified_base (279)..(279): a, c, t, g, unknown or other
  misc_feature (279)..(279): n is a, c, g, or t
tcagagctcacgtacacgaccggtgctcgatttagagagcgtcacagagagaagggctcagagaggagccttagccctggactccaaggcctttcccacttggtgatcagcactgagcacagaggactcaccatggaattggggctgagcgtgggttttccttgttgcttatttagaaggtgtccagtgtgagtgctaagttggtgacaatcggtggggagtcgttggtccgagccgtcgggggtccctcgagactcctctcgtgcgagccctactggnttcacctttagttccttcgtgtatagtacgttcggggtcccaccgtacgacgtccggaaggggacgggcgtggaggtgggtgacgagataaagccgtagagtaggaatacgaactaaaaacctgtagtacggtactcgttacgtacggaacgggtaccgattacccaaccgtacttacctaccgagaacgtaacccgaaccaaccgtaacgtaaacgtccgtttaccttcggtttacctacgtaaccgtaacgttcggaaccgaccggtaccgtacgtaagttaacgtaaccgaaacggtaaaccggtaccgggtacgggtttaacgttacgttaaccgttttaccgtttcggttacgtttacggtttccttaaccgggttccgaacccggtttcccggttaccccgggggtaccccggttttcccgggttaccggggtttaccccggtttaccccgggggg

SEQ ID NO: 136639 - DNA, 792 bp, Homo sapiens
  misc_feature: GYAE6OF01DZ00L.29.16.B05.1.454.CMB.1.raw
  modified_base (598)..(598): a, c, t, g, unknown or other
  misc_feature (598)..(598): n is a, c, g, or t
tcagatagagtactcacgaccggtgctcgatttagagctcacgtatttggggtttggggggggtctcaggaggcagcgctctcaggacgtcaccaccatggcctgggctctgctccctcctccaccctcctcactcgaggcacgacggtcctcggcccagtctcgtcctgactcacgtccctcccgtccgccgtaccgggtctccgtaggacagtcacgtccacctactcctctacgccacgtacggaaccagctaaggtcggtaacggtttggttaggttactcgaacttgttccgttccgttaccggtaaggtacctaacgaaaacccgtaaccccgaacccgggtaaacctaaaaccccgtaccccctaaaaccgttccgttaagttaattttacggtaccggtaacccgtcggtaccgtacccgtcccgtaacccgttcgggaccgggtttccctagttccgttctttcgtttcgccggtactaccgtaggtccgacgaccaaccggtcctccctccgtacgtcccgtcgtcgtacgggtccctaggcggtctacggacgtagtacggacgttctaacgtaccttaacgttccncgtacccttacaccgttatccggactaccggaactaaacgtaacctttaagttttcgggtttacgtttaccggttcccgggaaggggaaccgttacgacgtaccggtacccgtaccgtccttagggcctaaccgcggtaccgtaccgacgttcccgtaccccctttaccgtaccgtttcgtccccgttcccccg

SEQ ID NO: 136640 - DNA, 904 bp, Homo sapiens
  misc_feature: GYAE6OF01B8BLT.29.16.B05.1.454.CMB.1.raw
  modified_base (129)..(129): a, c, t, g, unknown or other
  misc_feature (129)..(129): n is a, c, g, or t
tcagatagagtactcacgaccggtgctcgatttagagctcacgtagttgggtttgggggggggtctcaggaggcagcgctctcaggacgtcaccaccatggcctggctctgctcctcctcaccctcctnactcagggcacagggtcctgggcccagttctgtcctgacctcacgccctcccctccggcgtacccgggtctccgtggacagtcaagtccaccatcctccgtgacctacgtacggaacctcggctaaggtcggttacgggtttgggttaggtttactaggtaaccttagtacggttaccgttacccgttacgggtacttaaccaaaacccggaaaccccgtaacccccgggtaaacctaaaaaccccggttaccccccgaaaaacctttacccccgttaggtttaaacgttttaaccgtaccgggtaaaccccggtttcggtaaccccggttaacccggggaccccgttaaccccgtaaccggggttaaccgggggtttaaaccccttacgggtaacgtttcccgtttaccgtttttaacccggtggtaccctttaaaccgtaacgggtttccgaaccggttaacctaaaccccggtaaccccggtcccttcccggtaccgtaacccgttcgtaacccgggtcgtacccgtaccgtcgggtacgtcggtaaccgtggtacgtacggtaccgtaacgttattaccttaccgtcgttacccttacccgtataacgttacgtacgtaccgtaacggaacctaacgttaactttacgtttacgtttagggttacgggtaacgggaccggtacgacgtaccgtaccgtctaccgtctacggtcgacgtaccgtaacggccgtaccgtccccggtaccctaccgttctaaccgtttcccccg

SEQ ID NO: 136641 - DNA, 345 bp, Homo sapiens
  misc_feature: GYAE6OF01BGEX2.9.32.C10.1.454.CMB.1.raw
  modified_base (343)..(345): a, c, t, g, unknown or other
  misc_feature (343)..(345): n is a, c, g, or t
tcagtgatacgtctcacgaccggtgctcgatttagtatagacatcaacacacaaagggagagccccagggtcgtcatctctgttaattccgatcgcccctcaggggtctccgaccgcttctctggctccaggtctggcgcctcagcctccctggccatcgctgggctccagcctgaggatgaggctgattatttctgccattcatatgacagtagtctggttgcgtcggtgttcggcggagggaccaagctgaccgtcctaagtcagcccaaggctgcccccaggtcactctgttcccaccctcctcagacgtatcactgagcgggctggcaaggcgcatagnnn

SEQ ID NO: 136642 - DNA, 345 bp, Homo sapiens
  misc_feature: GYAE6OF01E18KN.9.32.C10.1.454.CMB.1.raw
  modified_base (344)..(345): a, c, t, g, unknown or other
  misc_feature (344)..(345): n is a, c, g, or t
tcagtgatacgtctcacgaccggtgctcgatttagtatagacatcaacacacaaagggagagccccagggtcgtcatctctgttaattccgatcgcccctcaggggtctccgaccgcttctctggctccaggtctggcgcctcagcctccctggccatcgctgggctccagcctgaggatgaggctgattatttctgccattcatatgacagtagtctggttgcgtcggtgttcggcggagggaccaagctgaccgtcctaagtcagcccaaggctgcccccacggtcactctgttcccaccctcctcagacgtatcactgagcgggctggcaaggcgcatagnn

SEQ ID NO: 136643 - DNA, 646 bp, Homo sapiens
  misc_feature: GYAE6OF01DYB8B.16.39.D06.1.454.CMB.1.raw
  modified_base (454)..(454): a, c, t, g, unknown or other
  misc_feature (454)..(454): n is a, c, g, or t
tcagtgtactactccacgaccggtgctcgatttagtgacatctcgcagttctttgggggagaggagcccagcactgggattccgaggtgtttccattcggtgatcagcactgaacacagaggactcaccatggagttttggctgagttgggttttccttgctgctattttaaaaggtgtcagtgtgaggtgtacttggtggagtctggaggaggcttgacccgaggccgggggggtccctgagactctcctgtgcagcctctgggttcagcgtcagtaacaaccacgtgatgtggtccgccagccctccgaggggaacggggctggaagttgggtctcgagtttatagaaaatggagtggtgacacaatctacgccgactccggtagaacgggcctattccaccatcctaccagacgaactaacttaccaaagaacacggtagaacttcttaanaaatacgaacacgcctagaacgaaccgaggacgacggtaccgttatacttagttagtaagttaggttagttgggttaggttaacgttcccggggaccccgttggggacccgtagggggtaacccggttcgggtacccgtaacccgttccttcccgacgaaccggtcccctacccgaacccggtaaacccggg

SEQ ID NO: 136644 - DNA, 558 bp, Homo sapiens
  misc_feature: GYAE6OF01CMFQ1.16.39.D06.1.454.CMB.1.raw
  modified_base (296)..(296): a, c, t, g, unknown or other
  misc_feature (296)..(296): n is a, c, g, or t
  modified_base (302)..(302): a, c, t, g, unknown or other
  misc_feature (302)..(302): n is a, c, g, or t
  modified_base (353)..(353): a, c, t, g, unknown or other
  misc_feature (353)..(353): n is a, c, g, or t
  modified_base (399)..(399): a, c, t, g, unknown or other
  misc_feature (399)..(399): n is a, c, g, or t
  modified_base (419)..(419): a, c, t, g, unknown or other
  misc_feature (419)..(419): n is a, c, g, or t
  modified_base (437)..(437): a, c, t, g, unknown or other
  misc_feature (437)..(437): n is a, c, g, or t
  modified_base (468)..(468): a, c, t, g, unknown or other
  misc_feature (468)..(468): n is a, c, g, or t
  modified_base (471)..(471): a, c, t, g, unknown or other
  misc_feature (471)..(471): n is a, c, g, or t
  modified_base (481)..(481): a, c, t, g, unknown or other
  misc_feature (481)..(481): n is a, c, g, or t
tcagtgtactactccacgaccggtgctcgatttagtgacatctcgcaggttctttggggggagaggagcccagcactgggattccgaggtgtttccattcggtgatcagcactgaacacagaggactcaccatggagttttggctgagttgggttttccttgctgctatttaaaaggtgtccagtgtgaggtgtacttggtggagtctggaggaggcttgacccgaggccgggggggtccctggagactctcctgtgcagcctctgggttcagcgtcagtaacaaccacgtgatgnggtccncagcctccgagggagggctggaatgggtctcagttatagaaaatgatggtnacacaatctacgccgactcggtagaacggcattcacatctacaganaactactacaagaacaggtnaaatcttaacaatgaacngcctagaacgacgagacacggactataactnttntagtacgttnggttagtaagtccgggcccgtaggggccaggggtaacctggtaccacgtcctcaccgagcccctcgaccgaaccggg

SEQ ID NO: 136645 - DNA, 712 bp, Homo sapiens
  misc_feature: GYAE6OF01DCXGD.16.39.D06.1.454.CMB.1.raw
  modified_base (260)..(260): a, c, t, g, unknown or other
  misc_feature (260)..(260): n is a, c, g, or t
  modified_base (298)..(298): a, c, t, g, unknown or other
  misc_feature (298)..(298): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctattttaaaggtgtccagtgtgaggtgtacttggtggagtctggaggaggcttgacccaggccggggggtccctgagactctcctgtgcagcctntgggttcagcgtcagtaacaaccacgtgatgtggtccncagcctccgagggaagggctggaagtgggtctcgagttatagaaatgatggtagacaacaatcctacgccgtactccgtagaagggcctattccaacgtatcctaccgaagacgactaaacttaccgaaagaaacgacggttagaaacttaccttacaaaagttagaaaccgtagaccctaggaaacgaaccgggaagggaccgtaaccgggtaccgttaattaagtttaacgttaggttaaagtttaaggggttttaagttaggggttaacgggtttaacggtttccccgggggtacccccgttagggggggaccccgtaacgggggtaaacccggttcgggttaccccgtaaccccggttcccttacccgtaccgtacggcccccgttacccgaaccccggtaaacccgggg

SEQ ID NO: 136646 - DNA, 591 bp, Homo sapiens
  misc_feature: GYAE6OF01A8K8N.16.39.D06.1.454.CMB.1.raw
  modified_base (306)..(306): a, c, t, g, unknown or other
  misc_feature (306)..(306): n is a, c, g, or t
  modified_base (417)..(417): a, c, t, g, unknown or other
  misc_feature (417)..(417): n is a, c, g, or t
  modified_base (439)..(439): a, c, t, g, unknown or other
  misc_feature (439)..(439): n is a, c, g, or t
  modified_base (473)..(473): a, c, t, g, unknown or other
  misc_feature (473)..(473): n is a, c, g, or t
  modified_base (493)..(493): a, c, t, g, unknown or other
  misc_feature (493)..(493): n is a, c, g, or t
  modified_base (504)..(504): a, c, t, g, unknown or other
  misc_feature (504)..(504): n is a, c, g, or t
tcagtgtactactccacgaccggtgctcgatttagtgacatctcgcagttctttgggttttggggagaggagcccagcactgggattccgaggtgttccattcggtgatcagcactgaacacagaggactcaccatggagttttggctgagttgggttttccttgctgctattttaaaaggtgtccagtgtgaggtgtacttggtggagtctggaggaggcttgacccgaggccgggggggtccctgagactctcctgtgcagcctctgggttcagcgtcagtaacaaccacgtgatgtgggtccnccagcctccgagggaggggctggaagtgggtctcagttattagaaatgagtggtgacacaatcgtaacgccgacgtccgtggaacgggccgtattccaccatcctccaganaacaattccaaagaacacggtnaatcttacaaagtcgaacagcctagacgaaccgngacacggcgtatattagttnagttaggttanggttaggtaacgttccggggccccgtggggcccaaggggtaacccgttggtccacccggttctccctacacgtccctcccaacccgg

SEQ ID NO: 136647 - DNA, 557 bp, Homo sapiens
  misc_feature: GYAE6OF01ET59U.16.39.D06.1.454.CMB.1.raw
  modified_base (432)..(432): a, c, t, g, unknown or other
  misc_feature (432)..(432): n is a, c, g, or t
  modified_base (440)..(440): a, c, t, g, unknown or other
  misc_feature (440)..(440): n is a, c, g, or t
  modified_base (545)..(546): a, c, t, g, unknown or other
  misc_feature (545)..(546): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccagccgggggggtccctgagactctcctgtgcagcctctgggttcagcgtcagtaacaaccacgtgatgtgggtccgccagcctccgaggggaagggggctggaatgggtctcagttattagaaaatgatggtgacacaatctacgccgactccgtgaagggccgattcaccatctccagagacaattccaaagaacacggtanaatcttanaaatgaaacagcctagaacgaaccgaggaccacggccgtatattattgtataggttatggtgtaagttcgggccctggggccagggaccgtggtcaccgtctccnncgcctccaccg

SEQ ID NO: 136648 - DNA, 556 bp, Homo sapiens
  misc_feature: GYAE6OF01DTVJ2.16.39.D06.1.454.CMB.1.raw
  modified_base (399)..(399): a, c, t, g, unknown or other
  misc_feature (399)..(399): n is a, c, g, or t
  modified_base (423)..(423): a, c, t, g, unknown or other
  misc_feature (423)..(423): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccaggccggggggtccctgagactctcctgtgcagcctcgtgggttcagcgtcagtaacaaccacgtgatgtggtccgccagcctcgaggggaacggggctggaagtgggtctcgagttatagaaaatgatggtgacacaatctacgccgactcgtgaacggcatcacatctcaganacaatcaagacacgtagaatctanaatgaacagcctagacgaacgagacacggactatattatgtattaggtatggtagtacgtccgggtcccgtggggccgagggtaccgtggtcccgaccgtccgtaccctcgaccgtccctccgaaccgaccgg

SEQ ID NO: 136649 - DNA, 568 bp, Homo sapiens
  misc_feature: GYAE6OF01C2WOK.16.39.D06.1.454.CMB.1.raw
  modified_base (369)..(369): a, c, t, g, unknown or other
  misc_feature (369)..(369): n is a, c, g, or t
  modified_base (391)..(391): a, c, t, g, unknown or other
  misc_feature (391)..(391): n is a, c, g, or t
  modified_base (435)..(435): a, c, t, g, unknown or other
  misc_feature (435)..(435): n is a, c, g, or t
  modified_base (454)..(454): a, c, t, g, unknown or other
  misc_feature (454)..(454): n is a, c, g, or t
  modified_base (496)..(496): a, c, t, g, unknown or other
  misc_feature (496)..(496): n is a, c, g, or t
  modified_base (550)..(550): a, c, t, g, unknown or other
  misc_feature (550)..(550): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctgggaggaggcttgacccaggccgggggggtccctgagactctcctgtgcagcctcgtgggttcagcgtcagtaacaaccacgtgatgtcgggtccgccagccctccgaggggaacggggctggaatggggtctcgagttattagaaaatgatggtnacacaatctacgccgactccgngaagggccattcacatctccagagacaattccaagaacacggtnaacttcttacaaatgaacngcctagacgaaccgaggacacggctatattatgtataggttntggtgtaacgtcgggacccgtgggaccagggaccgttgggccacccgtcacctnacgtccctccgaacccgg

SEQ ID NO: 136650 - DNA, 815 bp, Homo sapiens
  misc_feature: GYAE6OF01B0GHY.16.39.D06.1.454.CMB.1.raw
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgcttattttaaaggtgtcagtgtgaggtgtacttggtggagtcgtggaggaggcttgacccgaggcccggggggtcctgagactctcctgtgcagcctcgtggttcagcgtcagtaacaaccacgtgatggtcgggtcccgccgacgcccgtccggaaggggaacggggcgtaggaagtcggggttctacgtaaggttacgttacggttgggttggttaggtttaactaacccgtaacgtaacttaaccgtaccgaccgtaacgtaacccgtccggttacgggaacggggttcccgttaccaaccgtactccgtaccgaaggtaacgtaacctaaacgttacccgaaaaggtaaaccctaacctaaccgttagtaaaccttcgtacgaacctaaaagtacggaaacctacggcccgttaaggaaccggaccggaccccggaaccgaaccgtaccgggacccttaaagttaacttaaccgttacgtacggtacgaacccggtaaaacgccccgtaacccgggtacgttaaacgggtttacccgtaaccccctaaacccccgtaaagttttaacccccgtttaacggttttaccggaaaccccgttttaacccggggtcccggggggaaacccccgttaaacccggggg

SEQ ID NO: 136651 - DNA, 535 bp, Homo sapiens
  misc_feature: GYAE6OF01C0J5M.16.39.D06.1.454.CMB.1.raw
  modified_base (359)..(359): a, c, t, g, unknown or other
  misc_feature (359)..(359): n is a, c, g, or t
  modified_base (396)..(396): a, c, t, g, unknown or other
  misc_feature (396)..(396): n is a, c, g, or t
  modified_base (430)..(430): a, c, t, g, unknown or other
  misc_feature (430)..(430): n is a, c, g, or t
  modified_base (482)..(482): a, c, t, g, unknown or other
  misc_feature (482)..(482): n is a, c, g, or t
  modified_base (521)..(521): a, c, t, g, unknown or other
  misc_feature (521)..(521): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccagccgggggggtccctgagactctcctgtgcagcctctgggttcagcgtcagtaacaaccacgtgatgtgggtccgccagcctccgagggaaggggctggaatgggtctcagttattagaaaatgatggtgacanaatctacgccgactccgtgaaggccgattcaccatcnccagagacaattccaagaacacggtagaatctanaaatgaacagcctagagaaccgagacacggccgtaatattatgtataggttntggtgtatcggcctgggccagggacgtgcaccgtctccnagcctcgacgacgg

SEQ ID NO: 136652 - DNA, 646 bp, Homo sapiens
  misc_feature: GYAE6OF01B9X1U.16.39.D06.1.454.CMB.1.raw
  modified_base (362)..(362): a, c, t, g, unknown or other
  misc_feature (362)..(362): n is a, c, g, or t
  modified_base (366)..(366): a, c, t, g, unknown or other
  misc_feature (366)..(366): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccaggccgggggggtccctgagactctcctgtgcagcctctgggttcagcgtcagtaacaaccacgtgatggtgggtccgccagcctccgaggggaaggggctggaatgggtctcagttattagaaaatgatggnacanaatctacgccgactccgtgaacgggccattcaccatctccagacgaacaacttaccaaagaacacggtagaaactcttacaaaatcgaaacacgcctaggaacgaaacccgaggaccgacgggtccgtaataatttattagtaagttaggttaacgttgggttacggttaagttacccggggtccccgtagggggaccccgtaagggggtaacccggttgggttacccgaacccggttcccgtacccgttaccgacgtccccgtaccccgtaaaccccgg

SEQ ID NO: 136653 - DNA, 761 bp, Homo sapiens
  misc_feature: GYAE6OF01ACYPG.16.39.D06.1.454.CMB.1.raw
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccagccgggggggtccctgagactcctcctgtcgcacgcctcgtgggttcagccgtcaacgtaaccaacctacggtgatggtcgggtcccgccgacgccctaccggaggggaacggggcgtaggaagtggggtctcgtagttatagaaaatgagtggtagacaactaatctacgccgactccggtaggaacgggtccgtattacccgacctactcctaccaaggaacgtaacctaacttacccgaaacgtaaccgaacgggttagtaactttcccttaaacgaaagttacgaaacacggtaccctaaggaaccggaaacccggacgggaacctaccgggtaacccgtttaattaagttttaagttaggttaagtttaacgggtttagtaggggtttacggttaaccggtttccccggggacccccggttcggggggtacccggaaacgggggttaaccccggttcgggtaccccgtaacccggttcccgttacccgttaccgacccggttcccctaaccccgaacccggtaaccccggg

SEQ ID NO: 136654 - DNA, 544 bp, Homo sapiens
  misc_feature: GYAE6OF01CXCOI.16.39.D06.1.454.CMB.1.raw
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccagccgggggggtccctgagactctcctgtgcagcctctgggttcagcgtcagtaacaaccacgtgatgtgggtccgccagcctccagggaaggggctggaatgggtctcagttattgaaaatgatggtgacacaatctacgccgactccgtgaagggccattcaccatctccagagacaattccaagaacacggtgaatctacaaatgaacagcctagagaaccgaggacacggccgtatattattgtataggttatggtgtaatcgggccctgggccagggaaccgtggtcaccgtctcctcagccctcgaccgacggg

SEQ ID NO: 136655 - DNA, 667 bp, Homo sapiens
  misc_feature: GYAE6OF01BFBCZ.16.39.D06.1.454.CMB.1.raw
  modified_base (357)..(357): a, c, t, g, unknown or other
  misc_feature (357)..(357): n is a, c, g, or t
tcagtgtactactccacgaccggtgctcgatttagtgacatctcgcagttctttggggggagaggagcccagcactaggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccaggccgggggggtccctgagactctcctgtgcagcctctgggttcagcgtcagtaacaaccacgtgatgtgggtccgccagcctccgaggggagggctgggaagtgggtctcagttattagaaaatgatggtnacacaatcctacgccgactcccggtaggaacgggcccattccaacctatcctaccagagaactaacttacaagaacacggtagaactcttacaaatacgaaacacgacctaggaacgaaccggaggaccaacgggtaccgtaattaagtttaattaggttaagttaaggttagttaggggttacggttaacgtttcccggggacccccggttagggggaccccggtaaggggtaacccggttcgggtacccgtaccccggttcctaccccgttccaaccggtccccctaccccgaacccggtaacccggg

SEQ ID NO: 136656 - DNA, 588 bp, Homo sapiens
  misc_feature: GYAE6OF01CX3FE.16.39.D06.1.454.CMB.1.raw
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccaggccgggggggtccctgagactctcctgtgcagcctctgggttcagcgtcagtaacaaccacgtgatggtgggtccgccagccctccgaggggaaggggctggaatggggtctcgagttattgaaaatgaatggtgacacaatctacgccgaactccgtagaacgggccattcacatctcagacgacaattaccaagaacacgtagaatcttacaaatgaacagacctagaacgaaccgaggaacacggaccgtatattagttagtaagtaggttatggttaggtaacgttccgggccccgtggggcccaggggtaccgtcggtccaccggtcctacctcgacgccctccgaacccgg

SEQ ID NO: 136657 - DNA, 562 bp, Homo sapiens
  misc_feature: GYAE6OF01AKLU7.16.39.D06.1.454.CMB.1.raw
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctgggaggaggcttgacccaggccgggggggtccctggagactctcctgtgcagcctctgggttcagcgtcagtaacaaccacgtgatgtgggtccgccagccctccgaggggaaggggctggaatgggtctcgagttattagaaaatgatggtgacacaatctacgccgactccgtgaacgggccattcaccatcctcagacgacaattccaagacacggtgaactcttacaaatgaacagcctagacgaacgaggacacggcctatattatagtatagtatggtggtagttccgggcccgtggggccagggaaccgtggtccaccgttctcctcgacgccctccgaccgaacgg

SEQ ID NO: 136658 - DNA, 568 bp, Homo sapiens
  misc_feature: GYAE6OF01ARGDE.16.39.D06.1.454.CMB.1.raw
  modified_base (555)..(555): a, c, t, g, unknown or other
  misc_feature (555)..(555): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccaggccgggggggtccctgagactctcctgtgcagcctctgggttcagcgtcagtaacaaccacgtgatgtgggtccgccagcctccgagggaaggggctgggaatggggtctcagttattgaaaatgatggtgacacaatctacgccgactccgtgaagggccgattcaccatctccagacgacaattaccaagaacacggtagaatcttacaaatgaaacacgcctagacgaaccgaggacacggccgtaatattattagtataggttatggtaggtacgtcgggcccgtggggcgacgggaccgtcggtcgaccgtctcctacncgccgtccaaccg

SEQ ID NO: 136659 - DNA, 542 bp, Homo sapiens
  misc_feature: GYAE6OF01EL9KP.16.39.D06.1.454.CMB.1.raw
  modified_base (529)..(529): a, c, t, g, unknown or other
  misc_feature (529)..(529): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccagccgggggggtccctgagactctcctgtgcagcctctgggttcagcgtcagtaacaaccacgtgatgtggtccgccagcctcaggggaagggctggaatgggtctcagttatgaaaatgatggtgacacaatctacgccgactccgtgaagggccgatcaccatctccagagacaattccaagaacacggtagaatcttacaaatgaaacagcctagaacgaaccgaggacacggccgtatattattgtattagtatggtgtaatccgggccctggggccagggacctggccaccgtctctcancctccacgaacgg

SEQ ID NO: 136660 - DNA, 605 bp, Homo sapiens
  misc_feature: GYAE6OF01D00RD.16.39.D06.1.454.CMB.1.raw
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccagccggggggtccctgagactctcctgtgcagcctctgggttcagcgtcagtaacaaccacgtgatgtgggtccgccagcctccgaggggaaggggctggaatgggtctcagttattagaaaatgatggtagacacgaatctacgccgactccgtagaagggccattcaccatctcagagacaattccaaagaacacggtgaaatcttacaaatgaaacagcctagacgaaccgaggacacggcgtaatattattagtataggttagtggtaggtaacgttccggggccccgttagggggcccgtaaggggtaacccggttagggttcccgaaccccggttcttccctaccgaacggtcccctccccgaaacccgg

SEQ ID NO: 136661 - DNA, 570 bp, Homo sapiens
  misc_feature: GYAE6OF01AYRKX.16.39.D06.1.454.CMB.1.raw
  modified_base (546)..(546): a, c, t, g, unknown or other
  misc_feature (546)..(546): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccaggccgggggggtccctgagactctcctgtgcagcctctgggttcagcgtcagtaacaccacgtgatgtgggtccgcagcctccgagggaaggggctggaatgggtctcagttattagaaaatgatggtgacacaatctacgccgactccgtgaagggccgattcaccatctccagagacaattaccaagaaccacggtagaacttcttacaaatagaacagcctagagaaccgaggaaccacggccgtaatattattgtataggttatggtaggtaattcgggcccgtggggccacgggaccgtggtccaccgtcnccctacgacgtcccgccgaaccgg

SEQ ID NO: 136662 - DNA, 546 bp, Homo sapiens
  misc_feature: GYAE6OF01DAJRN.16.39.D06.1.454.CMB.1.raw
  modified_base (350)..(350): a, c, t, g, unknown or other
  misc_feature (350)..(350): n is a, c, g, or t
  modified_base (429)..(429): a, c, t, g, unknown or other
  misc_feature (429)..(429): n is a, c, g, or t
  modified_base (530)..(530): a, c, t, g, unknown or other
  misc_feature (530)..(530): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccaggccgggggggtccctgagactctcctgtgcagcctctgggttcagcgtcagtaacaaccacgtgatgtggtccgcagcctccgagggagggctggatgggtctcagttatagaaatgatggtanacacaatcgtacgccgactccgtgaacggcattcgaccatctacagagaacaattaccaagaacacggtagaactctanaatgaacagctagacgaacgagacgacgaccgtatattatagtataggtataggtgtagtccggcccgtgggccgaggaccgtgtccgccgtctcctcacnccctaccacgtaccgg

SEQ ID NO: 136663 - DNA, 783 bp, Homo sapiens
  misc_feature: GYAE6OF01DMD22.16.39.D06.1.454.CMB.1.raw
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtcgtgggaggaggcttgacccgaggccgggggggtccctggagactctcctgtgcagcctcgtgggttcagcgtcagtaaccaaccacgtgatggtcgggtccgccaggccctccggaaggggaacggggctagggaagtcggggtctacgtaagtttaagttagaaaagtgagtggtagacacaatccgtaccgccgtactccggtaggaacgggccgtaacttccgacctacgtcctaccgaagaacgtaacctaaacgttacccgaaaacggtaacccgtaaacgggttactaaacgttaccctttaaacgaaaacgttacggaaaacctacggacccgttaacggaaaccggaaaccggacgggaaccgtacccgggtaacccgtttaattaacgttttaagttacggttaagtttaacgggttagttaggggttaacgggttaaccggttccccgggggacccccggttaggggggaccccgtaaacgggggtaacccggttcgggtaccccgtaacccggttcccgtccctaccgacccggtccccctacccggaaacccggtaacccgggg

SEQ ID NO: 136664 - DNA, 545 bp, Homo sapiens
  misc_feature: GYAE6OF01B3HKF.16.39.D06.1.454.CMB.1.raw
  modified_base (363)..(363): a, c, t, g, unknown or other
  misc_feature (363)..(363): n is a, c, g, or t
  modified_base (434)..(434): a, c, t, g, unknown or other
  misc_feature (434)..(434): n is a, c, g, or t
  modified_base (481)..(481): a, c, t, g, unknown or other
  misc_feature (481)..(481): n is a, c, g, or t
  modified_base (535)..(535): a, c, t, g, unknown or other
  misc_feature (535)..(535): n is a, c, g, or t
  modified_base (538)..(538): a, c, t, g, unknown or other
  misc_feature (538)..(538): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccaggccgggggggtccctgagactctcctgtgcagcctctgggttcagcgtcagtaacaaccacgtgatgtgggtccgccagccctccgaggggaaggggctgggaagtggggtctcgagttattagaaaatgaatggtnacacaatctacgccgactccgtgaacgggccgattcaccatctccagagacaacttccaagaacacggtanaatcttacaatgaacagcctgaagaccgagacacggactatatattntataggtatggtgtatcgggccctgggcagggaccgtggcaccgtctcccagcnccncgcgccg

SEQ ID NO: 136665 - DNA, 550 bp, Homo sapiens
  misc_feature: GYAE6OF01BVB4M.16.39.D06.1.454.CMB.1.raw
  modified_base (400)..(400): a, c, t, g, unknown or other
  misc_feature (400)..(400): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctgggaggaggcttgacccaggccgggggggtccctgagactctcctgtgcagcctctgggttcagcgtcagtaacaaccacgtgatgtgggtccgccagcctccgagggaaggggctggaatgggtctcagttattgaaaatgatggtgacacaatctacgccgactccgtgaaggccattcacatcnccagagacaattccaagaacacggtagaatcttacaaatgaacagcctagacgaaccgaggacacggccgtattattattgtataggttatggtgtaattcgggcccgtggggccagggaccgtggtcaccgtctcacgcgcctcacccg

SEQ ID NO: 136666 - DNA, 611 bp, Homo sapiens
  misc_feature: GYAE6OF01DSPRY.16.39.D06.1.454.CMB.1.raw
  modified_base (309)..(309): a, c, t, g, unknown or other
  misc_feature (309)..(309): n is a, c, g, or t
  modified_base (368)..(368): a, c, t, g, unknown or other
  misc_feature (368)..(368): n is a, c, g, or t
  modified_base (373)..(373): a, c, t, g, unknown or other
  misc_feature (373)..(373): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctgggaggaggcttgacccgaggccggggggtccctggagactctcctgtgcagcctcgtgggttcagcgtcagtaacaaccacgtgatgtgggtccncacgcctccgaggggaagggctggaatgggtctcgtagtttaatgaaaatggattggtnaacanaatcgtaacgccgactccgtagaagggccattcaccatctacagagacaattccaagaacacggtagaacttacttacaaatagaacagacctagaacgaaccgaggacgaaccggtaccgttaatacgttaagttagtaagttacggttagttagggtaggttaaacgtccgggtccccgtgggggtaccacggggtaccgtggtccaccgtcctacacgacgtccctcgaacccgg

SEQ ID NO: 136667 - DNA, 711 bp, Homo sapiens
  misc_feature: GYAE6OF01DSF79.16.39.D06.1.454.CMB.1.raw
  modified_base (178)..(178): a, c, t, g, unknown or other
  misc_feature (178)..(178): n is a, c, g, or t
tcagtgtactactccacgaccggtgctcgatttagtgacatctcgcagttcgtttgggtttggggagaggagcccagcactgggattccgaggtgtttccattcggtgatcagcactgaacacagaggactcaccatggagttttggctgagttggtttcctgctgctatttaaagtntccagtgtgaggtgtacttggtggagtcgtgggaggaggtcttcgacccgagggcccggggggtccctgacgacctcctcctgtcgcacgtcctcgtgggttcaggtccgtacgaacgtaaaccaaccgtacggtagagtggtcgggtcccgccgacggcccgtaccggaaggggaacgggcgtagggaacgttggggtccttagtaaggtttacgtagaaaagtggagttgggtacgaactaactaacgtccgtaaccggaccgtacgttccggtaggaacgggtccgtaacttccaacctacttcctaccgaagtaacgaactaacttaccgaaagtaacgtacggtagtaacttacttaacgaaagtcgaaactagaccgtagaacgaacccgaggacgaaccggtacttaagttacttagtttgtaacgttaggttagtggttacgtaaccgtccgggtacccgtagggacccgaagggttaccttcgggacctacccggtctcccacgccgtccacccggtaaaccgg

SEQ ID NO: 136668 - DNA, 626 bp, Homo sapiens
  misc_feature: GYAE6OF01EYYJ6.16.39.D06.1.454.CMB.1.raw
  modified_base (306)..(306): a, c, t, g, unknown or other
  misc_feature (306)..(306): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccagccggggggtccctgagactctcctgtgcagcctctgggttcagcgtcagtaaccaaccacgtgatgtcgggtccnccagccctccgaggggaaggggctggaagtgggtctcgagttattagaaaatgagtggtgacacaatctacgccgactccggtaggaacgggccattccaccatcctaccagacgacaattaccaagaacacggtagaactctacaaatgaacacgcctagaacgaaccgaggaccgaacggccgttaatacgttattgtaagtaggttagtggttacggttaagttcccggggccccgttcgggggaccgaacggggtaacccgttcggtacctacccggttccgtacccgtaccgaccgtcccgtcccgaaacccggg

SEQ ID NO: 136669 - DNA, 548 bp, Homo sapiens
  misc_feature: GYAE6OF01BKOQK.16.39.D06.1.454.CMB.1.raw
  modified_base (535)..(535): a, c, t, g, unknown or other
  misc_feature (535)..(535): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccagccggggggtccctgagactctcctgtgcagcctctgggttcagcgtcagtaacaaccacgtgatgtgggtccgccagcctccagggaaggggctgggaatgggtctcagttattgaaaatgatggtgacacaatctacgccgactccgtgaagggccgattcaccatctcagagacaattccaaagaacacggtagaatcttacaaatgaaacagcctagagaaccgaggacacggccgtatattattgtataggttatggtgtaattcgggccctggggcagggaccgtggtcaccgtctccnacgcctcgacccg

SEQ ID NO: 136670 - DNA, 685 bp, Homo sapiens
  misc_feature: GYAE6OF01ED70D.16.39.D06.1.454.CMB.1.raw
  modified_base (305)..(305): a, c, t, g, unknown or other
  misc_feature (305)..(305): n is a, c, g, or t
  modified_base (461)..(461): a, c, t, g, unknown or other
  misc_feature (461)..(461): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccgaggcccgggggggtccctgagactctcctgtgcagcctcgtgggttcagcgtcagtaacaaccacgtgatgtcgggtccnccagccctccgaggggagggctggaagtgggtctcgtagttatagaaaatgagtggtagacacaatctacgccgactccggtgaacggcctattccaactatcaccagagactaattaccaaagaactacggtagaacttcttaacaaatgaaacngtaccgtagaacgaaccgaggaaccgacgggtacccgttaattacgttaagttaggttaagtttaacgggttagttagggttacgggttaaacggtttccccgggggacccccggttaggggggacccgtaacgggggtaaccccggttcggggttacccgtaacccggttccgttaccccgtaccgaccggtacccccttacccgaacccggtaaacccgggg

SEQ ID NO: 136671 - DNA, 616 bp, Homo sapiens
  misc_feature: GYAE6OF01DZBDQ.16.39.D06.1.454.CMB.1.raw
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccgaggccggggggtccctgagactctcctgtgcagcctcgtgggttcagcgtcaagtaacaaccacgtgatggtcggtccgccacgcctccgaggggaagggctggaagtgggtctcagtttatagaaaatgagtggtagacacaatccgaacgccgactccgtaggaacgggcctattccacctatcctaccgagacgaactaacgttaccaaagtaaacacggtagaacttaccttaacaaatacgaacacgccgtagaacgaaccgaggaccgaacggtccgtaattattattagtaattaggttatggtaggtaacgttccgggcccgtggggaccacggggtacctggtaccaccgtctacctcgacgtcccgccgaacccgg

SEQ ID NO: 136672 - DNA, 577 bp, Homo sapiens
  misc_feature: GYAE6OF01A0N88.16.39.D06.1.454.CMB.1.raw
tcagtgtactactccacgaccggtgctcgatttagtgacatctcgcagttctttgggggagaggagcccagcactgggattccgaggtgtttccattcggtgatcagcaactgaacacagaggactcaccatggagttttggctgagttgggttttccttgctgctattttaaaggtgtccagtgtgaggtgtacttggtggagtctggaggaggcttgacccagccggggggtcctgagactctcctgtgcagcctctggttcagcgtcagtacaaccacgtgatgtgggtccgccagcccgtccgaggggaacggggctggaagttggggtctcgagttattgaaaatgaagtggtagacacaagtctacgccgactccgtgaaggccgatcaccatctcagagactaattccaagtacacggtagaatcttacaattgaacagcctgaagaccgaggacacggacctatattattgtaataggttatcgggtaggtaagttccgggacccgtgggggcccaggggaaccgtggtaccacccggtctccctctagcccttccgaccgtacccggg

SEQ ID NO: 136673 - DNA, 826 bp, Homo sapiens
  misc_feature: GYAE6OF01DZ9C1.16.39.D06.1.454.CMB.1.raw
  modified_base (180)..(180): a, c, t, g, unknown or other
  misc_feature (180)..(180): n is a, c, g, or t
  modified_base (324)..(324): a, c, t, g, unknown or other
  misc_feature (324)..(324): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggtttccttgctgctatttaaaggngtccagtgtgaggtgtacttggtggagtcgtgggaggaggcttggacccgagggcccggggggtccctgacgactctccgtgtgcacgcctcgtgggttcaggtcgtacaggtaaaccaaccgacgtgagttggtcgggtcccnccgacggcccgtaccggaaggggaacgggcctaggaagttcggggtcctacgtaagtttagttaggaaaaatggaagtgggtagaactaactaaacgtcgtaaccgacccgtacgttaccggtaggaaaccgggtcccggttaccaacccgttcaaaccgtaaggaaccgtaacctaacgtttacccgaaagtaacccgtaccgtacttaccttaacgtccgtacgtaccgttaaacgttaccggaaccctaacggtcccgttaacgggaccggtcccggaacccgggtaacggaaccccgtacccgggtacccttaacgttacggtttaaacgtttaacccgtaacggttaaaccgttaaacggtcccgggtaccggggtcccggtaccccgggtccgggtaaccccgggttaccgttccgggttaagtttccgggtttttaacggtaccgttttacggggtaccggggtaacccggttaaaggggtaccgttaaaccggg

SEQ ID NO: 136674 - DNA, 623 bp, Homo sapiens
  misc_feature: GYAE6OF01EAG09.16.39.D06.1.454.CMB.1.raw
  modified_base (260)..(260): a, c, t, g, unknown or other
  misc_feature (260)..(260): n is a, c, g, or t
  modified_base (374)..(374): a, c, t, g, unknown or other
  misc_feature (374)..(374): n is a, c, g, or t
  modified_base (449)..(449): a, c, t, g, unknown or other
  misc_feature (449)..(449): n is a, c, g, or t
tcagtgtactactccacgaccggtgctcgatttagtgacatctcgcagttctttgggggggagaggagcccagcactgggattccgaggtgtttccattcggtgatcagcactgaacacagaggactcaccatggagttttggctgagttgggttttccttgctgcttattttaaaaggtgtccagtgtgaggtgtacttggtggagtctgggaggaggcttgacccgaggcccgggggggtccctgagactctcctgtncagcctcgtggtcagcgtcaagtaaccaaccacgtgatggtcggtccgccacgccctaccggagggggacggggctagggaagtgggtctgtagttatagaaaatgagtggtanacacaatctaccgcgtacgtcggaggacggcctatcaccatccacagacgactaactaccaagaacgtacggtanaacttactaacaaatcgaacacgtaccagaacgaaccggagaccgacggtacttattaattagttagtattaggtatgggtagtacgttcccgggcccggtagggacccgtaggggaccgtcggtacccgtaccgtcctccgtaccgaccgtcccctaccgaccggtaacccgg

SEQ ID NO: 136675 - DNA, 658 bp, Homo sapiens
  misc_feature: GYAE6OF01BEIY9.16.39.D06.1.454.CMB.1.raw
  modified_base (406)..(406): a, c, t, g, unknown or other
  misc_feature (406)..(406): n is a, c, g, or t
  modified_base (504)..(504): a, c, t, g, unknown or other
  misc_feature (504)..(504): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggtagttttggctgtagtttgggttttccttgctgcttaattttaaaaggtgtccagtgtgaggtgtacttggtggagtcgtggaggaggtcttcgaccccgagggcccgggggggtccctggacgacctctccgtgtcgcacgtcctcgtgggttcacggtcgtacaacgtaaccaaccgacgtgagtggtcggtcccgccacgcccgtaccggaggggaacggggcgtaggaagtcgggtctacgtagttatagaaatgagtggtanacacatcaccgccgtacgtccgtagacggctatccactactctcgagacgaactaacttaccaaagaacctacggtataactctaacaagtcgaaacncgactggaacgaaccggaggaccaaccggtactattaattagttagtaattaggttagtggtacgttacggttcccgggcccggtagggacccgacgggtacccgttcggaccctacggttccctaccgtactccgccccgtaccgaacccggg

SEQ ID NO: 136676 - DNA, 554 bp, Homo sapiens
  misc_feature: GYAE6OF01AVW4S.16.39.D06.1.454.CMB.1.raw
  modified_base (303)..(303): a, c, t, g, unknown or other
  misc_feature (303)..(303): n is a, c, g, or t
  modified_base (354)..(354): a, c, t, g, unknown or other
  misc_feature (354)..(354): n is a, c, g, or t
  modified_base (413)..(413): a, c, t, g, unknown or other
  misc_feature (413)..(413): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaggtgtccagtgtgaggtgtacttggtggagtctggaggaggcttgacccaggccgggggggtcctgagactctcctgtgcagcctctgggttcagcgtcagtaacaaccacgtgatgtggtccncagcctcgagggagggctggatgggtctcagttatgaaatgatggtgacanaatctacgccgacccgtgaacggccgatcaccatcacagagacaatccaagaacacgtnaatcttacaaatgaacagcctagaacgaaccgaggacacggacctatattattgtataggttatggtagtacgtcgggacccgtgggccgtagggaccgtggtaccaccgttcgtacctcgagccctccgaccgtaaccgg

SEQ ID NO: 136677 - DNA, 545 bp, Homo sapiens
  misc_feature: GYAE6OF01AT7H1.16.39.D06.1.454.CMB.1.raw
  modified_base (534)..(535): a, c, t, g, unknown or other
  misc_feature (534)..(535): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccagccgggggggtccctgagactctcctgtgcagcctctgggttcagcgtcagtaacaaccacgtgatgtgggtccgccagcctccagggaggggctggaatgggtctcagttattgaaaatgatggtgacacaatctacgccgactccgtgaaggggccgattccaccatcctccagagacaattccaagaacacggtgaactcttacaaatgaacagcctgagaccgaggacacggcgtatattattgtataggttatggtgtaatcgggcccgtggggccagggaccgtggtcaccgtctccnncgcctcaccg

SEQ ID NO: 136678 - DNA, 680 bp, Homo sapiens
  misc_feature: GYAE6OF01BI1JA.16.39.D06.1.454.CMB.1.raw
  modified_base (321)..(321): a, c, t, g, unknown or other
  misc_feature (321)..(321): n is a, c, g, or t
  modified_base (383)..(383): a, c, t, g, unknown or other
  misc_feature (383)..(383): n is a, c, g, or t
  modified_base (389)..(389): a, c, t, g, unknown or other
  misc_feature (389)..(389): n is a, c, g, or t
tcagtgtactactccacgaccggtgctcgatttagtgacatctcgcaggtttcgtttggggggagaggagcccagcactgggattccgaggtgtttccattccggtgatcagcactgaacacagaggactcaccatgggagttttggctgagttgggttttccttgctgcttattttaaaaggtgtccagtgtgaggtgtacttggtggagtcgtggaggaggcttgacccaggccggggggtccctggacgactctccgtgtgcagccttcgtgggttcagcgtacaagtaaccaaccgacggtgagttggtgggtcccnccacgccctccgaggggaaggggcctagggaatggggtctcgtagttattagaaatgatggngaccanaatcacgccgactccgtgaacgggcattccaccatcctacagacacaacttaccaagaacgtaggtagaacttacttaacaatacgtaaacagtaccctaggaacgaaccggaggaccgacgggtaccgtaagttagtttagttacgttaagtttaggttagttacggggttaggttaacggttcccggggacccgttacgggggaccctaagggggtacccggttcgggttaccgtaacccggttctacccgtaccgtaaccgtcccctacccgtaacccggtaaccggg

SEQ ID NO: 136679 - DNA, 640 bp, Homo sapiens
  misc_feature: GYAE6OF01BD6CX.16.39.D06.1.454.CMB.1.raw
  modified_base (363)..(363): a, c, t, g, unknown or other
  misc_feature (363)..(363): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccaggccggggggtccctgagactctccgtgtgcagcctcgtggttcagcgtcagtaacaaccacgtgatgtcgggtccgccagcctccgagggaaggggctgggaatgggtctcgagttattagaaaatgatggngacacaatctacgcgactcgtgaacgggccattcacctatccgtacagacgactaacttaccaaagaaccacggtagaattccttacaaagtgaacagtcctaggaacgaaccggaggaaccacggtaccgtaattactttaagttagtaagttagggtttacttaggggttaggttaaacggttcccggggaccccgttgggggaccctaacgggggtaacccgttggtacccgtacccgttcctacccgtccgacgtcccctacccgaaccccgg

SEQ ID NO: 136680 - DNA, 608 bp, Homo sapiens
  misc_feature: GYAE6OF01EFAOY.16.39.D06.1.454.CMB.1.raw
  modified_base (376)..(376): a, c, t, g, unknown or other
  misc_feature (376)..(376): n is a, c, g, or t
  modified_base (423)..(423): a, c, t, g, unknown or other
  misc_feature (423)..(423): n is a, c, g, or t
  modified_base (441)..(441): a, c, t, g, unknown or other
  misc_feature (441)..(441): n is a, c, g, or t
  modified_base (450)..(450): a, c, t, g, unknown or other
  misc_feature (450)..(450): n is a, c, g, or t
  modified_base (458)..(458): a, c, t, g, unknown or other
  misc_feature (458)..(458): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgcttattttaaaaggtgtccagtgtgaggtgtacttggtggagtctggagggaggcttgacccgaggcccgggggggtccctgagactctcctgtgcacgcctcgtgggttcagcgtacaagtaaccaaccacgtgatggtcgggtcccgccacgccctccgaagggggacggggcgtggaagtgggtctcgtagttatagaaatgatggtanacacaatctacgccgactccggtagaacggctatccacatctcaganacaataccaagacagtanaacttctanaatgaacngcctagaacgaaccgagacacggactaattagttattagtattaggttagtggtagtacgttccgggccccgtggggacccgtaggggtacccgtggtaccctaccggttcctccgtaccgaccgtccctacccgaacccggtaaccggg

SEQ ID NO: 136681 - DNA, 691 bp, Homo sapiens
  misc_feature: GYAE6OF01DQF3O.16.39.D06.1.454.CMB.1.raw
  modified_base (478)..(478): a, c, t, g, unknown or other
  misc_feature (478)..(478): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctgggaggaggcttgacccgaggccgggggggtccctggacgactctcctgtgcagcctgtgggttcagcgtcagtaacaaccacgtgatggtcgggtccgccagccctcgaggggaagggctaggaagtggggtctacgtagtttattagaaaagtgagttggtagaaccaactaatccgtaccgcccgtacgtccggtaggaacgggcctacgttaccacctatacctccgaagacaacctaaattacccgaaagtaaccgtacggtaanaacttacttaacaaaagttcgaaacctacggacccgtaaggaacggaacccgaagggaacccacgggtacctaattacgtttagttaggtaatttaagggttagtacgggttaggttacgttccgggggtccccgtagggggtcccgaaggggtaaccggttcgtaccgtacccgtccctaccgtacacgtccccctacgaacccggaccggg

SEQ ID NO: 136682 - DNA, 552 bp, Homo sapiens
  misc_feature: GYAE6OF01E15FX.16.39.D06.1.454.CMB.1.raw
  modified_base (438)..(438): a, c, t, g, unknown or other
  misc_feature (438)..(438): n is a, c, g, or t
  modified_base (537)..(537): a, c, t, g, unknown or other
  misc_feature (537)..(537): n is a, c, g, or t
  modified_base (541)..(541): a, c, t, g, unknown or other
  misc_feature (541)..(541): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccaggccgggggggtccctgagactctcctgtgcagcctctgggttcagcgtcagtaacaaccacgtgatgtgggtccgccagcctccgagggaagggggctgggaatgggtctcgagttattagaaaatgatggtgacacaatctacgccgactccgtaggaagggccgattcaccatcctccagagaccaattccaaagaacacggtanaatctacaaatgaacagcctgacgaaccgaggacacggctatattatgtataggttatggtgtatcggccgtgggcagggacctggcaccgtctacccncacncctccgaaccg

SEQ ID NO: 136683 - DNA, 788 bp, Homo sapiens
  misc_feature: GYAE6OF01EMQQC.16.39.D06.1.454.CMB.1.raw
tcagtgtactactccacgaccggtgctcgatttagtgacatctcgcagttctttggggttttggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccaggccgggggggtccctgagactctcctgtgcagcctcgtgggttcagcgtcagtaaacaaccacgtgatggtcgggtccgccacgcctaccgaaggggaaggggcctggaacgtgggtctcgtagtttattagaaaatgagtggtagacactaatctacgccgactccggtaggaacgggcccgattccaacctagtcctaccgaagaacgtaaccaacgtttacccaaaaggaaacccgtaaccgggtaagtaaactttacctttaacgaaaaacgttacgaaaaccgtaacggtaccccgttaagggaaaccggaaaaccccgggaacgggaaacccgaacccggggtacccgtttaaagttaaacgttttaagtttacggttaagttaaggggttttaacgtggggtttaacggttaaccggtttacccgggggaccccccgggttaggggggtaaccccgaaacgggggttaaaccccggttcggtaacccgtaaccccggtttccgttaccccgtaccgtaaccggtacccccttacccggaaaaccccggg

SEQ ID NO: 136684 - DNA, 764 bp, Homo sapiens
  misc_feature: GYAE6OF01CFJ5O.16.39.D06.1.454.CMB.1.raw
  modified_base (321)..(321): a, c, t, g, unknown or other
  misc_feature (321)..(321): n is a, c, g, or t
  modified_base (478)..(478): a, c, t, g, unknown or other
  misc_feature (478)..(478): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaggtgtccagtgtgaggtgtacttggtggagtctgggaggaggtcttcggacccgaggcccgggggggtccctggacgtactcgtcctgtcgcgacgcctcgtggttcagcgtcagtaaccaacgacgtgagtggtcggtccnccacgcctaccgaggggacgggcgtggaagtggtctacgtagttaagtagaaatgagtggtagacactaactcgacgccgacgtcggaggaacggcctagttccacctagtcctacgaagtacgaactaacgttacccgaagaaaccgtacggtaanaaacttcctaacaaacgtcgaaactacgtaccgtaggaacgaaacccgacgggtaaccgaccgggtaaccgttaagttacgtttaagttacggtttaacgttagggtttaacgttacggggttaacggttaacccggtttacccggggaccccccgggtttaggggggaaccccgtaaaccggggggttaacccggttccgggtttaacccggtaacccccgggtttcccgttaacccgtacccggtaaccccgttcccccgttaaccccgggtaaaacccccggg

SEQ ID NO: 136685 - DNA, 600 bp, Homo sapiens
  misc_feature: GYAE6OF01AYTJ1.16.39.D06.1.454.CMB.1.raw
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccaggccgggggggtccctgagactctcctgtgcagcctcgtggttcagcgtcagtaacaaccacgtgatgtggtccgccagcctccgagggaagggctggatgggtctcagttattagaaaatgatggtgacacaatctacgccgactccgtggaacggccattcacctatcctaccgagacgactaattaccaaagaaccacgggtagaacttcttacaaagttcgaacagcctagacgaaccgaggacacggacctattattattgtaagttacggttatgggttagttaacgttcccggggcccgtggggccacggggtaaccgtggtacctacccggtctaccgtaccacgtcccgtcccgaacccgg

SEQ ID NO: 136686 - DNA, 758 bp, Homo sapiens
  misc_feature: GYAE6OF01BLX8N.16.39.D06.1.454.CMB.1.raw
tcagtgtactactccacgaccggtgctcgatttagtgacatctcgcagttcgtttgggggagaggagcccagcactgggattccgaggtgtttccattcggtgatcagcactgaacacagaggactcaccatggtagttttggctgtagtttgggttttccttgctgcttaattttaaaggtgtccagtgtgaggtgtacgttggtggagtcgtgggaggaggtcttcgaccccgagggcccgggggggtccctggacgactcctcctgtgcagtcctcgtgggttcagcgtcaagtaaccaaccacgtgatggtcggtcccgccagccctaccggaggggaaggggtctaggaagtcgggtctcgtagtttattagaaaatgagtggtagacacatctacgccgacgtccggtagacggcctacttccacctatccaccgaagacgaacctaacttaccgaaagaaccgtacggtaacgtaacttaccttaacaaacgtacgaaaccaacgtcccgtacggaacgaaacccggaagggaaccgaccgggtaaccgttaacgttaagtttaagtttaggttaagtttaagggtttaacgttgggttaagggtttaaaccggtttcccgggggtacccccggtacgggggtaccccggtaaacggggtaaccccgggttcgggttacccctaccccggttacccgttaccccgttaccgaacccggtcccccgtaccccgaaccccggaaaccccgggg

SEQ ID NO: 136687 - DNA, 702 bp, Homo sapiens
  misc_feature: GYAE6OF01AX312.16.39.D06.1.454.CMB.1.raw
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttggttttccttgctgctattttaaaggtgtccagtgtgaggtgtacttggtggagtctggaggaggcttgacccgaggccggggggtccctgagactctcctgtgcagcctgtgggttcagcgtcagtaacaaccacgtgatggtcgggtcccgccacgcccgtaccggaggggaacggggctgggaagtgggtctcgagttatagaaaatgatggtagacacaatcgtacgccgacgtccggtaggaacggtccgtacttccaacctactaccgtaccgaagacgaacctaaacttacccgaaaggaaactacgggtagtaaacttaccgtttaacaaattacgaaaccacgtacccgtaaggaacgaaccggacggtaaccggaaccggtaccgttaagttagtttacgttagttaagttaaggttagttacgggttaaggttaacggttcccggggtaccccgttaggggacccggtacggggtaacccggtcgggtacccgtacccgttccgtcccgtacgaccgtcccctacccgaccggtaacccggg

SEQ ID NO: 136688 - DNA, 683 bp, Homo sapiens
  misc_feature: GYAE6OF01B25QS.16.39.D06.1.454.CMB.1.raw
  modified_base (338)..(338): a, c, t, g, unknown or other
  misc_feature (338)..(338): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccaggccgggggggtccctgagactctcctgtgcagcctctgggttcagcgtcaagtaacaaccacgtgatggtcgggtccgccagccctcgaggggaagggctggagtgggtctnagttatagaaaatgatggtagacacaatcctacgccgactccggtaggaacgggccgtatccaccactcctaccagacgaacaacttaccaagaacgacggtagaacttcgttaacaaattacgaacacgtaccctaggaacgaacccggaacgggaccaacccgggtaccgttaacttaagtttacgttagttaacgttaagggtttacgttaggggttacggttaaacggtttcccggggaccccggttcggggggtacccgacggggggtaacccggttcgggtccctaacccggtcccttcccgtaccgaccgtccccttcccgaacccgggtaacccggg

SEQ ID NO: 136689 - DNA, 789 bp, Homo sapiens
  misc_feature: GYAE6OF01BZXUS.16.39.D06.1.454.CMB.1.raw
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggtttccttgctgctattttaaaggtgtccagtgtgaggtgtacgttggtggagtctgggaggaggcttgacccgagggcccggggggtccctgacgtacctctccgtgtgcacgcctcgtgggttcagccgtacaagtaacaaccacgtgatggtcgggtcccgccgacgccctaccggaaggggaacgggctagggaatcggggtctacgtagtttagttaagaaaagtgagtggtacgaactaacgtaattaccgtaccgcccgtaaccgtccggtaaggaacggggccctagttaccaaccacttccgtaccgaagtactaaacgtaaacttacccgaaagtaaaccgtaacgggtagtaaactttaccgtttaacgaaaagttacggaaaccttaacggaccccttagggaaaaccggaaaacccggacgggaaacccgaaaccgggtacccgtttaagttaaaccgttttaagtttacggtttaaaggttacgggtttaagtagggttaacgggttaacggttaccccgggtccccgggttagggggtacccgtaacgggggtacccgtcgggttacccgaaccccgttcgtaccccgtaccgaccgtcccgtccccgtaaacccggg

SEQ ID NO: 136690 - DNA, 582 bp, Homo sapiens
  misc_feature: GYAE6OF01CL8L7.16.39.D06.1.454.CMB.1.raw
  modified_base (353)..(353): a, c, t, g, unknown or other
  misc_feature (353)..(353): n is a, c, g, or t
  modified_base (357)..(357): a, c, t, g, unknown or other
  misc_feature (357)..(357): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctgggaggaggcttgacccaggccgggggggtccctgagactctcctgtgcagcctcgtgggttcagcgtcagtaacaaccacgtgatgtggtccgcagcctccgagggagggctggaatgggtctcagttatagaaaatgatggtnacanaatctacgccgactccgtagaaggccattcacctatcctacagacgacaattaccaagaacacggtagaatcttacaatagaacagcctagaacgaacgaggacacggacctataacttattagtaattaggttatgggttaggttaacgtccgggcccgtaggggaccgtaaggggaaccgtcggtaccaccgtcgtcctacgacgccctccgaaccgaaccgg

SEQ ID NO: 136691 - DNA, 753 bp, Homo sapiens
  misc_feature: GYAE6OF01CTLU5.16.39.D06.1.454.CMB.1.raw
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccaggccggggggtccctgagactctcctgtgcagcctctgggttcagcgtcagtaacaaccacgtgatggtcgggtccgccgacgccgtaccgaaggggtaacggggctagggaacgttcggggtctcgtaagtttattagaaaatggatgggtagaacacaactcgtaccgccgactccggtagaacgggtccattaccgactatctaccaaggacgtaactaacttacccgaaagtaaaccgtacgggtagaaacttccgtttaacaaaagttacgaaacctacggtaccgtacggaacgggaaaccccgagggaaacccgaccgggtacccgtttaaagtaacgttttaagttacgggtttaacgttagggtttacgttagggttacggttaaaacggttccccgggggccccggttaggggggtaaccccgtaaacggggggttaaccccgttcggggttaaccctccccgggttaccttacccgtacccgaacccggtccccgttaacccgaaccccggg

SEQ ID NO: 136692 - DNA, 653 bp, Homo sapiens
  misc_feature: GYAE6OF01C2X60.16.39.D06.1.454.CMB.1.raw
  modified_base (343)..(343): a, c, t, g, unknown or other
  misc_feature (343)..(343): n is a, c, g, or t
  modified_base (373)..(373): a, c, t, g, unknown or other
  misc_feature (373)..(373): n is a, c, g, or t
  modified_base (562)..(562): a, c, t, g, unknown or other
  misc_feature (562)..(562): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctatttaaaaggtgtccagtgtgaggtgtacttggtggagtctggaggaggcttgacccgaggccgggggggtccctgagactctcctgtgcagcctctggacttcacctttagtgcctatcgccagtgagcgtcgggtccgccaggctaccgaggggaagggctaagagtgggtctanaagtatcaacaagcaagtagtacgtaccgnagtggtacgcagtacctccggtaggaacggtcccgtttacaccattcctaccgagaacgtactaaacgttacccgaaagaaaccgacgtcttagttactttacggaactaaaagtcgaaacgtagttacgtaggaaagtcgggtaacggaacgggaccgaaccgggtacctaattattaactttaacgnggtagacgggtaaagggtccggggtaagtttcggggtagggacggttagacgttcggtactttagttacggaaccgttgggtaaccggggg

SEQ ID NO: 136693 - DNA, 684 bp, Homo sapiens
  misc_feature: GYAE6OF01AXOQC.16.39.D06.1.454.CMB.1.raw
  modified_base (301)..(301): a, c, t, g, unknown or other
  misc_feature (301)..(301): n is a, c, g, or t
  modified_base (332)..(332): a, c, t, g, unknown or other
  misc_feature (332)..(332): n is a, c, g, or t
  modified_base (351)..(351): a, c, t, g, unknown or other
  misc_feature (351)..(351): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggtttccttgctgctatttaaaggtgtccagtgtgaggtgtacttggtggagtctggaggaggcttgacccgaggccgggggggtccctgagactctcctgtgcagcctcgtgggttcagcgtcagtaaccaaccacgtgatgtgggtccnccagccctcgagggagggctggatgggtctnagttatgaaaatgatggtnacacaatcgtacgcccgactccggtgaacgggccgattccaaccctatcctaccgagacgaacgtaattaccccaaagaacctaacggtagaaacttccttaacaaagtacgaaaccacgcccgtaggaacggaaacccgaagggacgaacccgggaccgttaattaacgtttaagttagtttaagttaacgggtttagttaggggttacggttaaacgttccccgggggacccccgttagggggaccccgtaaggggaaccccggttgggtacccctacccggttcctaccccgtactacccggacccctccccgaaccccggtaaaccggg

SEQ ID NO: 136694 - DNA, 664 bp, Homo sapiens
  misc_feature: GYAE6OF01CBQTB.16.39.D06.1.454.CMB.1.raw
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctattttaaaaggtgtcagtgtgaggtgtacttggtggagtctggaggaggcttgacccaggccggggggtccctgagactctcctgtgcagcctcgtgggttcagcgtcagtaacaaccacgtgatgtcgggtccgccacgcctcgaggggaacgggctggaagtgggtctcgtagttatagaaaatgagtggtgaacacaatctacgccgacgtccgtaggaacggtccgattccgacctactcctaccaagaacgaacctaacttaccgaaagaaccaacggttagaaacttaccttacaaatacgaacagtcctaggaacgaaccggacggacgaccggtacgtattaacttagttagttaagttaggttataggggttacggttaacggttcccgggaccccggtgggggacccgtaacgggggtaacccggttcgggtaccctaacccggttcctcccgtaccgacgtcccctacccgacccggtaaacccggg

SEQ ID NO: 136695 - DNA, 685 bp, Homo sapiens
  misc_feature: GYAE6OF01BWFVR.16.39.D06.1.454.CMB.1.raw
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaagtgtccagtgtgaggtgtacttggtggagtcgtggaggaggcttgacccgaggccggggggtccctgagactctcctgtgcacgcctcgtgggttcaggcgtacacgtaacaacctacgtgatggtcgggtccccgccacgtcccgtccggaaggggaacggggcgtaggaagtgggtctcgtagtttatagaaaatgagtggtacgacaactaactcgtaccgccgtaaccgtccggtaggaacgggcgtacttccaccactcctaccagacgaactaacttaccgaaagtaaccgacggtagtaaacttcttaacgaaatacgaaacgacgtacctaaggaacggaaaccggacgggaacctaaccgggtccttaaattaagtttacgtttagtaagttaggttagttcggttaggttacgttccgggacccggtggggtaccacggggtaccgtcggtaccgtacccgttcctaccgtaccgcctccgcccgtaaacccggg

SEQ ID NO: 136696 - DNA, 892 bp, Homo sapiens
  misc_feature: GYAE6OF01C9DU2.16.39.D06.1.454.CMB.1.raw
tcagtgtactactccacgaccggtgctcgatttagtgacatctcgcagttctttggggggagaggagcccagcactgggattccgaggtgtttccattcggtgactcgagcactagaaccacaggagacctcaccagtggtaggtttgctagtaggttttcggttttcctgtctgtactttaagtttaaaggtctcgtagtgtgtaggttgttacgttgggtggagttcgtaggggaggaggtcgttaccgacccgacgggggtcccggggggttccctaggaacgtccttcctccgttggtcgcacgtcccgtcggttcgggtacacggtccgttacgaaacggttaaacccaacccgtacggtagtacgttggggttccgggtaccccaccgacggtccccgtacggggaagggggacgggtcgtagggtaggtcggtctagtagtttataagaaatgtaagtggtacaactactactccgaccgcccgtacgtcggtaggaaccggtcctataccacctatcccgacgtagaacaactaaccttacgaaacgtacggtacgtaagtaacttactaacaacgttacgaaccgtacgtaccggtaacggaaacccggtaacccgggaaccggtaacccggtaaacccggtttaccgttaaattttaacgtttacggttttaagttaagggttttaaacggtttagggttaacgggggtttaaccggtttaacccgggttcccccgggggtacccgggttacggggggtaaaccccgggtaacggggggttaccccggttcgggttacccccgttacccggtttaccccggttcccgtaacccgtccccggttaaccccccgtccccggaaacccgggttaaacccccgggg

SEQ ID NO: 136697 - DNA, 618 bp, Homo sapiens
  misc_feature: GYAE6OF01DRERJ.16.39.D06.1.454.CMB.1.raw
  modified_base (600)..(600): a, c, t, g, unknown or other
  misc_feature (600)..(600): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctgggaggaggcttgacccgaggcccgggggggtccctggagactcctcctgtgcagcctcgtgggttcagcgtcagtaacaaccacgtgagtgtcgggtcccgccagcctccgaggggaaggggctagggaatgggtctcgtagttatagaaaatgatggcacacaatcacgccgactcggagaacgggccatcacctatccacagacgaactaacttaccaagaacgaacgtagtaactacttaacaaatacgaaacacgcctagaacgaaccgaacggaacgacgggtaccttaataattattagttaagttaggttagttggtaggttacgtccgggtcccgtcggggaccgacgggtaccgtcggtaccaccgtcctacctacnccgtccctccgaacccgg

SEQ ID NO: 136698 - DNA, 654 bp, Homo sapiens
  misc_feature: GYAE6OF01DXIDB.16.39.D06.1.454.CMB.1.raw
  modified_base (306)..(306): a, c, t, g, unknown or other
  misc_feature (306)..(306): n is a, c, g, or t
  modified_base (357)..(357): a, c, t, g, unknown or other
  misc_feature (357)..(357): n is a, c, g, or t
  modified_base (441)..(441): a, c, t, g, unknown or other
  misc_feature (441)..(441): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccaggccgggggggtccctgagactctcctgtgcagcctctgggttcagcgtcagtaacaaccacgtgatgtgggtccnccagcctccgagggagggctggaatgggtctcagttatagaaatgatggtnacacaatctacgccgacgtccgtgaacgggccgtattccacctatcctaccagaacgactaacttaccaaagaactacgggtanaacttccttacaaagttcgaacgtacgccctaggaacgaacccggaggaaccgaccgggtccgttaatattttaagttaggttaagttagggtttaagtgggttacgggttaacgtttccggggaccccgtgggggtacccgaaggggtaaccccgttgggtaccctaccccggttcctacccgttccgacggtccccgtcccgaaacccggg

SEQ ID NO: 136699 - DNA, 668 bp, Homo sapiens
  misc_feature: GYAE6OF01EET2E.16.39.D06.1.454.CMB.1.raw
  modified_base (430)..(430): a, c, t, g, unknown or other
  misc_feature (430)..(430): n is a, c, g, or t
  modified_base (441)..(441): a, c, t, g, unknown or other
  misc_feature (441)..(441): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccgaggccgggggggtccctggagactctcctgtgcagcctcgtgggttcagcgtcagtaacaaccacgtgatggtgggtccgccagccctccgaggggaacgggctggaatgggtctcagtttatagaaaatgatggtagacacaatcacgccgactccgtgaacggcattccacatctaccagacgacaattccaagaacaggtanaattccttaanaagtacgaaacacgtaccgtagaacggaacccggaggaaccgaaccggtaccgttaattaacgtttagttacgttaagttagggttagtaggggttaggttaaccggttcccggggaccccgttaggggggaccctaaggggggtaaccccggttgggtaccccgtaacccggttccgttcccgtaccgtaaccggtcccctaacccgaaccccggtaaacccgggg

SEQ ID NO: 136700 - DNA, 582 bp, Homo sapiens
  misc_feature: GYAE6OF01BC8GH.16.39.D06.1.454.CMB.1.raw
  modified_base (436)..(436): a, c, t, g, unknown or other
  misc_feature (436)..(436): n is a, c, g, or t
  modified_base (453)..(453): a, c, t, g, unknown or other
  misc_feature (453)..(453): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctgggaggaggcttgacccgaggccgggggggtccctgagactctcctgtgcagcctcgtgggttcagcgtcagtaacaaccacgtgatgtgggtccgccagccctccgaggggaaggggctggaatgggtctcgagttatagaaaatgatggtgacacaatctacgccgactccgtggaacgggccattcacctatcctccagacgactaattaccaagaacacggtanaatcttacaatagaacngaccctagaacgaaccgaggaacacggacctatattattagtataggttatggtaggtacgttccgggcccgtggggcctaggggaccgtggtaccaccgtctccctcacgccctccgaccgtaaccgg

SEQ ID NO: 136701 - DNA, 662 bp, Homo sapiens
  misc_feature: GYAE6OF01CY20L.16.39.D06.1.454.CMB.1.raw
  modified_base (373)..(373): a, c, t, g, unknown or other
  misc_feature (373)..(373): n is a, c, g, or t
  modified_base (462)..(462): a, c, t, g, unknown or other
  misc_feature (462)..(462): n is a, c, g, or t
  modified_base (484)..(484): a, c, t, g, unknown or other
  misc_feature (484)..(484): n is a, c, g, or t
tcagtgtactactccacgaccggtgctcgatttagtgacatctcgcagttctttggggggagaggagcccagcactgggattccgaggtgtttccattcggtgatcagcactgacacagaggactcaccatggagttttggctgagttgggttttccttgctgctattttaaaaggtgtcagtgtgaggtgtacttggtggagtctggaggaggcttgacccgaggcccggggggtccctgagactctcctgtgcagcctcgtcgggttcaggccgtcacgtaacaaccacgtgatcgtgggtccgccagcctccgaaggggtaacgggcgtggaagtcgggtactcgtagttacttagaaaatgtagtcggngacacgaatcgtacgccgacgtccgtaggaacggtccgattccgacctatcctaccgagaacgaacaacgttaccaagaacacgggtanaaactcttacaaatcggaaacncgacctagaacgaaccggagtacgaacggtccgttaatacgttagttagttaagttaggtttagtgggttaagggtttaacgttccggggccccgttgggggaccgtaacgggtacccgggttggtccctaaccggtccttcccgtacgtacgccccgtcccgtaaccgaacccgggg

SEQ ID NO: 136702 - DNA, 620 bp, Homo sapiens
  misc_feature: GYAE6OF01CP66T.16.39.D06.1.454.CMB.1.raw
  modified_base (370)..(370): a, c, t, g, unknown or other
  misc_feature (370)..(370): n is a, c, g, or t
  modified_base (449)..(449): a, c, t, g, unknown or other
  misc_feature (449)..(449): n is a, c, g, or t
  modified_base (464)..(464): a, c, t, g, unknown or other
  misc_feature (464)..(464): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctgggaggaggcttgacccaggccggggggtccctgagactctcctgtgcagcctcgtgggttcagcgtcagtaacaaccacgtgatggtcgggtccgccacgccgtccgaggggaaggggctggaagtcgggtctcgagtttatagaaaatgatggtnacacaatctacgccgtacgtccggtagaacgggccgtattccacctatctcaagacgactaataccaagaacacggtanaatctacaatgaacngcctagacgaacgagacacggtaccgtaattagtagttgttaagtaggttagtgggttacggtaacgttcccggggacccgttcgggggaccgtaacggggtaaccggttcggttaccgacccgttctacccgtcgaccgtccctaccgaacccgg

SEQ ID NO: 136703 - DNA, 634 bp, Homo sapiens
  misc_feature: GYAE6OF01EHCFZ.16.39.D06.1.454.CMB.1.raw
  modified_base (306)..(306): a, c, t, g, unknown or other
  misc_feature (306)..(306): n is a, c, g, or t
  modified_base (364)..(364): a, c, t, g, unknown or other
  misc_feature (364)..(364): n is a, c, g, or t
  modified_base (368)..(368): a, c, t, g, unknown or other
  misc_feature (368)..(368): n is a, c, g, or t
  modified_base (431)..(431): a, c, t, g, unknown or other
  misc_feature (431)..(431): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccgaggccgggggggtccctgagactctcctgtgcagcctctgggttcagcgtcagtaacaccacgtgatggtggtccnccagcctccgaggggaggggcgtggaagtgggtctctagttattagaaaatgatggtnacanaatcacgcacgtcgtagagggccatcaccatcaccagacgacaagttccaaagacgacggtanaattctaacaaagtcaaacacgacctaggaacgaaccggaggaccgacggaccgttaattatttaagttgtaatttagggttagtagggttaggttaaaccgttccggggtaccccggttagggggacccgtaagggggtacccgttacgggtcccgtacccggttccctacccgtcgtacccgtcccctacccggaacccgg

SEQ ID NO: 136704 - DNA, 583 bp, Homo sapiens
  misc_feature: GYAE6OF01B4GG0.16.39.D06.1.454.CMB.1.raw
  modified_base (359)..(359): a, c, t, g, unknown or other
  misc_feature (359)..(359): n is a, c, g, or t
  modified_base (448)..(448): a, c, t, g, unknown or other
  misc_feature (448)..(448): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccagccgggggggtccctgagactctcctgtgcagcctctgggttcagcgtcagtaaccaaccacgtgatgtgggtcccgccagccctccgaggggaaggggctggaagtgggtctcagttattgaaaatgatggtnaacacaatctacgccgactccggtagaacgggccattcaccatcctccagacacaacttccaagaacacggtagaatctacaatgaacngacctagacgaaccgaggacacggcctatattattgtaagttaggttatggtggtacgttccgggccctggggcccagggtaacccgtgggtacctaccggtctcccgtacacgtccctcccacccggtaacggg

SEQ ID NO: 136705 - DNA, 703 bp, Homo sapiens
  misc_feature: GYAE6OF01A7EG1.16.39.D06.1.454.CMB.1.raw
  modified_base (362)..(362): a, c, t, g, unknown or other
  misc_feature (362)..(362): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctattttaaaggtgtccagtgtgaggtgtacttggtggagtcgtggaggaggcttcgacccgaggcccgggggggtccctgagactctcctgtgcagcctcgtggttcagcgtcagtaacaaccacgtgatgtggtccgccagcctccgaggggaagggctggaagtgggtctcgtagttatagaaaatgaatggtanacacaatcgtacgccgactccgtagaacgggcctattccaccatcctaccagacgaactaaacttaccaaagaacgaacggtagaaacttccttaacaaagtacgaaacacgaccctagaacgaaccggaagggaaccgaccgggtaacccgttaattaacgtttaagttacgttaagttaagggtttagttaggggttaaggttaacggttcccggggtacccccggttaggggggaccccggtaagggggtaacccggttcgggtaccccgtaaccccggttcccgtaccccgttaccgaaccggtcccccttaccccgaaccccgggtaaaccccggg

SEQ ID NO: 136706 - DNA, 723 bp, Homo sapiens
  misc_feature: GYAE6OF01ES9WM.16.39.D06.1.454.CMB.1.raw
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccaggccgggggggtccctgagactctcctgtgcagcctctgggttcagcgtcagtaacaaccacgtgatgtgggtccgccagcctccgaggggaaggggctgggaagtgggtctcgagttattagaaaatgagtggtagacacaatctacgccgactccgtaggaacgggccattcaccactcctaccagacgaactaacttacccgaaagaaaccaacgggtagtaaattaccttacaaaattgaaacacggacctaggaacgaacccggaaggaaccgaaccgggtacccgtaattaacgttttaagttaggttaagttaacgggtttaagttggggttaagggtttaaaccgtttcccggggggtaccccccggttacgggggggtacccgtaacgggggggtaaaccccggttcggggttaccccgtaaaccccgggtttccctaccccggttacccgaacccggtccccctaccccgtaaaacccccggg

SEQ ID NO: 136707 - DNA, 600 bp, Homo sapiens
  misc_feature: GYAE6OF01BGLE6.16.39.D06.1.454.CMB.1.raw
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccgaggccgggggggtccctgagactctcctgtgcagcctctgggttcagcgtcagtaacaaccacgtgatgtgggtccgccagcctccgaggggaaggggctaggaatgggtctcgagttattgaaaatgatggtgacacaatcacgccgactccgtggaacgggccgatttcacccatcctaccagacgactaacttaccaaacgaacacggtataatccttacaaattcgaacagaccagaacgaaccgaggacacggtacgtaatattagttagtagttaggtagtggtagttaacgttccgggcccgtggggacccgagggtacccgtggtccgacccgtctcccgtacacgtcccgtccgaacccgg

SEQ ID NO: 136708 - DNA, 680 bp, Homo sapiens
  misc_feature: GYAE6OF01C40RP.16.39.D06.1.454.CMB.1.raw
  modified_base (217)..(217): a, c, t, g, unknown or other
  misc_feature (217)..(217): n is a, c, g, or t
  modified_base (305)..(305): a, c, t, g, unknown or other
  misc_feature (305)..(305): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttcctgctgctattttaaaggtgtccagtgtgaggtgtacttggtggagtctggaggnggcttgacccaggccggggggtcctgagactctcctgtgcagctcgtggttcagcgtcgagtaacaacgacgtgagtggtcgggtccncgacgccgtccgaaggggaacgggctaggaacgtgggtctcgtagtttaagttagaaaatggagtggtacaacacgaaatccgacgccgactccgtaggaacggcgtattcgactatcctacagacacaattacccgaaagaaccgtaggtaagtaacttaccgttaacaaagtacgaaacctagaccgtagaacggtaaccggaaggacccgaaccgggtaccgttaaagttacgtttaagttcggttaaagttaggttaacggttgggttaacggttaacggttcccgggtcccgtaggggtaccggaacggggtacccgttcggtacccgtacccgtccgttacccacgcgtaccccgtctaaaccccgggg

SEQ ID NO: 136709 - DNA, 588 bp, Homo sapiens
  misc_feature: GYAE6OF01BO57B.16.39.D06.1.454.CMB.1.raw
  modified_base (368)..(368): a, c, t, g, unknown or other
  misc_feature (368)..(368): n is a, c, g, or t
  modified_base (406)..(406): a, c, t, g, unknown or other
  misc_feature (406)..(406): n is a, c, g, or t
  modified_base (409)..(409): a, c, t, g, unknown or other
  misc_feature (409)..(409): n is a, c, g, or t
  modified_base (420)..(420): a, c, t, g, unknown or other
  misc_feature (420)..(420): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctgggaggaggcttgaccccagccgggggggtccctgagactctcctgtgcagcctctgggttcagcgtcagtaacaccacgtgatgtgggtccgccagcctccgaggggaaggggctgggaatggggtctcgagttattgaaaatgatggtgacanaatcacgccgactccgtgaagggccattacacatcacnganactactacaanaacgtgtagaacttctaataagtacgaacacgactagaacggaaccgaggaaccgacgggtacctaattattagtacgtaagttagttagtggtagttacgtcccggtcggtcgggtacggacggtaccggtggacccttacgtcctcctagctcccgcgtaacccgg

SEQ ID NO: 136710 - DNA, 683 bp, Homo sapiens
  misc_feature: GYAE6OF01BF4CJ.16.39.D06.1.454.CMB.1.raw
  modified_base (471)..(471): a, c, t, g, unknown or other
  misc_feature (471)..(471): n is a, c, g, or t
  modified_base (497)..(497): a, c, t, g, unknown or other
  misc_feature (497)..(497): n is a, c, g, or t
tcagtgtactactccacgaccggtgctcgatttagtgacatctcgcagttctttgggttttggggagaggagcccagcactgggattccgaggtgtttccattctgtgatcagcactgaacacagaggactcaccatggagttttggctgagttgggtttccttgctgctattttaaaaggtgtccagtgtgaggtgtacttggtggagtcgtggaggaggcttgacccgaggccgggggggtccctgagactctcctgtgcagcctcgtggttcagcgtcagtaacaaccacgtgatggtcggtccgccagcctccgaggggaacggggcgtggaagtcgggtctcgagttatagaaaatgagtggtgaacacgtaatcgtaccgccgactaccggtagaacgggccgtattccaacctactccctaccgaagtagaaccctaattaccccgaaaggaaccgacggttanaacttaccttaataaacgcgaaaccngtaacccctggaaaccgaacggacggaccaacgggaccttaattaatttacgttacggttaattacgggtttagtaggggttacgttaaccggtttcccggggacccggttggggacccgtaaccgggggtaacccgttcgggtacccgtacccgttcacccggtcgtacccgccctaaaccccgg

SEQ ID NO: 136711 - DNA, 567 bp, Homo sapiens
  misc_feature: GYAE6OF01A2LN3.16.39.D06.1.454.CMB.1.raw
  modified_base (420)..(420): a, c, t, g, unknown or other
  misc_feature (420)..(420): n is a, c, g, or t
  modified_base (428)..(428): a, c, t, g, unknown or other
  misc_feature (428)..(428): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctatttaaaaggtgtccagtgtgaggtgtacttggtggagtctggaggaggcttgacccgaggccggggggtccctgagactctcctgtgcagcctctggtcagcgtcagtaacaaccacgtgagtgtgggtccgccacgcctccgaggggaagggcgtaggaagtgggtctcgtagttattagaaaatgatggtagacacaatcacgccgactcggtagaggccatcacatctcagacacactcaagacaggtanaactctanaagtacgaacagcagagaaccgacgacgacgacgtatactattgtataggttatggtagtacgttccgggcccgtggggtccgagggtaccgtcggtaccgtaccgtctccctgaccgtccctaccgaccggtaaccgg

SEQ ID NO: 136712 - DNA, 697 bp, Homo sapiens
  misc_feature: GYAE6OF01B8GJE.16.39.D06.1.454.CMB.1.raw
  modified_base (386)..(386): a, c, t, g, unknown or other
  misc_feature (386)..(386): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttggttttccttgctgcttattttaaaaggtgtccagtgtgaggttgtacgttggtggagtcgtggaggaggcttgaccccgagggccggggggtccctgacgactcctccgtgtgcgacgcctcgtggttcagtccgtcaagtaaaccaaccacgtgagtggtcggtccgccgagccgtacggaagggaggcgtaggaagtgggtctcgtagttagtagaaaatgagtggtanacaactaatcgtacgccgtacgtccggtaggaacgggtcctagtccaacctctcaccgagaacgaactaacttacaaacgaacgtacggtaacaaagttcctaacaaagtacgaaaccacgtaccgtaggaacggaaccgaacggaaccgaaccgtacgttaagttaatttaacgttagttaacgttagggttaacgttaggttaacggttacggttacccgggtaccccggtcgggacccgtaacggggtacccgttcggtaccgtacccgttccgtaccctaccgaccgtcccgtcccgtaaacccggg

SEQ ID NO: 136713 - DNA, 702 bp, Homo sapiens
  misc_feature: GYAE6OF01EPMWH.16.39.D06.1.454.CMB.1.raw
  modified_base (364)..(364): a, c, t, g, unknown or other
  misc_feature (364)..(364): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttggtttccttgctgctattttaaaaggtgtccagtgtgaggtgtacttggtggagtctggaggaggcttgacccgaggccggggggtccctgagactctcctgtgcagcctgtggttcagcgtcagtaacaaccacgtgatggtcggtccgccacgcctacgagggaacgggctaggaagtgggtctcgtagttatagaaaatgatggtanacacaatcgtacgccgacgtccgtagaacggccgtattccaacctatccgtaccagaacgaactaacttaccgaaagaacgtaacggtagaaactttccttaacgaaacgttcgaaactacggtacccgtaaggaaaccggaacccggaacggacccgaaccgggtaccgttaattaacgttttagttacgttaagttacgggtttaagttgggttaagggtttaaaccgttcccgggggtacccccggttagggggaccccgtaagggggtaaccccgttcgggtacccgtacccggttccttacccgtacaccggtcccctacccgaaaccccggg

SEQ ID NO: 136714 - DNA, 727 bp, Homo sapiens
  misc_feature: GYAE6OF01BHNY3.16.39.D06.1.454.CMB.1.raw
  modified_base (373)..(373): a, c, t, g, unknown or other
  misc_feature (373)..(373): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtcgtggaggaggcttgacccgaggccggggggtccctgagactctccgtgtgcagcctcgtgggttcagcgtcagtaacaaccacgtgatggtcgggtccgccacgcctccggaggggaaggggctgggaagtgggtctcgagttattagaaaatgatggtanaacacaatcgtacgccgtacgtccgaggaacgggccattccaccatcctaccgagaacgaactaacttaccaaagaaccgtaacggtagtaaacttaccgttaacaaagttacgaaacaacggtcctacggaacgaaacccgggtaggaacccgaccgggtaacccgttaatttaacgtttaagttaggtaacgtttaagggttacgttaggggttaacggttaaccggtttaccccggggtaccccggtaggggggtaaccccgaacggggggtaaaccccgttcgggtaccccgtaaccccggttccgttaccctaccggtacccgtccccgtaccccggtaaaaccccggg

SEQ ID NO: 136715 - DNA, 677 bp, Homo sapiens
  misc_feature: GYAE6OF01DZC6D.16.39.D06.1.454.CMB.1.raw
  modified_base (292)..(292): a, c, t, g, unknown or other
  misc_feature (292)..(292): n is a, c, g, or t
  modified_base (302)..(302): a, c, t, g, unknown or other
  misc_feature (302)..(302): n is a, c, g, or t
  modified_base (401)..(401): a, c, t, g, unknown or other
  misc_feature (401)..(401): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctattttaaaggtgtccagtgtgaggtgtacttggtggagtctgggaggaggcttgacccgaggcccgggggggtccctgagactctcctgtgcagcctctgggttcagcgtcagtaacaaccacgtnatgtggtccnccagccctccgaggggaggggctggaagtgggtctcagttattagaaaatgaatggtgaacacaatctacgccgactccgtgaacggccattcacatcnccagagactaacttaccaagaacacggtagtaactcttacaaatgaaccaggaccctaggaacgtaaccggaacggaacgaccgggtaccgttaattaacgtttagtttaggttaaacgttagggtttaagttcggggtttacgggttaaaccggtttcccgggggccccccgggttagggggaccccggtaaacgggggtaacccggttcgggtacccgtacccgttcccgttcccgtacgaccgtccccctaccgaaccccggtaaacccgggg

SEQ ID NO: 136716 - DNA, 630 bp, Homo sapiens
  misc_feature: GYAE6OF01CBOBF.16.39.D06.1.454.CMB.1.raw
  modified_base (481)..(481): a, c, t, g, unknown or other
  misc_feature (481)..(481): n is a, c, g, or t
  modified_base (613)..(613): a, c, t, g, unknown or other
  misc_feature (613)..(613): n is a, c, g, or t
  modified_base (617)..(617): a, c, t, g, unknown or other
  misc_feature (617)..(617): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtcgtggaggaggcttgacccgaggcccgggggggtccctgacgactctcctgtgcagcctcgtgggttcagcgtactaagtaaaccaaccacgtgatggtcgggtcccgccacgccctaccggaaggggaaggggtcgtaggtaagtcgggtctacgtagtttaattaggaaaattgagttggtacgacactaactcgtacggccgtactccggtaggaacggcgtatccgactatcctacaagacaacctaacgttaccgaagaacgtacggtanaactactacaaagtacgaacagccctagaaccgaaccgaggacaccggacttatatttctagttataggttagtggtacgttacgtccggcccgtagggccgagggtaccgtgacctaccgtctccacgacncccnccgaacggaccgg

SEQ ID NO: 136717 - DNA, 713 bp, Homo sapiens
  misc_feature: GYAE6OF01CMOEA.16.39.D06.1.454.CMB.1.raw
  modified_base (391)..(391): a, c, t, g, unknown or other
  misc_feature (391)..(391): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtcgtggagggaggcttgacccgaggccgggggggtccctggagactctcctgtcgcagcctcgtgggttcacggtcgtcaagtaaaccaaccgacgtgagtggtcgggtccgacgacgcccgtaccggaaggggacgggcgtaggagtcgggttcacgtagttattagaaaatgatggtanacacaatctacgccgtactcggaggacggcctattccgaactactctaccaagacgaactaacttaaccaaaggaaaccgtaacggtaactaacttaccttaacgaaacgtacgtaaaccgtacgtaccgtaacggaaacggaaccggtaacggaaccgtaaccgggtaccgtaagttaacgtttaagttaggttagttaaggttacgttagggtacggttaaccggttcccgggtaccccggtacggggaccgtaacggggtaaccgttcgggtaccctacccggttccgtaccctcgaccgtcccgtacccgaaacccgg

SEQ ID NO: 136718 - DNA, 795 bp, Homo sapiens
  misc_feature: GYAE6OF01AM2XF.16.39.D06.1.454.CMB.1.raw
  modified_base (365)..(365): a, c, t, g, unknown or other
  misc_feature (365)..(365): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatgggagttttggctgagttgggttttccttgctgctattttaaaaggtgtccagtgtgaggtgtacttggtggagtctgggaggaggcttgacccgaggccgggggggtccctgagactctcctgtgcagcctcgtgggttcagcgtcagtaaccaaccacgtgatggtcgggtccgccagcctccgagggaagggctggaatgggtctcagttatagaaatgatggtnacacaatcgtacgccgtacgtccgtaggaacggggcctaattccgacctactccctaccgaaggtaacgaacctaaactttacccgaaacgtaaaccgtaacgggttacgtaaacttaccgtttaacaaaacttacggaaaccgacggtacccgttaggaaccggaaacccggtaaccggaaccgtaacccggtaacccgtttaagttaacgttttaacgtttaggttaaacgtttagggttaaaggtttacggggttacgggtttaaaaaccggtttcccggggggtaccccccgggtttacggggggaaccccggtaaacggggggttaacccccgggtttacggggttaccccggttaaaccccgggttcccgtttacccccggtacccgtaacccggtccccccgttaaccccggaaacccccggg

SEQ ID NO: 136719 - DNA, 688 bp, Homo sapiens
  misc_feature: GYAE6OF01BT0LY.16.39.D06.1.454.CMB.1.raw
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaagtgtcagtgtgaggtgtacttggtggagtctggaggaggcttgacccgacgggccggggggtcctgagactctcctgtgcacgcctcgttgggttcacggcgtacaacgtaaccaaccgacgtgagtggtcggtcccgccacgcctaccggaggggaggggcgtggaagtgggtctgtagttatagaaatgagtgtgacacaatcacgccgactcggtaggaacggcctatcacctatcctacaagacgactaacttaccgaaacgtaaccgaacgggttactaacttactaacgtaaacgttagaaaccgtagtacccgtaaggtaaaccggaacccggacggaaccgtacgggtacccttaagttaactttagtttacggttaagttaggtttacgttagggttacggttaaccggttcccgggtacccggtggggacccggtaacggggtaccggtcggttaccgtacccgttcgtacccacgaccgtcccgccggtaaaccccgg

SEQ ID NO: 136720 - DNA, 765 bp, Homo sapiens
  misc_feature: GYAE6OF01A5Z14.16.39.D06.1.454.CMB.1.raw
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaaggtgtccagtgtgaggtgtacttggtgggagtcgtggaggaggcttcgacccgagggcccggggggtcctgagactcctccgtgtgcagcctcgtggttcaggcgtcaacgtaacaaccgacgtgagtggtcgggtccgccacgccctccggaggggaacggggcgtaggaagtcgggtctacgtagtttaagttaagaaaatggtagttgggtacaacgaacaacgttccgaaccggacccgtaccgttccgggtaaggaaccggggtccgtaacttacccgaaccgtacgttacctaaccgaggaacgtaacctaaacttaccgaaaagaacccgtacggtactaaacttacgttaacaaacgtacgaaaccgacgtaccgtacgaacggaacccggagggtaacccgaaccggttaccgttaagttacgtttacgttacgtaagtttagggttacgtaggggtttagttaaaccgggttccccgggaccccggttgggggaacccgttacgggggtaaccccggtggttaccccggaaccgttccgaccccttaggcccgtaccccgtacccgaaacccggg

SEQ ID NO: 136721 - DNA, 629 bp, Homo sapiens
  misc_feature: GYAE6OF01DGLTE.16.39.D06.1.454.CMB.1.raw
  modified_base (444)..(444): a, c, t, g, unknown or other
  misc_feature (444)..(444): n is a, c, g, or t
  modified_base (465)..(465): a, c, t, g, unknown or other
  misc_feature (465)..(465): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctattttaaaaggtgtcagtgtgaggtgtacttggtggagtctggaggaggcttgacccgaggccgggggggtccctgagactctcctgtgcagcctgtgggttcagcgtcaagtaacaaccgacgtgatggtcgggtcccgccgagccctccgaaggggaagggctaggaagtgggtctcgtaagtttattagaaaatgagtggtagacactaatctacgccgtactcgtagaacggcattccacatctaccagactacaataccgaagaacacggtanaactcttaacaaatcgaaacngtacctagaacgaacgaggaccacggtactattattagtagttaattaggttataggtagttaacgtccgggaccccgtaggggacccgtaaggggtaaccgttcggtaccctacccgttcctacccgttacgaacgtccccctaccgaaacccggtaaccggg

SEQ ID NO: 136722 - DNA, 706 bp, Homo sapiens
  misc_feature: GYAE6OF01CZPP6.16.39.D06.1.454.CMB.1.raw
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggtttccttgctgctattttaaaaggtgtccagtgtgaggtgtacttggtggagtctgggaggaggcttgacccaggccggggggtccctgagactctcctgtgcagcctctggttcagcgtcagtaacaaccacgtgatgtggtccgccagcctccgagggaacgggctggaagtgggtctcgagtttatagaaaatgagtggtgacacaatcacgccgactccgtgaacgggccattcgacctactctccgaagacgaccgtaaacttaccgaaagaaacctacgggtactaaacgttacctttaacaaaagttacgaaaccaggtaccctaggaaccggtaaacccggacggaaccgaaccgggtacccgtttaataacgtttagtttacgttaagttaagggtttaagttgggttaacgggttaaaccgttccgggggacccccgttagggggggacccctaaacgggggggtaaccccgttcgggtaaccctacccgggttcccttacccgtaccgtaccggtcccccgtacccgtaaaccccggg

SEQ ID NO: 136723 - DNA, 734 bp, Homo sapiens
  misc_feature: GYAE6OF01CTOO9.16.39.D06.1.454.CMB.1.raw
tcagtgtactactccacgaccggtgctcgatttagtgacatctcgcagttctttgggggagaggagcccagcactgggattccgaggtgtttccattcggtgatcagcactgaacacagaggactcaccatggagttttggctgagttggtttccttgctgctaattttaaaggtgtccagtgtgaggtgtacttggtggagtctgggaggaggcttggacccgagggccggggggtccctgacgtactctccgtgtcgcagcctcgtggttcagtcgtcagtaacaaccacgtgatggtcggtcccgcgagccctaccggagggaacggggctagggaacgtgggtctacgtaggttaattaggaaaatcgagttggtagacaactaactcgtacgacctacgtacccgtaggaacggtccgtacttaccgaacctactaccgtaccgagaacgtaacctaagtacccaaagtaaccgacggttacgtaaattaccttaacgaaaagtccgtaaacacgtaccgtagggaaaccgaaaccggacggtaacccgaacgggtacccttaagtttagtttaagttagttaagttaaggtttaggtccgggtttaaggttacccgtccgggggtaccccgtaggggggacccctaaaggggtacccgttcgggaaccctccccggtttacaccccgttacccaacggcccccttaacccggaaccggtaacccgggg

SEQ ID NO: 136724 - DNA, 797 bp, Homo sapiens
  misc_feature: GYAE6OF01CQIN1.16.39.D06.1.454.CMB.1.raw
  modified_base (219)..(219): a, c, t, g, unknown or other
  misc_feature (219)..(219): n is a, c, g, or t
  modified_base (248)..(248): a, c, t, g, unknown or other
  misc_feature (248)..(248): n is a, c, g, or t
tcagtgtactactccacgaccggtgctcgatttagtgacatctcgcaggttctttggggttttggggagaggagcccagcactgggattccgaggtgtttccattcggtgatcagcactgaacacagaggactcacatggagttttggctgagttggtttcctgctgataagtttaaaaggtgtacagtgtgaggtgtactggtggagttcgtggaggnggtcttcgacccgagggccggggggtccngagactcgtcctgcgcgacgtcctacgtgggtcagctcaagtaacaaccagtgatcggtgggcccgacacgtccgaccgaggggaacgggtctagggaagtcgggtcctagtaagtttagttaaggaaaaatggaagttggagaaacccaatttaaaacggtccaacccgtccggtacccgtacccggtaggaaaacgggggtcctaattaccctaccccaattcccgggaccaaggaacaaacctttaactaacccgaaaaggaaacccgttaacggtaacggtaaatactttaaacctaaaacgtaaggaaaccacgttaacccgaggaacggaaaaccgggaccgggaacgaaccccggggttactaaagtttaattttaagttagggttaagttaaagggtttagttaaccgggggtacgtttaaaccgggtttccggggtccccccgtagggggacccggtaaccgggtaaccggttccggggtaaccctaacccgggtcctttcccgaaccgccggttaccctaaccccggtaaaccccgggg

SEQ ID NO: 136725 - DNA, 680 bp, Homo sapiens
  misc_feature: GYAE6OF01DXDW5.16.39.D06.1.454.CMB.1.raw
tcagtgtactactccacgaccggtgctcgatttagtgacatctcgcagttctttggggggagaggagcccagcactgggattccgaggtgtttccattcggtgatcagcactgaacacagaggactcaccatggagtttgggctgatctgggtcttccttgttgtcttttttaaaaggtgtccagtgtgaggagcagctggcggaggtccgggggaggtcttagttcagccgtgggaacgtccctgagactctcctgtgcagcctctggtacttccacctttcagactaattactggctgcacgtcggtccgcaagctcgagggagggctggtgtggtctcactatattaatcgtacgtagtagggtaattaacgtttacgccgtacggcggtaccgtccgtacgaaacgggtcctaacgttccgacccgtcctaccgaacgacgaaccaaccaaaccaaacgaaccaacgtaacttactaactcgtacgacgatagttacgactacgtcgtacgaaccggacccggaacggaaccgacggtacgttaggttacgttaacgtttacgtggttacggacgtaacggtacgttaacggttcggtaagtaaacgttagggtttagggttgggggttttaggggggtttagttttttcgggggtttttttacggttaaccgggg

SEQ ID NO: 136726 - DNA, 674 bp, Homo sapiens
  misc_feature: GYAE6OF01DGR0J.16.39.D06.1.454.CMB.1.raw
  modified_base (410)..(410): a, c, t, g, unknown or other
  misc_feature (410)..(410): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagtttgctgagttggtttccttgctgctatttaaagtgtcagtgtgaggtgtacttggtggagtctggaggaggcttgacccgaggccggggggtcctgagactctcctgtgcagcctcgtgggttcagcgtacagtaaccaccacggtgatggtcggtccgccacgcctccggaaggggaacgggctaggaagtcgggtctcgtagtttatagaaagtcgatggtagaacaacaatccgtacgccgtacgtccgtagaacggtcattccaacgtntctaccagacaactaacttaccaaagaaccgtaacggtataaactcttaaacgaattacgaaactacgtacctaggaaacggacccgtaagggaaccctcgggaaccttaattaagtttaagttacgttaagttaacggtttagtagggtttaacggtaacggtcccggggtaccccgtagggggaccccgtaaggggtaaaccggttcggtacccgtacggttccctccgaccaccggacccctcccgaaaccggtacccggg

SEQ ID NO: 136727 - DNA, 592 bp, Homo sapiens
  misc_feature: GYAE6OF01A622P.16.39.D06.1.454.CMB.1.raw
  modified_base (302)..(302): a, c, t, g, unknown or other
  misc_feature (302)..(302): n is a, c, g, or t
  modified_base (361)..(361): a, c, t, g, unknown or other
  misc_feature (361)..(361): n is a, c, g, or t
  modified_base (365)..(365): a, c, t, g, unknown or other
  misc_feature (365)..(365): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccaggccgggggggtccctgagactctcctgtgcagcctcgtgggttcagcgtcagtaacaaccacgtgatgtgggtccnccagcctccgaggggaagggctaggaagtgggtctcgagttattagaaaatgagtggtnacanaatctacgccgactccggtagaacggccgtattccacctatcctaccgagagacaacttaccaagaaccacggtagaactactacaatacgaacacgacctagacgaaccgacggacgaccggaccgtatattattagtagttagtagtgggttacgtagttccgggacccgtgggccgagggtaccggtcggcctaccgtctccgacacgccctccgaccgaccgg

SEQ ID NO: 136728 - DNA, 579 bp, Homo sapiens
  misc_feature: GYAE6OF01EODYU.16.39.D06.1.454.CMB.1.raw
  modified_base (356)..(356): a, c, t, g, unknown or other
  misc_feature (356)..(356): n is a, c, g, or t
  modified_base (424)..(424): a, c, t, g, unknown or other
  misc_feature (424)..(424): n is a, c, g, or t
  modified_base (446)..(446): a, c, t, g, unknown or other
  misc_feature (446)..(446): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccgaggccgggggggtccctgagacctctcctgtgcagcctcgtgggttcagcgtcagtaacaaccacgtgatgtggtccgcagccctcgaggggagggctggaatgggtctcgagttatagaaatgagtggtnacaacatctacgccgactcgtagaacggctatcactatctacgagacacaactcgaagaacacggtanaactcttaacaaagtcgaaacncgactaggaacaaccggagaaccacggaccgtatagttatgtagtagttagtgtgtacgtccgggaccctggggacccaggggacccgtggtacctaccgtccctccacgacgccctccgaccgtaacccggg

SEQ ID NO: 136729 - DNA, 719 bp, Homo sapiens
  misc_feature: GYAE6OF01BJXVD.16.39.D06.1.454.CMB.1.raw
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctatttaaaggtgtccagtgtgaggtgtacttggtggagtctggaggaggcttgacccgaggccgggggggtccctggacgactcctcctgtgcagcctgtgggtcagcgtcagtaacacagtgatggtcggtccgccagcctaccggaggggaaggggctaggaagtcggggttactcgtagtttacttagaaaagtgtagtggtacgaaccaacgtaatccgtaaccggaccctacgtacccggtagggaaccgggtcccgtaactttacccgaacctacgtacctaccgaaggaacgaacctaaacgttaccaaacggtaaccgaacggttagaacttacttaacaaagtacgaacacgtacctaggaacgaacgacggaccgacggtaccgttaatagtttaacgttaggttaagttaacgggttagttagggttagggttaaccgttcccggggtaccccgtagggggacccggtagggtaacccggttcggtacccgtacccggttccctaccgtctaacccggcccctaccggaacccgtaacccggg

SEQ ID NO: 136730 - DNA, 824 bp, Homo sapiens
  misc_feature: GYAE6OF01BE05Q.16.39.D06.1.454.CMB.1.raw
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggtttccttgctgctattttaaaaggtgtccagtgtgaggtgtacgttggtggagtcgtggaggaggcttgacccgagggccggggggtccctgagactctcctgtgcacgcctcgtggttcagtcgtacaagtaaaccaaccgacgtagagtcggtcgggtcccgccgacggcccgtaccggaagggggaacggggacccggaagttcggggtacctacgtaaggtttaagttaagtaaaagtggtagttagggtagaaccaacgtaactccgtaaccggccgtaaccgtccggtaggaaacgggccgtacttaccaacccgtactcctaccgaagaacgtaacctaacgttaacccgaaaaggtaaccgtaaccgggttagtaaacttacctttaaacgaaaagttacgaaaccgtacggtaccgtaacggaaccggtaaacccggacggaaacccgaaccggttacccgttaaatttaaccgtttaagtttaaggttaacggttaaggtttaagttacggggttaacgttaaacccggggttcccgggccccgggttaaacgggggtcccggtaaacgggggttacccgttacgggttacccacccggttcccgttaccccgtaccgacccgacccccgttacccgaaacccgggacccggggttaccccc

SEQ ID NO: 136731 - DNA, 654 bp, Homo sapiens
  misc_feature: GYAE6OF01CLEFX.16.39.D06.1.454.CMB.1.raw
  modified_base (256)..(256): a, c, t, g, unknown or other
  misc_feature (256)..(256): n is a, c, g, or t
  modified_base (301)..(301): a, c, t, g, unknown or other
  misc_feature (301)..(301): n is a, c, g, or t
  modified_base (356)..(356): a, c, t, g, unknown or other
  misc_feature (356)..(356): n is a, c, g, or t
  modified_base (454)..(454): a, c, t, g, unknown or other
  misc_feature (454)..(454): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccgaggccgggggggtccctgagactctcctgtncagcctgtgggttcagcgtcagtaaccaacacgtgatgtgggccnccagcctccgaggggagggctggagtgggtctcgtagttatagaaaatgagtggngacacaatccgtacggcccgacgttccgtaggaacgggcctacgttaccaccattcctaccgagaacgtaacaaacttaccaaagaaccgaacggtanaacttacttaacaaatcggaaacacgcctagaacgaaccgaggaccgacggtaccgtatacgttagttagttaagttaaggttagtgggttacggttaacggttcccgggtcccggtaggggtccgaacggggtaccggtcgggtaccgtacccggttccttcccacgtaccgcccctaacccgtaaccggaaccccggg

SEQ ID NO: 136732 - DNA, 820 bp, Homo sapiens
  misc_feature: GYAE6OF01CPWS1.16.39.D06.1.454.CMB.1.raw
tcagtgtactactccacgaccggtgctcgatttagtgacatctcgcagttctttgggttttggggagaggagcccagcactgggattccgaggtgtttccattcggtgatcagcactgaacacagaggactcaccatggagtttggctgtagtttgggttttccttgctgtactaattttaaaaggtgtccagtgtgaggtgtacgttggtggagtcgtgggaggaggtcttgaccccgagggtccggggggtccctggacgtacgtcctccgtggtcgcgacgtccttcggttcggggttccaggtcgtacaacgtaaaaccaaccgtacggtagtagtggtcgggtcccgaccgacggtcccgtaccggaagggggaacgggtcgtaggaacggttggggtactacgtaagttaagttaagaaaagttggaagttggacgaaacgtaactaacgttaccgtaaccggaccgtaacgttccggtacgggaaacgggtacctacttaccgacctaactccctaccgaagtaacgtaacaaacgtttaacccgaaaagtaaccggtaacggtacgtaaaacttccgtaaactaaaacgtacgaaaccgacgtacccgttaaggaaacgaaacccgggtaaggaaccccgaacgggtaccgtttaagtaacgttttaacgtaggttaagttaggttacggttaagggttacggtaaacggttcccgggtaccccggaggggttaacccgaacgggtaacccggtacgggtaccctacccggttaccctaccgttccgaccgtccccgaccgtaaaccccggg

SEQ ID NO: 136733 - DNA, 762 bp, Homo sapiens
  misc_feature: GYAE6OF01DUM8F.16.39.D06.1.454.CMB.1.raw
  modified_base (349)..(349): a, c, t, g, unknown or other
  misc_feature (349)..(349): n is a, c, g, or t
  modified_base (737)..(737): a, c, t, g, unknown or other
  misc_feature (737)..(737): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggtagtttggctgtagttgggttttcctgctgtacttaagttttaaaaggtgtcctagtggtgagttgtacgttggtggagtcgtgggaggaggtcttcgacccgagggtcccggggggtcctgacgtactccgtcctggtcgcacgtccgtcgtcgggttcacggtccgtacgaacgtaaaccaacgtaacgtgagttcggtcgggtcccnccgtaccgtccgtaaccggaaggggacgggtcgtagggtaacgtcgggtctacgtaagtttagtaaggtaaaatggtaacgtgggtacaaacgaacgtaaacgtaccgtaccgacccggtaccgtaccggtaacggaaccgggtacgtaccttaaccgaccctacttacccgaccgaacggaactaaaccgtaaaccttacgaaaacgtacggaacgtataaacgttacttaaacgaaattacgaaacgtacgaccgtaaggaacgaaccggacggaccgtacgtacgttataacgttagtagtaggtaacgttggtacgtacggttacgtccgggccggtacgggacggtaccggtacccggcgttacccggtccgtccaacccgtnaacccgtcccgtaccgaaacccggg

SEQ ID NO: 136734 - DNA, 602 bp, Homo sapiens
  misc_feature: GYAE6OF01BV3X2.16.39.D06.1.454.CMB.1.raw
  modified_base (339)..(339): a, c, t, g, unknown or other
  misc_feature (339)..(339): n is a, c, g, or t
  modified_base (431)..(431): a, c, t, g, unknown or other
  misc_feature (431)..(431): n is a, c, g, or t
  modified_base (453)..(453): a, c, t, g, unknown or other
  misc_feature (453)..(453): n is a, c, g, or t
  modified_base (582)..(582): a, c, t, g, unknown or other
  misc_feature (582)..(582): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgaccccaggccgggggggtccctggagactctcctgtgcagcctctgggttcagcgtcagtaacaaccacgtgatggtggtccgccagcctcgagggagggctggaatgggtctnagttatagaaatgatggtgacacaatctacgcgactcgtgaagggcctatccaccatctaccagacaactaacttaccgaaagaacacggtnaaattcctacaaagttgaaacngcctggaagaaccgaggaccacggctaatactttattgaattaggttatgggttagttaacgtcccggggtccccgtaggggacccaacggggtaaccgttgggtaccctacccggttcctcccgtacncggtccctcccgaaacccgg

SEQ ID NO: 136735 - DNA, 874 bp, Homo sapiens
  misc_feature: GYAE6OF01CX58C.16.39.D06.1.454.CMB.1.raw
tcagtgtactactccacgaccggtgctcgatttagtgacatctcgcagttctttggggggagaggagcccagcactgggattccgaggtgtttccattcggtgatcagcactgaacacagaggactcaccatggagttttggctgtagttgggttttccttgctgctatttaaaaggtgtccagtgtgaggtgtacttggtggagtcgtggaggaggcgttcgacccgacggggcccggggggtccctgacgtaccttccgtccgtgtcgcgtacgtccttcggttcggttcgacgtcgtaactaaacgtaaaccgaaccgtacggtagtacgtcgggtccgggtacccgccgacggtacccgtaaccgggaacggggaacggggtcgtagggtaacggtcgggttaccgtacgttaaggtttaagttaaaggtaaaagttggtaaggttaggtacgtaacctaacgtaactaccgtaacccggacccggtaacgtaccggtaacgggtaaccggtacccgttaactaccctaaccgtacgttaccctaccgaaagtaaccgtaaccttaaaccgttaacccgaaaaggtaacccggtaggttaaattaaccttaccgtaaaataacgtaacgaaccgtacgtaccgtaaggaaacccggaaaggaccggtaaccggaccggtaacctttaagtttaaacgtttacggtaaggtttaagtttaacgggttaggtttcggggttaaacgttaccggggttacccccggggtacccgggtacgggggaaccccggttaagggtaccggttcggtaccccgttaccggttacctcccgtacgacccggttaccctaaccccggaacggtaaccccgg

SEQ ID NO: 136736 - DNA, 573 bp, Homo sapiens
  misc_feature: GYAE6OF01BWHKH.16.39.D06.1.454.CMB.1.raw
  modified_base (359)..(359): a, c, t, g, unknown or other
  misc_feature (359)..(359): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccgaggcccgggggggtccctggagacctctcctgtgcagcctctgggttcagcgtcagtaacaaccacgtgatgtgggtccgccagcctccgagggagggctggaatgggtctctagttattagaaaatgatggtnacacaatcacgccgactccgtagaacggccgatcacctatcctaccagacgacaactaccaaagaacacgtctagttatttcgaactaaatagaacagtcagagagtcgagacacggacattatacttactgtgacggaggtcgggtaagttgggtggtggtagtcgttagcttagttcggactacggtcggggcccgtaacggggtaaccccg

SEQ ID NO: 136737 - DNA, 763 bp, Homo sapiens
  misc_feature: GYAE6OF01AYF7G.16.39.D06.1.454.CMB.1.raw
  modified_base (589)..(589): a, c, t, g, unknown or other
  misc_feature (589)..(589): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggtagttttggctgtagttgggttttccttgctgctattttaaaggtgtccagtgtgaggtgtacgttggtggagtcgtgggaggaggcttcgaccccgagggcccgggggggtccctggacgtacctcctccgtgtgcgacgtccgtcgtgggttccaggtccgtacaacgtaaccaacccgtacggtgagtcggtcggggtcccgaccgacgtccccgtaccgggaagggggtaacgggggccgttaggggtaacggttcgggggtaccttacgtaaggttttaagttaaggtaaaaagttggtaagtacgggttaacgaactaacgtaaacgttcccgtaaccgtacccgtaccgttccgggtaggaaccgggtccgtacttaccgaacctactcctacgaagtacaaactaactaccgaaagtaaccgaggttacaacttaccttaanaaatcgaaactacgtaccgtagaaccgaaacgacggaaccgtacggtaccgtaattaagtttagttagtaacgttaggttagtggtacggttaacgtcccggggacccggtgggtacccgacgggtaccgtacggcctacccgttcctcctaccgccgtcccgtccgaacccgg

SEQ ID NO: 136738 - DNA, 630 bp, Homo sapiens
  misc_feature: GYAE6OF01CBGTU.16.39.D06.1.454.CMB.1.raw
  modified_base (389)..(389): a, c, t, g, unknown or other
  misc_feature (389)..(389): n is a, c, g, or t
  modified_base (448)..(448): a, c, t, g, unknown or other
  misc_feature (448)..(448): n is a, c, g, or t
  modified_base (454)..(454): a, c, t, g, unknown or other
  misc_feature (454)..(454): n is a, c, g, or t
  modified_base (457)..(457): a, c, t, g, unknown or other
  misc_feature (457)..(457): n is a, c, g, or t
  modified_base (463)..(463): a, c, t, g, unknown or other
  misc_feature (463)..(463): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctaattttaaaggtgtccagtgtgaggtgtacttggtggagtcgtgggaggaggcttgacccgagggcccgggggggtccctggacgacctcctcctggtgcacgcctcgtgggttcagcgtacaagtaaccaaccgtacgtgatggtcgggtcccgccgacgcccgtacggagggggaaggggctagggaacgtgggtctagtagttatagaaaatgagtggtnacacaatcacgccactccgaggacggcatccacatcaccagacactatcaagacagtanatctanaancgaacngcagacgaacgcgacgacggtactatatttagtagttaagttaggttagtgggttaggtacggttcccggggtccccgtagggggtaccgaacggggtacccggttggtccccgtaaccgttcccgtcccacgtacccgtcccctacccgaacccggtaaacccggg

SEQ ID NO: 136739 - DNA, 705 bp, Homo sapiens
  misc_feature: GYAE6OF01D0K2F.16.39.D06.1.454.CMB.1.raw
  modified_base (425)..(425): a, c, t, g, unknown or other
  misc_feature (425)..(425): n is a, c, g, or t
  modified_base (476)..(476): a, c, t, g, unknown or other
  misc_feature (476)..(476): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtcgtggaggaggcttgacccgaggccggggggtcctgagactctccgtgtgcagcctcgtgggttcagtcgtcagtaacaaccacgtgatggtcgggtccgccagccgtccgaggggaaggggctagggaagtcgggtctcgtagtttattagaaaatgagtggtgacacaatcgtacgccgtactccggtagaacgggccgattcacctatccncagaacactaacttcaaagacgtaggtagaaatccttaacaaatcgaaacncgtaccgtagaacggaaccgagggaacccaccgggtaccgtttaaattacgtttaaagttggtttaacgtttaggggtttaacgttggggtttaacggttaaaccggtttcccggggggtacccccgtttaggggggaccccgtaacggggggtaaacccgttcgggttacccaaccccgggtttcctaccccgttccgaaccggtcccccttccggaaaacccccggg

SEQ ID NO: 136740 - DNA, 761 bp, Homo sapiens
  misc_feature: GYAE6OF01ECUPJ.16.39.D06.1.454.CMB.1.raw
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtcgtggaggaggcttgacccgaggcccgggggggtccctgagactctcctgtgcagcctctgggttcagcgtcagtaacaaccacgtgagtgtgggtcccgccgacgcccgtccgagggggaacgggggcgtagggaagtggggtctacgtagtttaattagaaaatgagtggtgaacaacaactcgtaccgccgaaccgtccggtaggaacggggcccgtagttccacctactcctaccgagacgaactaacttaccgaaagaacgtaacggtagtaaacttaccttacgtaaaactcgtaaaaccgtcggtaccctagggaacgtaaacccggacgggtaaacccgaaccgggtacccgtttaaataactttttaagttaggttaaacggttaggggttttaaggtaggtttacggggttaaacccgtttcccgggggacccccggtaggggtaccccggtaaacggggggtaacccgttcggggtttaccccaccccggtttccgttacccgtacccgtaaccgccccgttacccgaaacccccgggg

SEQ ID NO: 136741 - DNA, 798 bp, Homo sapiens
  misc_feature: GYAE6OF01A3QJN.16.39.D06.1.454.CMB.1.raw
  modified_base (175)..(175): a, c, t, g, unknown or other
  misc_feature (175)..(175): n is a, c, g, or t
  modified_base (240)..(240): a, c, t, g, unknown or other
  misc_feature (240)..(240): n is a, c, g, or t
  modified_base (521)..(521): a, c, t, g, unknown or other
  misc_feature (521)..(521): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggtttcctgctgctatttaaaggtntccagtgtgaggtgtacttggtgggtctggaggaggctcgtaccgacggccgggggtcccggtcngacgtctccgtgtgcacgccgtctgggttcgtgcgtcgataacgtaccacgtgatcgtgggtccgccgtacgccgtacccgaggggtaacggggacgtggaacgtacgggtctcgtaacgttagttacgaaaagtgtagtgtacggacaacgtaactacgtaccgtaccgaccgttccggtacggaacgggtaccgtacgttccgtaacccacgtctaccgtacgaacgtaactaaccttaccgaacgaaacgtacggtaacgaaattccttaacgtaaanacggtaaactacggaccgttacggaacgtaacccgggtaaggaaccgtacccgggtaaccgtagttttaaacttaaaggtttcggttaaaattaacgggtttagggttacggttaaccggggttaaacgggtttaccccgggggttcccccggtacggggggtaacccgttaccgggggaaacccggtttcggggtaaaccccttcccccggggttaccttccccggttactacccgggtccccctacccgtaaacccggacccggggttacccccg

SEQ ID NO: 136742 - DNA, 563 bp, Homo sapiens
  misc_feature: GYAE6OF01A1AF1.16.39.D06.1.454.CMB.1.raw
  modified_base (466)..(466): a, c, t, g, unknown or other
  misc_feature (466)..(466): n is a, c, g, or t
  modified_base (543)..(543): a, c, t, g, unknown or other
  misc_feature (543)..(543): n is a, c, g, or t
  modified_base (553)..(553): a, c, t, g, unknown or other
  misc_feature (553)..(553): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccaggccgggggggtccctgagactctcctgtgcagcctctgggttcagcgtcagtaacaaccacgtgatgtgggtccgccagccctccgaggggaagggggctgggaatggggtctcagttattgaaaatgatggtgacacaatctacgccgactcgtgaagggccattcaccatcctccagacgacaattccaagaacacggtagaatcttacaaatcgaacagctagacgaaccgaggacncggacctatattattgtattaggttatggtaggtattccgggccctggggcctaggggaccgtggtcaccgtctccncacgccctcnccgaaccggg

SEQ ID NO: 136743 - DNA, 824 bp, Homo sapiens
  misc_feature: GYAE6OF01DB1QJ.16.39.D06.1.454.CMB.1.raw
  modified_base (232)..(232): a, c, t, g, unknown or other
  misc_feature (232)..(232): n is a, c, g, or t
tcagtgtactactccacgaccggtgctcgatttagtgacatctcgcagttcgtttgggttttggggagaggagcccagcactgggattccgaggtgtttccattcggtgatcagcactgaacacagagactcaccatggtagtttgctgagttggtttcctgctgcttatttaaagtgtcagtgtgtaggtgttacgttggtggagtcgtgggaggagtcttcggaacccgngggtcccgggggggtccctaggacgtccgttcctccgtgtcgcgacgtccgtcgttcgggttacacggtaccgtacgtaacgtaaccaaccgtacgtgacgtcggtccggtccgaccgacggtacccgtacggaacgggggaacgggtccgtagggaacgttcgggttcctaagttaaggtttaagttaacggtaaaatagggtagtacggttgaaacctaacgtaaacgttaccgtaccggtacccgtaacccggtccggttaacgggaaccgggtaccttacgttaacccaccgtaatcccgtaacgagaacgaaacttaacgtaaccaaagtaacccgtaggtacaaacttctaaacgtaaacgtagaaacccgtgtaaccctaagggaaaccggtaccgaacgggtaaacctacccgggttacgttaaatttaccgtaaagtttttggtaaggtttacggggtttatacggggtttaggtaaacccgggttcccggacccgggttaggggtaacccgacggggttaaccttcccgggacctacccttcccgttaacgcccgttaccggtccctacccggtaacccggg

SEQ ID NO: 136744 - DNA, 754 bp, Homo sapiens
  misc_feature: GYAE6OF01BI72J.16.39.D06.1.454.CMB.1.raw
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccaggcccgggggggtccctgagactctcctgtgcagcctcgtgggttcagcgtcagtaacaaccacgtgatggtcgggtccgccagcctccgaggggaaggggcgtggaatggggtctcgtagtttagttagaaaatgtagtggtagacaactaatcgtaaccgccgtactccggtaggaacgggcccgtattccaccgtactcctccgaagaacgacctaacttacccgaaaggtaacccgtacgggttagtaaacttccgttaactaaagtacgaaacctacggacccgtaggaaccgaaacccgggaggaacccgaccgggtaacccgttaagttaagtttaactttaggttaactttaaaggtttacgttgggggtttaacggtttaaccgggttacccggggtacccccgggttacggggggacccggtaacggggggtaacccgttccgggtaccccgttaacccggttccgttacccccgttaccgaccgtccccccgttacccggtaaaccccccggg

SEQ ID NO: 136745 - DNA, 555 bp, Homo sapiens
  misc_feature: GYAE6OF01E1ZJC.16.39.D06.1.454.CMB.1.raw
  modified_base (393)..(394): a, c, t, g, unknown or other
  misc_feature (393)..(394): n is a, c, g, or t
  modified_base (396)..(396): a, c, t, g, unknown or other
  misc_feature (396)..(396): n is a, c, g, or t
  modified_base (401)..(401): a, c, t, g, unknown or other
  misc_feature (401)..(401): n is a, c, g, or t
  modified_base (409)..(409): a, c, t, g, unknown or other
  misc_feature (409)..(409): n is a, c, g, or t
  modified_base (412)..(412): a, c, t, g, unknown or other
  misc_feature (412)..(412): n is a, c, g, or t
  modified_base (415)..(415): a, c, t, g, unknown or other
  misc_feature (415)..(415): n is a, c, g, or t
  modified_base (421)..(421): a, c, t, g, unknown or other
  misc_feature (421)..(421): n is a, c, g, or t
  modified_base (425)..(425): a, c, t, g, unknown or other
  misc_feature (425)..(425): n is a, c, g, or t
  modified_base (429)..(429): a, c, t, g, unknown or other
  misc_feature (429)..(429): n is a, c, g, or t
  modified_base (440)..(440): a, c, t, g, unknown or other
  misc_feature (440)..(440): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccaggcccgggggggtccctgagactctcctgtgcagcctctgggttcagcgtcagtaaccaaccacgtgatgtgggtcccgccagcctccgaggggaacgggctggaatgggtctcgagttatgaaaatgatggtagacacatctacgccgactccgtgacggcatcacnncncaganacatcaanacngtnatctanaatnaacngcagagaacgngacacggctatattattagtagttaggtatggtgtaacgttccgggcccgttagggccgtagggtaccggtgtaccgacccgttctccctacacgccctacccgcgtaacccggg

SEQ ID NO: 136746 - DNA, 734 bp, Homo sapiens
  misc_feature: GYAE6OF01APOW4.16.39.D06.1.454.CMB.1.raw
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaggtgtcagtgtgaggtgtacgttggtggagtcgtgggaggaggcttcggaccccgacggggcccggggggggttccctggacggtaccttccgtcccgtggtcgccacggtcccttcgtcgggttcaggccgtacaagtaaaccaaccgacgtgagttcggtcgggtcccgccacggccctaccggaggggaaggggcgtggaagtgggtctacgtagtttatagaaaatgagtggtgacacaatctacgccgacgtccgtaggacggtccattcacctactcgtaccgagaacgactaacttaccaaagaacgtaacggtacgtaacttaccgtaataaagtacgaacgtacgtacccgtaagggaactaaacccgggagtaacccgaacggtaccgttaagtttaacgttaatttacggttaattacgggtttagtagggttaacgttacgggttacccgggccccggttagggggacccggtaacgggtacccggttcgggtaccctacccggttccgttacccctacgaccgtcccgtcccgaaacccggg

SEQ ID NO: 136747 - DNA, 822 bp, Homo sapiens
  misc_feature: GYAE6OF01BY4OI.16.39.D06.1.454.CMB.1.raw
  modified_base (292)..(292): a, c, t, g, unknown or other
  misc_feature (292)..(292): n is a, c, g, or t
  modified_base (409)..(409): a, c, t, g, unknown or other
  misc_feature (409)..(409): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagtttggctgagttgggttttccttgctgtacttaattttaaaaggtgtccagtgtgaggtgtacgttggtggagtcgtggaggaggcttcgacccgaggccggggggtcctgagactctcctgtgcagcctcgtgggtcagcgtcacgtaacaaccncgtgtagtcggtcgggtcccgccgacgcccgtaccggaagggggaacggggcgtagggaacgttggggttcctagttaagtttaagttaaggtaaaaattgggtaaagttcgggtanaaccgtaaactaaacgtacccgttaccggacccggtaaccgttacccgggtaggaaaccggggtccgtaactttacccgaaccctacgtacccgtaccgaacggtaacgaacctaaacgttaaccgaaacggtaaacgtaacgggttaactaaaccgttacgttaaaccgtaaataacggtaaaaccacgtacccgtaaggaaaccggtaaaccgggaacggaaccgtaacccgggtaccgttaatttaacgtttagttaagttaacgttaagggtttacgtagggttaaggttaccgttcccggggtaccccggttagggggacccgtaaccggggaaccggtttcccggtcccgtacccggttccctaccggttccgaacccgtccccgtacccgaaaccggtaacccggg

SEQ ID NO: 136748 - DNA, 680 bp, Homo sapiens
  misc_feature: GYAE6OF01A9UQY.16.39.D06.1.454.CMB.1.raw
  modified_base (485)..(485): a, c, t, g, unknown or other
  misc_feature (485)..(485): n is a, c, g, or t
  modified_base (496)..(496): a, c, t, g, unknown or other
  misc_feature (496)..(496): n is a, c, g, or t
  modified_base (509)..(509): a, c, t, g, unknown or other
  misc_feature (509)..(509): n is a, c, g, or t
  modified_base (538)..(538): a, c, t, g, unknown or other
  misc_feature (538)..(538): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctattttaaaaggtgtcagtgtgaggtgtacttggtggagtcgtggaggaggcttgacccgaggccgggggggtccctggagacgtctcctgtgcacgcctcgtcgggttcagcgtcaacgtaaccaaccacgtgatggtacgggtccgccacgcccgtaccgaagggggaacggggtccgtagggaacgtgggtactcgtaagttagttagaaaagtggattcggtagaacaactaatccgtaacgcccgtaacctcggtaggaacggcctaactacaccactcgtacaagacgaactactaccgaaagaactacggtanaacttcctaanaaagtcgaaaccnggtacctaaggaaccgaacggacggaacncgggtaacctttaataacgtttagttagttacgttaaggttatagggttaggtaacgttccgggcccgttaggggccgttagggaaccgtcggtaccgtaccgtccgtcccgacgaaccgtcccgtaccgacccggtaacgg

SEQ ID NO: 136749 - DNA, 719 bp, Homo sapiens
  misc_feature: GYAE6OF01AHF87.16.39.D06.1.454.CMB.1.raw
  modified_base (286)..(286): a, c, t, g, unknown or other
  misc_feature (286)..(286): n is a, c, g, or t
  modified_base (300)..(300): a, c, t, g, unknown or other
  misc_feature (300)..(300): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagtttggctgagttgggtttcctgctgctattttaaaaggtgtccagtgtgaggtgtacttggtggagtcgtggaggaggcttgacccgaggcccggggggtcctgagactctcctgtgcagcctcgtgggttcagcgtcagtaaccaaccngtgatgtgggtccnccagccctacgaggggaagggctaggaatgggtactcgtagttatagaaaagtgagtggtagaccaactaatccgtacgcccgtacgtcggtaggaacgggtccacgttccacctactccgtacccgaaggaacgtaacctaaacgtttacccgaaacggtaacccgtacgggtaacgtaaacgttacctttaaccgaaacgtaacggaacctacggacccgtacggaaacggaaccggaccggaaccggaccggtaaccgttaactacgtttaagttagttaagttaaggttagttacgggttaggttaaccgttcccgggtaccccgtcgggggacccgtacgggggtacccggttcggtacccctaccggttccctacccgtacgacccgtccctaacccgacccggtaaccccgg

SEQ ID NO: 136750 - DNA, 564 bp, Homo sapiens
  misc_feature: GYAE6OF01E15NH.16.39.D06.1.454.CMB.1.raw
  modified_base (555)..(555): a, c, t, g, unknown or other
  misc_feature (555)..(555): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccagccgggggggtccctgagactctcctgtgcagcctctgggttcagcgtcagtaacaaccacgtgatgtgggtccgccagcctccgagggaaggggctggaatgggtctcagttattgaaaatgatggtgacacaatctacgccgactccgtgaacgggccgattcaccatctccagagacaattccaagaacacggtagaatctacaaatgaacagcctgaacgaaccgaggacacggacgtatattattagtataggttatggtagttaagtccgggcccgtggggaccaggggaaccgtggtcgaccgtctcctcacgtcccnccgaacccg

SEQ ID NO: 136751 - DNA, 636 bp, Homo sapiens
  misc_feature: GYAE6OF01A3H3K.16.39.D06.1.454.CMB.1.raw
  modified_base (367)..(367): a, c, t, g, unknown or other
  misc_feature (367)..(367): n is a, c, g, or t
  modified_base (413)..(413): a, c, t, g, unknown or other
  misc_feature (413)..(413): n is a, c, g, or t
tcagtgtactactccacgaccggtgctcgatttagtgacatctcgcagttctttgggttttgggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccaggccgggggggtccctgagactctcctgtgcagcctctgggttcagcgtcagtaacaccacgtgatgtgggtccgccacgccctccgaggggaaggggctggaagtgggtctcagttatagaaatgatggtgacanaatcacgccgactccgtagaacgggccgtattccacatcctcaganacataccaagaacacgtagaatctacaaatgaaaccagcctagacggaaccgaggacgacgggaccttaatatttagttagtagttaggttagtgggttaacggttacggttcccggggcccccgttaggggggcccaacggggggtaaaccccggttgggtacccgtaacccggttccttaccccggttacaacccgggtccccttaacccgaaaccccggg

SEQ ID NO: 136752 - DNA, 1003 bp, Homo sapiens
  misc_feature: GYAE6OF01DYPXF.16.39.D06.1.454.CMB.1.raw
tcagtgtactactccacgaccggtgctcgatttagtgacatctcgcagttctttggggggagaggagcccagcactgggattccgaggtgtttccattcggtgatcagcactgaacacagaggactcaccatggagttttggctgtagttgggttttccttgctgtacttaattttaaaaggtgtccagtgtgaggtgtacgttggtggagtcgtggaggaggcttgacccgaggccggggggtcctgacgctctcctgtgcagcctgtgggttcagtcgtacaacggtaaaccaacccgacggttgagttcggtcgggtcccgccccgacggccccgtacccgaagggggggtaacgggggccttagggggaaacgtttcgggggtaccttcgtaaggtttttaaagttaaggaaaaaagttggtaagttagggttaacggaaacctaaacgtaaacgtttacccgtaaaccgggtccccgtaaccgtttaccccgggtaagggaaaccggggtacccggttaactttacccgaaccctaaacgttccccgttaacccgaacgggtaacgtaaaacccgttaaaactttaaccccccggaaaaaaggtaaaacccgtaacccgggggtttaaagtaaaaccttttacccgtttaaaacgtaaaaaagttaccccgggtaaaacaccgggttaacccgttaagggaaaacccggggaaaaccccggtaacgggggaaaccgtaaccccgggttaccggtttaaattttaaaggtttttaaccgtttaagggtttaaaggtttaacggggttttaagtttacggggggtttaacggttaaacccgggttttccccggggggaaccccccggtttggggggaaaccccggtaacggggggttaacccccggtttagggtacccccggtaaccccggtttccccgttaccccgtaaccgggtaacccgtcccccgtaccccgaaaaccccggggtaaacccggggg

SEQ ID NO: 136753 - DNA, 565 bp, Homo sapiens
  misc_feature: GYAE6OF01AQ1MZ.16.39.D06.1.454.CMB.1.raw
  modified_base (372)..(372): a, c, t, g, unknown or other
  misc_feature (372)..(372): n is a, c, g, or t
  modified_base (422)..(422): a, c, t, g, unknown or other
  misc_feature (422)..(422): n is a, c, g, or t
  modified_base (545)..(545): a, c, t, g, unknown or other
  misc_feature (545)..(545): n is a, c, g, or t
  modified_base (552)..(553): a, c, t, g, unknown or other
  misc_feature (552)..(553): n is a, c, g, or t
tcagtgtactactccacgaccggtgctcgatttagtgacatctcgcagtttcttttgggttttgggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctgggaggaggcttgacccgaggcccgggggggtcctgagactcctcctgtgcagcctcgtgggttcagcgtcagtaacaaccacgtgatggtgggtccgccagcctaccgagggaaggggctggaatgggtctcgagtttattagaaaatgatggtnacacaatcacgccgactccggtagaagggccattccaccatcctacaganacaattaccaagaacacgtgaactcttacaaatgaacacgcctagacgaaccgaggacgacggccgtatattattgtagtaggttatggtgtacgtcggcccgtgggaccgagggacgtgtcncgtctcnncgcctcgaaccg

SEQ ID NO: 136754 - DNA, 658 bp, Homo sapiens
  misc_feature: GYAE6OF01BEO2C.16.39.D06.1.454.CMB.1.raw
  modified_base (312)..(312): a, c, t, g, unknown or other
  misc_feature (312)..(312): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctatttaaaggtgtccagtgtgaggtgtacttggtggagtcgtggaggaggtcttgacccgaggcccgggggggtccctgagacctctcctgtgcagcctcgtgggttcagcgtacgaagtaaccaaccacggtgatggtcgggtccnccagtcccgtaccgaaggggacgggctaggaagtgggtctacgtaacgttttggtggtaggtggtgtcctaccgcctacgtacgcgaggtacgtccgtaggaacggtccgattaccacctatccacagacactacgttaccgaacgaacacgtctacgtactcgtagacgaagtacgaacgtacgtccgtaggagtagtacggaacggaccgacggacctaagttaacttagttagttagttaagttaggtttagtgggttagttaacgttcccgggtacccgtcggggtaccgtaacggggtacccgtacgggtcctacccgttcctacccgtcgccgtaccccg

SEQ ID NO: 136755 - DNA, 688 bp, Homo sapiens
  misc_feature: GYAE6OF01ARLWG.16.39.D06.1.454.CMB.1.raw
  modified_base (307)..(307): a, c, t, g, unknown or other
  misc_feature (307)..(307): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaggtgtccagtgtgaggtgtacttggtggagtctggaggaggcttgacccgaggccggggggtccctgagactctcctgtgcagcctcgtgggttcagcgtcagtaacaaccacgtgatgtcgggtccnccagcctcgaggggagggctggagtgggtctcgagttatagaaaatggatggtagaacacaatctacgccgactccgtaggaacggcctattcacatcctaccagacgacaacttaccaaagaacacggtagaacttactacaaatcgaaactacgaccgtagaaccggaaaccgacggaacccgaccgggtaccgtaattaacgtttaagttaggttaagttagggtttaagtacggggttaggttaaaccggtttcccgggggtaccccccggttaggggggaaccccgttaacgggggggtaaacccgttccggggtacccttaaccccggttcccgtacccgttaccgacccgtccccgtaccccggaaaccccggg

SEQ ID NO: 136756 - DNA, 744 bp, Homo sapiens
  misc_feature: GYAE6OF01EID9U.16.39.D06.1.454.CMB.1.raw
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctattttaaaggtgtccagtgtgaggtgtacttggtggagtcgtggaggaggcttgacccgaggccgggggggtccctgagacctcctcctgtgcacgtcctcgttgggttcagtccgtacaacgtaaaccaaccgacgtgatggtcgggtcccgccacggccctccggaagggggaacggggctaggggaagttcggggtctacgtagtttaagttagaaaactggtagtggtacgactaactaatccgtaccgcccgtactccggtaggaacgggcctaatccacctactcctaccgagaacgaactaacttaccgaaacgtaaacgtacggtaacgaaatttccttaacgaaaattcggaaacctacgacccgtaggaaacgaaacccgggaggtaaccggaccggtaaccgttaattaacgtttagtttaggttaattagggttacggttgggtaacggttaccgttacccgggggtccccgtagggggacccgtaaggggtaacccggttcggttacccgtacccggttccttacccgtacctaccggccccttaccggaacccgtaacccgggg

SEQ ID NO: 136757 - DNA, 662 bp, Homo sapiens
  misc_feature: GYAE6OF01DHL7P.16.39.D06.1.454.CMB.1.raw
  modified_base (308)..(308): a, c, t, g, unknown or other
  misc_feature (308)..(308): n is a, c, g, or t
  modified_base (311)..(311): a, c, t, g, unknown or other
  misc_feature (311)..(311): n is a, c, g, or t
  modified_base (641)..(641): a, c, t, g, unknown or other
  misc_feature (641)..(641): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgcttattttaaaaggtgtccagtgtgaggtgtacgttggtggagtctggaggaggcttggacccgaggcccgggggggtccctgagacctctcctgtgcagcctcgtgggttcagcgtcagtaacaaccacgtgatgtgggtccnccngcctcgagggaagggctaggagtgggtctcgtagttatagaaaatgagtggtgaacacaatctacgccgacgtccgtaggaacggcctattacacctatcctaccagaacgaactaacttaccgaaagaaccgacggtagtaacttcttaacaaagtagaaaccacgacctaaggaacgaaccggaggaaccaacgggtacctaattagtttattagtaagtttaggttacgttagggttacggttaacgtccggggtccccgtcggggaccgtacggggtaaccggtggtacccgtaccggttacccttccgtacccgtacgtcccccncccgtaacccgtaacccgggg

SEQ ID NO: 136758 - DNA, 852 bp, Homo sapiens
  misc_feature: GYAE6OF01CSWXA.16.39.D06.1.454.CMB.1.raw
tcagtgtactactccacgaccggtgctcgatttagtgacatctcgcagttctttggggggagaggagcccagcactgggattccgaggtgtttccattcggtgatcagcactgaacacagaggactcaccagtggagtttggctgagttggttttccttgctgacttaagtttaaaaggtgtccagtgtgaggtgtacgttggtggagtcgtaggaggaggcttcgacccgagggcccggggggtccctggacgtactcctccgtgtcgacacgtccgtcgttcgggttcacgtcgtacaagtaaaccaaccacggtagagttcggtacgggtcccgaccgacgccccgtacggaaggggaacggggcgtagggtaacgttcggggttacctacgttaaggtttaaagttaaggaaaaagttggtaagttagggtacgtaaaccaactaaacgttccgtaaaccggacccgtaaccgtacccggtaacggaacgggtaccctaacgttacccaaccgtactccgtaaccgagaacgtaacctaacttaaccgaaagtaaaccgtacggtaagtaaacttaccgttaacaaagtacgaaacaccgtaccgttaaggaaacggtaaacccggaacgggtaacccggtaaccgggtaacccgttaacgttaaacgttacgtacggttaacgaaccggtaaacgtaccgttaaccggtacgaacccggttaccctaaaccgtaaccccgtaaacccgttacgtaaacggtacccgtaacggttccgtttaccccgggtaaccccggttacccccggggtaacggggtaaccccgtaaacccggggttaaaccccgg

SEQ ID NO: 136759 - DNA, 738 bp, Homo sapiens
  misc_feature: GYAE6OF01BKE6H.16.39.D06.1.454.CMB.1.raw
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgcttattttaaaaggtgtccagtgtgaggtgtacgttggtggagtcgtggaggaggcttgacccgagggcccggggggtccctgacgactctccgtgtgcagcctcgtggttcagcgtacagtaaccaaccgacgtgagtggtcggtccgccgacgcccgtaccggaaggggacggggcgtagggaagtcgggtctacgtagtttattagaaaatgagtggtacgaacactaactcgtaccgccgtaccgtccgtaggaacggccgtactaccaccacttcctacgaagacgaacctaacgttaccgaaagtaactacgggtataacttacctaactaaagtacgaaacgacgacccgtaaggaaccgaacccggtacggaaccgtaaccgggtaccgttaagttaacgtttaagtttacggtaagttagggtttaagttagggttacgggttaaccgttcccgggggtaccccggtggggtaccccgtaacgggggtacccgttccggttaccccgtacccggttcccttacccgtacccgacccgtcccccgtacccgaaaccccggg

SEQ ID NO: 136760 - DNA, 714 bp, Homo sapiens
  misc_feature: GYAE6OF01CBZVS.16.39.D06.1.454.CMB.1.raw
  modified_base (527)..(527): a, c, t, g, unknown or other
  misc_feature (527)..(527): n is a, c, g, or t
  modified_base (539)..(539): a, c, t, g, unknown or other
  misc_feature (539)..(539): n is a, c, g, or t
  modified_base (552)..(552): a, c, t, g, unknown or other
  misc_feature (552)..(552): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttggttttccttgctgctatttaaagtgtccagtgtgaggtgtacttggtggagtctggaggaggtcttgacccgacgggcccggggggtccctgagacctctccgtgtgcagcctcgtggttcacgtcgtacaacgtaaccaaccgacgtgagttggtcggtccgccgacgtcccgtaccggaaggggaacgggtcgtaggaagtcgggttacctacgttaagtttagtaacgtaaaagtgaagttggtacgaacaactaacgtccgtaaccggcccgtaacgttccggtaggaaacgggtccctaattacccaaccgtaacttcctaccgaagtaaccgtaaccttaacgtaccgaaagaacgtaccggtaanaacttccgtaanaaacgtgaaaccngaccgtagaacgaacccgaggacccacggtacgttaatagtttagtgtaacgttaggttagtaggttacgttaacgtcccgggcccgtaggggtacccaacggggtccggttacggtcccgaccgttccgtaccctagacccgtccccgtaccgaacccggg

SEQ ID NO: 136761 - DNA, 563 bp, Homo sapiens
  misc_feature: GYAE6OF01BBA9N.16.39.D06.1.454.CMB.1.raw
  modified_base (363)..(363): a, c, t, g, unknown or other
  misc_feature (363)..(363): n is a, c, g, or t
  modified_base (405)..(405): a, c, t, g, unknown or other
  misc_feature (405)..(405): n is a, c, g, or t
  modified_base (533)..(533): a, c, t, g, unknown or other
  misc_feature (533)..(533): n is a, c, g, or t
  modified_base (543)..(543): a, c, t, g, unknown or other
  misc_feature (543)..(543): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggtttccttgctgctattttaaaggtgtccagtgtgaggtgtacttggtggagtctggaggaggcttgacccaggcccgggggggtcctgagactctcctgtgcacgcctcgtggttccagtccgtcagtaaccaaccacggtgatggtggtcccgccagccctcgaggggaaggggctggaagtgggtctcgagttatagaaaatgatggtnacacaatctacgccgactccgagaacggccattcaccatccncagacaactaactacaagaacgtacggtagaattctacaaatcgaacacgactagacgaaccggagaccgacgtacgtatattatgtatggtatgtgtactcgggcccgtggggctagggactggccncccgtctccnccagcccctcgacccgacgg

SEQ ID NO: 136762 - DNA, 541 bp, Homo sapiens
  misc_feature: GYAE6OF01BJPKX.16.39.D06.1.454.CMB.1.raw
  modified_base (312)..(312): a, c, t, g, unknown or other
  misc_feature (312)..(312): n is a, c, g, or t
  modified_base (397)..(397): a, c, t, g, unknown or other
  misc_feature (397)..(397): n is a, c, g, or t
  modified_base (400)..(400): a, c, t, g, unknown or other
  misc_feature (400)..(400): n is a, c, g, or t
  modified_base (405)..(405): a, c, t, g, unknown or other
  misc_feature (405)..(405): n is a, c, g, or t
  modified_base (422)..(422): a, c, t, g, unknown or other
  misc_feature (422)..(422): n is a, c, g, or t
  modified_base (429)..(429): a, c, t, g, unknown or other
  misc_feature (429)..(429): n is a, c, g, or t
  modified_base (437)..(437): a, c, t, g, unknown or other
  misc_feature (437)..(437): n is a, c, g, or t
  modified_base (513)..(513): a, c, t, g, unknown or other
  misc_feature (513)..(513): n is a, c, g, or t
  modified_base (518)..(518): a, c, t, g, unknown or other
  misc_feature (518)..(518): n is a, c, g, or t
  modified_base (523)..(523): a, c, t, g, unknown or other
  misc_feature (523)..(523): n is a, c, g, or t
  modified_base (528)..(528): a, c, t, g, unknown or other
  misc_feature (528)..(528): n is a, c, g, or t
  modified_base (534)..(534): a, c, t, g, unknown or other
  misc_feature (534)..(534): n is a, c, g, or t
tcagtgtactactccacgaccggtgctcgatttagtgacatctcgcagttctttgggttttgggggagaggagcccagcactgggattccgaggtgtttccattcggtgatcagcactgaacacagaggactcaccatgggagttttggctgagttgggttttccttgctgctattttaaaaggtgtccagtgtgaggtgtacttggtggagtctgggaggaggcttgacccaggccgggggggtccctggagactctcctgtgcagcctcgtgggttcagcgtcagtaacaacacgtgatggtcgggtccncgacgcctcgagggaggggctggatgggtctcagttatagaaatgatggtgacacaatctacgccgactcgtagacggcatcacntcncaganacatacaagacacggtnactctanaatgaacngccagacgaacgagacacgtcgtatatattgtataggttatggtagtacgtcgggcccgtggggccagggtaccgngtacncgtcncgacncgtccncgaaccg

SEQ ID NO: 136763 - DNA, 833 bp, Homo sapiens
  misc_feature: GYAE6OF01EBHJW.16.39.D06.1.454.CMB.1.raw
tcagtgtactactccacgaccggtgctcgattagtgacatctcgcagttctttgggttttggggagaggagcccagcactgggattccgaggtgtttccattcggtgatcagcactgaacacagaggactcaccatggagttttggcttgtagttgggttttcctgctgtacttattttaaaaggtgttccagttgtggaggttgttacgttggtggagtcgtgggaggaggtccgttcggaccctcggggcccggggggtccctgacgtcctcctccgtgtgccgtacgtccttcgtcgggttcacggtacgtccgtaacgtaaacctaacccgtccggttaggtacttcgggtccggggtccccgacccgtaaacccggggtttaccggtaccggtaacggggtaacggggctttacggggtaacggttacggggttacgttacgtaaggtttaagtttaaacgtaagtagtaagtaggtacgtaccgaacgtaacgtaccgtaccggtaccgtaccgtaccggtaacggtaccggtaccgtacgtaccgaccgtactacctaacgtaacgtaacgtaacgtaaccgtaacgtaaacgtaacgtacgtaacgtaccttactaaacgtaacgtaaccgacgaccgtacgaacggaaccgtaacggtaaccgtaacggtaccgtaacgttaagtttaacgttagttaacgttaaggttacggttacggttacgggtaaccggttacgggtacccggtacggggtacccggtaccgggtacccggtaccggtaccgtacccgtaccgtacccgtccgtaccgtacccgtacccg

SEQ ID NO: 136764 - DNA, 638 bp, Homo sapiens
  misc_feature: GYAE6OF01DEGTH.16.39.D06.1.454.CMB.1.raw
  modified_base (472)..(472): a, c, t, g, unknown or other
  misc_feature (472)..(472): n is a, c, g, or t
  modified_base (485)..(485): a, c, t, g, unknown or other
  misc_feature (485)..(485): n is a, c, g, or t
  modified_base (543)..(543): a, c, t, g, unknown or other
  misc_feature (543)..(543): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctaattttaaaaggtgtccagtgtgaggtgtacttggtggagtctggaggaggcttgacccaggccgggggggtccctgagactctcctgtgcagcctcgtgggttacagcgtcaagtaaaccaacctacgtgaatggtcggtccgccagccctaccgaggggaaggggctaggaatgggtctcgaagttatagaaaatgatggtagacacgaatcgtacgccgtactccgtagaacgggccattcaaccgtatcctcgaagaacacctaaattccgaaaagaccgacggtagaaatccttanaaatgtaaaccgngacctaggaacgaaccgaggaaccacggtaccgtaattattattagtaataggtttangggttaggtaacgtccgggaccccgtaggggaccgtaaggggtaaacccgtcggtccaacccgttcctaccgtcaacggtccctacgaaacccgg

SEQ ID NO: 136765 - DNA, 541 bp, Homo sapiens
  misc_feature: GYAE6OF01ARJMW.16.39.D06.1.454.CMB.1.raw
  modified_base (303)..(303): a, c, t, g, unknown or other
  misc_feature (303)..(303): n is a, c, g, or t
  modified_base (394)..(394): a, c, t, g, unknown or other
  misc_feature (394)..(394): n is a, c, g, or t
  modified_base (421)..(421): a, c, t, g, unknown or other
  misc_feature (421)..(421): n is a, c, g, or t
  modified_base (436)..(436): a, c, t, g, unknown or other
  misc_feature (436)..(436): n is a, c, g, or t
  modified_base (470)..(470): a, c, t, g, unknown or other
  misc_feature (470)..(470): n is a, c, g, or t
  modified_base (529)..(529): a, c, t, g, unknown or other
  misc_feature (529)..(529): n is a, c, g, or t
tcagtgtactactccacgaccggtgctcgatttagtgacatctcgcagttcgtttgggttttggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttggacccgaggccgggggggtccctggagacctctccgtgtcgcagcctcgtggtcagcgtcagtaacacacgtgatgnggtccgcagcctcgagggagggctggaatggggtctcgagttatgaaatgatggtgacacaatcacgcgactcgtagaagggcctatcacntcaccagacgacactcaagacacggtnactctacaatgaacngctagacgaacgagacacggtctatattagttanattacggtatggtagtagtcggcccgtgggaccgtagggaccgtggtcaccgtcgtccngcgcctcgaccg

SEQ ID NO: 136766 - DNA, 678 bp, Homo sapiens
  misc_feature: GYAE6OF01BLYI4.16.39.D06.1.454.CMB.1.raw
  modified_base (264)..(264): a, c, t, g, unknown or other
  misc_feature (264)..(264): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccgaggccgggggggtccctggagactctcctgtgcagcctntggttcagcgtcagtaacaacacgtgatggtcggtccgccagccctccgaggggaaggggctaggaagtcgggtctacgtagttattagaaaatgagtggtagacactaatcgtacgccgactccggaggaacggccgtatcaccatctacgagacgaactaacttaccgaagaaccgtaggtagtaacttaccgtaacaaatacgaacacgtacgtagaacgaacggaacggacgaccgggtacgttatagttacgttagttaacgttaagggttagtacgggttacggttaacggttcccggggtacccgtagggggacccgtaaggggggtacccggttcggtacccgtacccgttcccgttacccgtaccgtaccgtaccccgttaccccgaaacccggtaaccccgggg

SEQ ID NO: 136767 - DNA, 835 bp, Homo sapiens
  misc_feature: GYAE6OF01CCKAF.16.39.D06.1.454.CMB.1.raw
  modified_base (653)..(653): a, c, t, g, unknown or other
  misc_feature (653)..(653): n is a, c, g, or t
tcagtgtactactccacgaccggtgctcgatttagtgacatctcgcagttcgtttggggggagaggagcccagcactgggattccgaggtgtttccattcggtgatcagcactgaacacagaggactcaccatggagtttggctgagttggtttccttgctgcttagttttaaaggtgtccagtgtgaggtgtacgttggtggagtcgtgggaggaggcttcggacccgagggcccgggggggtccctaggacgtaccttccgtccgtcggtcgccgtacgtcccgttcgttcggggttacacggtccgttacgaacggtaaaccaaaccgtacggttgacgttcggtcggggtccccgaccgaacggtcccgttaacccggaagggggaacggggccttagggtaaacgttcgggttactacgttaaggttttaagttaaaggaaaatttcggaaggttacgggtagaaaccaacgttaactcccgtaacccggacccggtacccgttaccgggtaacgggaaaccggggtcccttaaccgtttacccgaaccttacgtccccgttaacgaacgaaccggtaaacctaaacgtttaacccgaaacggtaaaccgtaggtaacgttaactacggttaaacaaacgtagaaacnccggtaactacggaaacgaacggaacgaaccggaacggtaacgttattaagttacgttagttaacgttaggtcgttagggttacgtaccggttcccgggacccgtggggtcccgaaggggtacctcgggtaccccaaccgttcgtaccccacgtacccgccctcccgtaaccggtaacccgg

SEQ ID NO: 136768 - DNA, 781 bp, Homo sapiens
  misc_feature: GYAE6OF01CB9E2.16.39.D06.1.454.CMB.1.raw
  modified_base (428)..(428): a, c, t, g, unknown or other
  misc_feature (428)..(428): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctattttaaaaggtgtcagtgtgaggtgtacttggtggagtctgggaggaggcttgacccgaggccggggggtccctggacgactctccgtgtcgcacgcctcgtgggttcagcgtcaacgtaaccaaaccacgtgagtggtcgggtccgaccgacgcccgtacccggaagggggaaacggggtcgtaggtaaacgtcggggtactacgtaagtttaagttagaaaaagtgaatggtacaactaacaagtcgtaacgccgtacnccggtaggaaacgggcccgtaattaccaacctaacgtccctaccgaagacgtaactaacttaccgaaagaaccgtacggtagaaacttccttaacaaagtagaaaccgacgtacctaggaaacggaaccgaacgggaaccgaaccggtacgttaacttaaagtttagttaacggttaagttagggtttacgtttaggggtaacggtttaaccggttcccgggggtacccccggtacggggggtaacccgttaacggggggaaaccccgttcggggttaccccgtaaacccggttccccttacccggttaccgaaccccgtaccccgtccccgaaacccgggtaaacccccggg

SEQ ID NO: 136769 - DNA, 581 bp, Homo sapiens
  misc_feature: GYAE6OF01C3915.16.39.D06.1.454.CMB.1.raw
  modified_base (184)..(184): a, c, t, g, unknown or other
  misc_feature (184)..(184): n is a, c, g, or t
  modified_base (304)..(304): a, c, t, g, unknown or other
  misc_feature (304)..(304): n is a, c, g, or t
  modified_base (362)..(362): a, c, t, g, unknown or other
  misc_feature (362)..(362): n is a, c, g, or t
  modified_base (366)..(366): a, c, t, g, unknown or other
  misc_feature (366)..(366): n is a, c, g, or t
  modified_base (410)..(410): a, c, t, g, unknown or other
  misc_feature (410)..(410): n is a, c, g, or t
  modified_base (564)..(564): a, c, t, g, unknown or other
  misc_feature (564)..(564): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaaggtntccagtgtgaggtgtacttggtggagtctggaggaggcttgacccagccggggggtccctgagactctcctgtgcagcctctgggttcagcgtcagtaacaaccacgtgatgtgggtccnccagccctccgaggggaacgggctggaactggggtctcagttattgaaaatgatggtnacanaatctacgccgatccgtggaacgggccgattcacatctccaganacaattccaaagaacacggtagaaatcttacaaatgaaacagaccctagaacgaaccgaggaaccaacggaccgtatattattagtattaggtattggtaggtaagttcgggaccccgtggggacacggggaacgtcggtacaccgtcctaccnacgccctccgaacccgg

SEQ ID NO: 136770 - DNA, 989 bp, Homo sapiens
  misc_feature: GYAE6OF01EFWVR.16.39.D06.1.454.CMB.1.raw
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgtagtttgggttttccttgctgtcttaattttaaaggtgtccagtgtgaggtgtagttggtggagtcgtgggaggaggtcttcgaccccgagggcccgggggggtccctggacgtaccttcctccgtggtcgccgtacgtcccgttcggttcggggtttacacggtccgttaccgaaacggttaaaccaaacccgtacggtggtaacgttcggggtccggggtccccaccgtaaccggccccgttacccgggaaggggggtaacgggggtccttaaggggtaacggttcggggtccttacgttaaaggtttaagtttaaaggaaaaaggttggtaaggttacgggtaacgaaaccgaacgtaaacgttacccgtaacccggtacccggtaacccggttacccgggtaaggggtaaacccgggggtcccttaaacgttaccccgtaaaccctaccggttacccgtaacccggaaaggtaaacccgtaaacccgtttaaaccttaaccccggaaaagggtaaaccccgttaacggggtaacgtaactttaaccgtttaaaccgaaagttacgaaacccgtacgtacccgttaaggaacggtaacccgggaagggaaccccgtacgggtaccttaattaaagttttaggttaagttaacgtttagggtacgttacggggggttacgttaaccccggggtttcccggggaccccggttacggggggaacccggttaacccgggggttaacccgggtttcggtaccccccgttaaacccggtttccccgtaaccccgggttacccgaacccgggttaccccccgtaacccggtaaaaccccgggg

SEQ ID NO: 136771 - DNA, 749 bp, Homo sapiens
  misc_feature: GYAE6OF01CWFPW.16.39.D06.1.454.CMB.1.raw
  modified_base (712)..(712): a, c, t, g, unknown or other
  misc_feature (712)..(712): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgcttattttaaaaggtgtccagtgtgaggtgtacttggtggagtctgggaggaggtcttgacccgaggccgggggggtccctgacgactctcctgtcgcacgcctcgtggtcagcgtcagtaacaacctcgtagatggtcggtccgccacgccctaccggaggggaaggggtcgtaggtaagtcgggtctcgtaagtttatagtaaaatggtagtggtgaacctactaagtacctacgcccgtacgtaccggtaggaacgggcctacgtttccaacctacttcctaccgagaactaactaacttccgaaaacgtaaccgtaggttaacgtaacttaccgttaaccaaagtacggaactaacgtccgtaacggaaacggaacccgaagggtacccaagggttacccgttaattaagtttacgttaagttaacgtttaagggtttaacgttagggtttaacggttaaaccgggttccgggacccgggttaccggggaccggtaaccggggtaacgttccggggtcctaacccggttcctcccggttaaccncccggttaccccgtacccgtaaaccccggtaaccggg

SEQ ID NO: 136772 - DNA, 895 bp, Homo sapiens
  misc_feature: GYAE6OF01A3JP7.16.39.D06.1.454.CMB.1.raw
tcagtgtactactccacgaccggtgctcgatttagtgacatctcgcagttctttgggttttggggagaggagcccagcactgggattccgaggtgtttccattcggtgatcagcactgaacacagaggactcaccatggtagttttggctgtagtttggttttccttgctgtcttaattttaaaggtgtccagtgtgaggttgtacgttggtggagtcgtgggaggtacggtcttacggacccgacgggtcccggggggtcctaggacgtacctccgttccgtggtcgaccgacgtccttacggttcgggttacaggtaccgttacgtaacggtaaaccaaccgtacggttaggacgttcgggtaccggggtacccgaccgtaaccggtcccgtaccgggaagggggtaacggggtaccgtaggggtaaggttcgggttcgtacggttaaggtttaacgttaagtaaagtacgtagtacgggtacgaactaacgtaaactccgtaaccggtccgtaacccggtcggtaaggaacgggtacccgtaacgtttacccaaccgttacgttacccgtaaccgaagtaacggtaaccttaacgttaacccgaaaacggtaaccggtacgggttaaacttaaacgttaccttaaacgaaacgtacggaaacttaccggaacgttaacggaaaccgggtaaccgaaccgggtacccgtaaccgggttaccttaaagttacgtttttaaacgtacgtttaacgggttaacggtttagttacgggttaacggtttaaccggtcccggggtaccggttaccggggtaccgtaaccgggggttaccgtcggttacccgtacccgttcgttacccctacgaccgttccccgtaacggtaaccccggg

SEQ ID NO: 136773 - DNA, 719 bp, Homo sapiens
  misc_feature: GYAE6OF01D6E0S.16.39.D06.1.454.CMB.1.raw
  modified_base (318)..(318): a, c, t, g, unknown or other
  misc_feature (318)..(318): n is a, c, g, or t
  modified_base (391)..(391): a, c, t, g, unknown or other
  misc_feature (391)..(391): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgtctgtctaattttaaaaggtgtcagtgtgaggtgtacgttggtggagtcgtgggaggaggtcgttgacccgaggcccggggggtccccgagtacctcgtcctgtcgcagcctcgtggtcagcgtcagtaacaaccagtgtagtgtcggtccnccgagccctcggaaggggacgggtcgtaggacgtgggtctacgtagtttaattaggaaaatggtaagtggtanaacgaacaactccgtaaccgccgtactccggtacggaacggccgtactaccgacgacttcaccgaaggaacgtacctaaacttaccgaaaggaaaccctagggtacaaacgtttcctaacaaaattccgaaaacgtcgtaccgaagaaccggaaacggtacggaacctacgggtaccttaagtacgtttagttagaagtttacgggttagtacgggtagttaaccggtcccggggaccgtcggggggaaccctagggggtaacccttcggtaccgcccgttacccgtccgttagaacccgtccccgtaacccgacggtaaaccccggg

SEQ ID NO: 136774 - DNA, 564 bp, Homo sapiens
  misc_feature: GYAE6OF01E1S58.16.39.D06.1.454.CMB.1.raw
  modified_base (310)..(310): a, c, t, g, unknown or other
  misc_feature (310)..(310): n is a, c, g, or t
  modified_base (371)..(371): a, c, t, g, unknown or other
  misc_feature (371)..(371): n is a, c, g, or t
  modified_base (406)..(406): a, c, t, g, unknown or other
  misc_feature (406)..(406): n is a, c, g, or t
  modified_base (409)..(409): a, c, t, g, unknown or other
  misc_feature (409)..(409): n is a, c, g, or t
  modified_base (431)..(431): a, c, t, g, unknown or other
  misc_feature (431)..(431): n is a, c, g, or t
  modified_base (446)..(446): a, c, t, g, unknown or other
  misc_feature (446)..(446): n is a, c, g, or t
  modified_base (549)..(549): a, c, t, g, unknown or other
  misc_feature (549)..(549): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgaccccaggcccgggggggtccctggagactcctcctgtgcagcctctggttcagcgtcagtaacaaccacgtgatggtgggtccnccacgcctccgagggaaggggctggaagtggggtctcgagtttattagaaaatgagtggtnacacaatctacgcactccgtagaggccgattcacntcncagagacatcaagaacacggtnatctacaatagaacngcctagaacggaccgaggacacggaccgtataattattgtataggttatggtagtagtccgggcccgtgggtaccagggaccgtgggtccaccgtcctccacncgccgtcccgaaccg

SEQ ID NO: 136775 - DNA, 719 bp, Homo sapiens
  misc_feature: GYAE6OF01DOGFM.16.39.D06.1.454.CMB.1.raw
  modified_base (464)..(464): a, c, t, g, unknown or other
  misc_feature (464)..(464): n is a, c, g, or t
tcagtgtactactccacgaccggtgctcgatttagtgacatctcgcagttcgtttgggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtcgtgggaggaggctcgacccaggccggggggtccctgacgactctcctgtgcagcctctgggttcagcgtcagtaacaaccacgtgatgcgggtccgcagccctccgagggaaggggcgtggaatcggggtactcgtagtttaattagaaaaagtgaagtggtagacactaagtctaacgccgacctccgtaggaacgggtccgattaccgacctatcctaccgagaacgaaccaacttaccaagaaacgtacggtanaactactttacaaattgaaaccagtaccgtagaacggaaacccgagggaacctaaccgggaccgttaagtaagtttaacgtttggttaagttaacggttagttagggtaacggtttaaacggttcccggggtaccccggtcgggggtacccgtaaacgggggtaacccggttcgggttaacccgacccgggtttacccgttcccgttacccgtacccgtaccccgtaccccgtaaccccggtaaaacccccgggg

SEQ ID NO: 136776 - DNA, 721 bp, Homo sapiens
  misc_feature: GYAE6OF01EOTOU.16.39.D06.1.454.CMB.1.raw
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctgggaggaggcttcgacccgaggcccgggggggtccccagaccttctcctgtgcagcctctgggttccagcgtcagtaaccaaccacgtgatggtcgggtccgccagccctccgaaggggaaggggctgggaattggggtctacgagtttatagaaaatgatggtcgacacaatcgtacgccgactccggtaggaacgggcctatccacactcctacgagaagaacctaactaacccgaaagaccgaagggtacaagttcttaaccaaatacgaaacgacgaccgtacggaaacgaaccggacggaacggtaaccggtaccgttaattaacttttaagttagggttaacgtttagggttacgttaggggttacgggtttaaacggttccccggggaccccggttacgggggtacccgtaaacggggggttacccgtcgggttaccctacccgggttaccctccccgtaacggtacccgtcccgttaaccccgaaccggtaaacccgggg

SEQ ID NO: 136777 - DNA, 818 bp, Homo sapiens
  misc_feature: GYAE6OF01A9ZKA.16.39.D06.1.454.CMB.1.raw
  modified_base (390)..(390): a, c, t, g, unknown or other
  misc_feature (390)..(390): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctaattttaaaggtgtccagtgtgaggtgtacttgggtggagtcgtgggaggaggcttggaccccgagggcccgggggggtccctgagactctcctgtgcacgtcctcgtgggttcagcgtcagtaaccaaccacgtgatggtcgggtcccgccacgccctccgaggggaaggggctagggaagtggggtctcgtaggttaattagaaaatgtagtggtanaacacaatcctacgaccgtactccggtaggaacggggccctagttaccaaccctactacctaccgagactaaccaatttacccgaaagtaaccgaacggtagtaaacttccttaacaaaagttacgaaaacctacggtaccccgtaaggaaccggaaacccggaacgggtaacccgtaacccggggtacccgtttaaattaacgttttaagtttaacggtttaaggtttaacgggtttaagggttacggggttaacggggtttaaaaccgggttcccccgggggggttaccccccggttacgggggggacccccggttaaacgggggggttaaccccgggttgggttaacccccgttacccgggggtttcccttaacccccggttaccgtaaccggttcccccccgtaacccgggtaaaacccccggg

SEQ ID NO: 136778 - DNA, 560 bp, Homo sapiens
  misc_feature: GYAE6OF01BG96J.16.39.D06.1.454.CMB.1.raw
  modified_base (364)..(364): a, c, t, g, unknown or other
  misc_feature (364)..(364): n is a, c, g, or t
  modified_base (430)..(430): a, c, t, g, unknown or other
  misc_feature (430)..(430): n is a, c, g, or t
  modified_base (444)..(444): a, c, t, g, unknown or other
  misc_feature (444)..(444): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtcgtggaggaggcttgacccaggccgggggggtccctgagactctcctgtgcagcctcgtggttcagcgtcagtaacaaccacgtgatgtgggtccgccagcctccgagggaggggctggaagtgggtctcagttatagaaatgatggtgacanatctacgccgactccgtgaacgggccattccaccatctccagacgacaattccaagaacacggtanatctacaatcaacngcctgacgacgagacacggctatattatgtataggttatggtagtacgtcgggcccgtggggaccgaggggtaccgtgggtccaccgtcctcccgtacacgtccctccgaacccgg

SEQ ID NO: 136779 - DNA, 565 bp, Homo sapiens
  misc_feature: GYAE6OF01D38ZX.16.39.D06.1.454.CMB.1.raw
  modified_base (370)..(370): a, c, t, g, unknown or other
  misc_feature (370)..(370): n is a, c, g, or t
  modified_base (443)..(443): a, c, t, g, unknown or other
  misc_feature (443)..(443): n is a, c, g, or t
  modified_base (551)..(551): a, c, t, g, unknown or other
  misc_feature (551)..(551): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctgggaggaggcttgacccgaggccgggggggtccctgagactctcctgtgcacgcctcgtgggttcagcgtacacgtaaacaaccacgtgatgtgggtccgccacgcctccgaggggacggggcgtagggagtgggtctcgagttattagaaaatgatggtanacacaatcgtacgccgactccgtaggaacggccatcaccatctaccagacacaacttaccaagaacacggtanaacttactacaatgaacagcctagaacgaacgagacacggactatattattgtatagttagtggtgtaacgtccggaccgtgggcagggactggccacgtctccacanccctcgacgaccgg

SEQ ID NO: 136780 - DNA, 1027 bp, Homo sapiens
  misc_feature: GYAE6OF01ATMOI.16.39.D06.1.454.CMB.1.raw
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgcttatttaaaggtgtccagtgtgaggtgtacgttggtggagtcgtgggaggaggcttcgaccccgagggcccgggggggtccctggacgtactccgtcccgtgtcggcacggcccttcgttcggggttacacggtccgttactaaacgtaaaacccgaacccgtacggttaggtacgttcgggttcggggtcccccgaccgacggtccccggtaccgggaaggggggtaaccggggtccgttaggggtaacggtttcggggttccttacggttaaggttttaagttaaaggtaaaagttggtaaggttacgggtacgaaacctaacgtaaacttacccggtaacccggtacccgtaacccggttacccgggttaacggggaaacccggggttaccccggttaaacgtttaccccaaaccccgtaacgtttaccccgtaaccggtaaacggtaaaccgtaaacccgttaaacccgtttaaacccggaaaaccggtaaaacccggttaacgggttaaacgtaaaccttttaacccttaaaccgtaaaacgttaacggaaacccgtaacccggtacccggtaaacgggaaacccggtaaaaccccgggaacggtaaacccggtaaccgggttacccggttaaaattttacggtttaaacgtttaggttaaacggttaaggtttaaggggttaacgggtttaacggggttaacccgggttaccccgggggtaccccggggttacgggggtaaccccggttaaaccggggggtaaccccggttaccgggtaccccttacccgggttcccctacccgggttaacccgaaccccggttcccccgtaaacccgggtaaacccccgg

SEQ ID NO: 136781 - DNA, 1019 bp, Homo sapiens
  misc_feature: GYAE6OF01CK16P.16.39.D06.1.454.CMB.1.raw
tcagtgtactactccacgaccggtgctcgatttagtgacatctcgcagttcttgggggagaggagcccagcactgggattccgaggtgtttccattcggtgatcagcactgaacacagaggactcaccatggagtttggctgtagttgggttttccttgctgtacttaagttttaaaaggtgtccagtgtgaggtgtacgttggtggagtcgtaggaggagcgttcgacccgaggtcccggggggtccctggacgtacctctccgtgtcgcacgccgtgttcgggttcacggtccgtacgaacgtaaaccaaccgacggttagtaagttcggtaccggggtcccgcccgacggtccccgttaccggaagggggaacggggtccgtaggggtaacgttcggggtaccttacgtaaggttttaagttaacggaaaaaagttcggtaagtttacgggtacgtaaacctaaacgttaaaccgttacccgttaaaccccgggaccccggttaacccgtttaccccgggtaacggggtaaacccggggtaccccgtaaacttttaccccgaaaccccgttaaccgttaccccgtaacccggtaaggaaacccgtaaacccgttaaaacccgtttaaaccccggaaaaacggttaaaccccggtaaacgggtttaactaaaaccgtttaccgtttaaaaccgaaaacgttaccggaaaaccctaccggtacccgttaaacggaaacccgggtaaacccggaaaccgggtaacccgacccgggttaacccgttaaagtttaaaccgttttacgtttaaggttaacggtttaaagggtttacgttaacggggtttacgggttaaacccggtttcccccgggggacccccgggttaacggggggtaaccccgggtaaacgggggttaaccccgggttcggggttacccccttaacccgggttcccttaccccggttacccgaacccggttccccccgtaaaccccggtaacccgggtaaacccccgggg

SEQ ID NO: 136782 - DNA, 817 bp, Homo sapiens
  misc_feature: GYAE6OF01CS02H.16.39.D06.1.454.CMB.1.raw
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctaattttaaaaggtgtccagtgtgaggtgtacttggtggagtctggaggaggcttgacccgaggcccggggggtccctgacgactctcctgtgcacgcctcgtggttcagcgtcagtaaaccaaccacgtgagtggtcgggtccgccagccccgtccggaaggggaacggggctagggaagtcggggtctcgtaagtttaagttagaaaaatggtattgggtacgaactaacgaaatccgtaaccgccgtaacgttccggtagggaacgggtccgtaacttccgaacctactacctaccgaagtaaccgtaacctaaacgttaacccgaaacgtaaaccccgtacggttaacgtaaacgttacccttaacgaaaaccgttacggaaaaccctaaccggtaccccgttaaaggaaaccggtaaaaccccgggaacgggaaacccgtacccgggttaacccgtttaaagttaccgttttaagtttacggttaaagtttacgggtttaaaggttaggggttaacgggtttaaaccgggtttcccggggccccggttacggggggacccgtaaagggggtaaccccggttgggtacccgtaccccgttccgttaccccgtacgaaccggtcccctaacccggtaaacccgg

SEQ ID NO: 136783 - DNA, 744 bp, Homo sapiens
  misc_feature: GYAE6OF01DE759.16.39.D06.1.454.CMB.1.raw
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttggttttccttgctgctattttaaaagtgtccagtgtgaggtgtacttggtggagtctgggaggaggcttggacccgaggccgggggggtccctgacgactctcctgtgcacgccttcgtgggttcagcgtcagttaaccaaccgacgtgatggtcgggtccgccagccccgtccgaaggggaacggggctggaagtgggtctcgtagtttagttaagaaaatgtagtggtagacaacaagtctaccggacccgtactccggtaggaacggcccgtattaccgaacctattacctccgaagaaccgaactaaacgtttaccccgaaaaggtaaaccgtaaggttaacggtaaacttacccgttaacaaaagtacgaaaccgacgtacccgtaggaaccggaaccggaacgggaaccgtaccggtaccgttaagttaatttacgtttagttaagttacgggtttaagttagggttacggttaaacggtttcccggggccccgtagggggtacccggtaacgggggtaacccgttgggtaccccttaccggttcccgttacccgtcctaccgcccttacccggaaaccccggg

SEQ ID NO: 136784 - DNA, 1039 bp, Homo sapiens
  misc_feature: GYAE6OF01DXJ9F.16.39.D06.1.454.CMB.1.raw
tcagtgtactactccacgaccggtgctcgatttagtgacatctcgcagttctttggggggagaggagcccagcactgggattccgaggtgtttccattcggtgatcagcactgaacacagaggactcaccatggtagttttgctgtagttgggttttccttgctgcttaagttttaaaaggtgtccagtgtgtaggtgtacgttggtggagtcgtgggaggaggtcttcggacccgaggggcccgggggggtccctggacggtactccgttccgtggtcgccacgtcccgttcggttcgggttacacggtccgtaccgtaacgtaaaaccaacccgtacggttgtaggtcgggttaccgggtcccgacccgaacgtccccgtaccgggaagggggaacggggtcgtagggtaacgttcgggttaccttacgtaaggttttaacgttaaggtaaaaagttggaaggtttacgggtaaccgtaaaccgtaaaccgtaacgttacccggttaacccggtaccccggtaacccggttacccgggtaaacgggtaacggggtaacccccgttaacctttaacccgaaacccgtaccgttacccgtaacccggaaagtaaccgtaaacccttaaacgtttaaccgaaaacggtaaacccggtaaacgggttaaacgtaaaccgtttaaccgtttaaaaccgtaaacgtaaccgtaaacccgacgggttaacccgtaacgggaaacccggaaacccggggtaaaccggaaccggtaacccgggttaaacccgttaagttttaaacgttttaacggtttaagttaaaccgggtttttaagggtttacgggttaacggggtttacgggttaacccggtttacccccgggggttaccccggggttaacgggggtaccccggtaaacgggggttaacccccgggtttcgggttaaccccccgttaacccgggtttaccccccttaaccccggtacccgttaaccccggttaccccccgttaaacccgggaaccccgggtaaaccccgggg

SEQ ID NO: 136785 - DNA, 822 bp, Homo sapiens
  misc_feature: GYAE6OF01CS2W5.16.39.D06.1.454.CMB.1.raw
  modified_base (305)..(305): a, c, t, g, unknown or other
  misc_feature (305)..(305): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctattttaaaggtgtccagtgtgaggtgtacttggtggagtcgtggaggaggtcttgacccgacggccggggggtcctgacgactctcctgtgcacgcctcgtggttcagcgtcaagtaacaaccacgtgatgtcggtccncagcctcgagggagggcgtggaagtggtctactagttagttagaaaatgagtggtagaacaacaagtcctacgccgtacgtccggtacggaacggccgtactccgaacctactaccgtaccgagtaacgaacctaacttaaccaaaggtaacccgtaaggtaacgtaaacttccttaaacgaaagttgaaaacccgtcggaacccgttaacgggaaaccgtaacccgggaaaccgggtaaccgtaaaccccggggtacgtttaaacgtttaacggttttaaagtttacgggttaaagttttaaagggggtttacgttaacgggggttttaacggtttaaaaccccgggttcccccggggggtaacccgggtttaacccggggggaaccggggttaaaaccggggttaacccccggggtttcggtaaccccccggttacccggtttacccgtttcccccgaacgttaccccgggttaccccctaaaccccgggtaaaccccggttaaacccccggggg

SEQ ID NO: 136786 - DNA, 741 bp, Homo sapiens
  misc_feature: GYAE6OF01AVAL7.16.39.D06.1.454.CMB.1.raw
  modified_base (442)..(442): a, c, t, g, unknown or other
  misc_feature (442)..(442): n is a, c, g, or t
  modified_base (450)..(450): a, c, t, g, unknown or other
  misc_feature (450)..(450): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggtagttttggctgtagttgggttttccttgctgctaattttaaaaggtgtccagtgtgaggtgtacttggtggagtcgtgggaggtaggcttgacccgacgggcccgggggggtccctggacgtactcctccgtgtgcacgtccttcgtgggttcagtcgtacaacgtaaccaacctacgtgagtcggtcgggtccgccacgccgtccggaggggacgggcgtaggtaagtcgggtactcgtaagttataagaaagtgagtggtagaacactaacgtctacgcctacgtcgtaggaacggctactcacnctcacganacactaactccaaagactacggtataactctaacgaatacgaacacgtactaggaacgtaaccgaacgggaccgtaaccggtaaccgttattaacgtttaagttacggttaaagttcgggttacgttaggggttaaaccggttaaccggttccccggggtaccccgggttaggggggacccggttaaagggggtaaccccggttgggacccccgttaaccccgggtttaccctaccccggtcaaacccccgggtccccttaacccccggaaacccgggtaaacccccgggg

SEQ ID NO: 136787 - DNA, 701 bp, Homo sapiens
  misc_feature: GYAE6OF01B393T.16.39.D06.1.454.CMB.1.raw
  modified_base (272)..(272): a, c, t, g, unknown or other
  misc_feature (272)..(272): n is a, c, g, or t
  modified_base (406)..(406): a, c, t, g, unknown or other
  misc_feature (406)..(406): n is a, c, g, or t
  modified_base (506)..(506): a, c, t, g, unknown or other
  misc_feature (506)..(506): n is a, c, g, or t
  modified_base (517)..(517): a, c, t, g, unknown or other
  misc_feature (517)..(517): n is a, c, g, or t
tcagtgtactactccacgaccggtgctcgatttagtgacatctcgctaggtttcggttttggggggagaggagcccacgcactgggattccgaggtgtttccattcggtgatcagctactgaacacagaggactcaccatggtagttttggctgagttggtttcttgctgctatttaaacggtgtccagtgtgaggtgtacttggtcggacgtctggaggaggtcttcgacccgaggccgggggggtccctggacgactcctccgtgtagcncgcctcgtgggttacagcgtcaagtaaccaaccgtacgtgatggtcggtaccgccacggccctacgacggggggaacgggtctacgggtaagtcgggttctcgtaaggtttactagaaaattggaagtgggtanaacgacagtcctaccggaccgtacgtccggtaggaacggtccgtacttccaaccgtactccgtaccgagactaaccgtaattaccgaagtacgacggtanacttacgttanaagtcgaacacgtcgagaaacgaaccgacgaacgtaccggtccttaattacgtttaagttagtaacgttaaggttgtacgggttaggttaaccgtccccggggtacccgtggggaacccggtagggtacccgttggtcccgtacccgttctccctacgacccgtcccctacgaaccggacccgg

SEQ ID NO: 136788 - DNA, 832 bp, Homo sapiens
  misc_feature: GYAE6OF01CCVX1.16.39.D06.1.454.CMB.1.raw
  modified_base (364)..(364): a, c, t, g, unknown or other
  misc_feature (364)..(364): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccaggccgggggggtccctgagactctcctgtgcagcctcgtgggttcagcgtcagtaaccaaccacgtgatggtcgggtccgccacgccctccgaggggaaggggctaggaagtgggtctcgagttatagaaatgatgganacacaatctacgccgtactccggtagaacgggccgtacttccgacctatcctacccgaagaacgaacctaaactttacccgaaaagaaccgtaaccgggtataaacttcgttaaccgtaaaagtacgaaaacgtacgtaccctaagggaaaccggtaaacccggaacgggaacccgtaaccggggtaaccccgtttaaagttttaaacgttttaaacgtttttacggtttaaaaggttttaacgggggttttaactttaacgggggggtttaaccggggtttaaaaccgttttccccccggggggggtacccccccgggttaccgggggggggtaccccgtaaacggggggggttaaacccccggttcggggtttaccccctaacccccgggtttcccgttccccgttaacccggtaaccccggtcccccgtttaaccccccgtaaacccggggtaaaccccccgggg

SEQ ID NO: 136789 - DNA, 639 bp, Homo sapiens
  misc_feature: GYAE6OF01CFKVS.16.39.D06.1.454.CMB.1.raw
  modified_base (615)..(615): a, c, t, g, unknown or other
  misc_feature (615)..(615): n is a, c, g, or t
  modified_base (625)..(625): a, c, t, g, unknown or other
  misc_feature (625)..(625): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgtagttgggttttccttgctgcttaattttaaaggtgtccagtgtgaggtgtacttggtggagtcgtggaggaggtcttcgaccccgagggtcccgggggggtccctagacggacctccgtccgtgtgcacgcctcgtgggttcaggcgtacaagtaaaccaaccgacgtgagtcggtcgggtcccgacccgacgccctaccggaaggggagggccgtaggaagtcgggtctcgtagttatagaaaatgagtggtagacacgaatcctacgccgtacgtccggaggaacgggcctactccaccactcctaccgaagaacgtactaacttaccgaaagtaaccgtaggtagaacgttacctaacaaagtacgaacgacgtaccagaacgaaccgaggactacggacgtattatattgtagtagtagtggtagtacgtccggtccggcggaccggaggtacgcgtccncgtcctcctncctccgtccaccgg

SEQ ID NO: 136790 - DNA, 600 bp, Homo sapiens
  misc_feature: GYAE6OF01BDZ7D.16.39.D06.1.454.CMB.1.raw
  modified_base (365)..(365): a, c, t, g, unknown or other
  misc_feature (365)..(365): n is a, c, g, or t
  modified_base (401)..(401): a, c, t, g, unknown or other
  misc_feature (401)..(401): n is a, c, g, or t
  modified_base (428)..(428): a, c, t, g, unknown or other
  misc_feature (428)..(428): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaggtgtccagtgtgaggtgtacttggtggagtctgggaggaggcttgacccaggccgggggggtccctggacgactctcctgtgcagcctcgtgggttcagcgtcagtaacaccacgtgatggtgggtccgccgagcctcgaggggaggggctgggaatgggtctcgagttatagaaaatgatggtnacgacaatcacgcgactccgtgacggccagttcacntcacagacacaattccaagacaggtanaatcttacaaatgaacagccgtagaacgaaccgaggaccacggcctaatattagtcgtattacggttatggtacggttacgttcccggggcccgttgggggtaccaacggggtacccgttcgggtaccctacccgggttcttacccgacgacgtccccgtccgaaacccggg

SEQ ID NO: 136791 - DNA, 888 bp, Homo sapiens
  misc_feature: GYAE6OF01DXO5L.16.39.D06.1.454.CMB.1.raw
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtcgtggaggaggcttgacccaggccggggggtccctgagactctcctgtgcagcctctggtcagcgtacaggtaaccaaccgacgtagagttcggtcgggtccgaccgacgtcctaccggaagggggaacggggtacgttagggaaacggttcgggtaccgttcgtaagtttacttaggaaaaattggtagtgggtagaactacgtaaacgtccgtaaccggaccgtaccgtaccggtacgggaaaccggggtaccgtacgtttaccgaacccgtacttaccgtacccgtaaaggacgtaacccgtaaacgtttacccgaaaacgtaaaccgtaacgggttaacgtaacctttaaccgttaacgtaaaacgttaccgaaaccgtaacggtacccgttaaggaaccggaaacccggacgggtaaacccgtaccgggttaacccgttaagtttaaccgtttaaggtttacggttaccgggtaccccgggttaacggggtttaaacggtttttaaccgttaacgttacggttaaacgtttaaacggttttaaacggtttaaagggttttaaaaaccggtaaaaaaaccggggttttaccgttaaacgtttttaaacgggaacccggttttaaccgggtaaccgggggtaacccggttaacccgggggtttaaaacccccgg

SEQ ID NO: 136792 - DNA, 892 bp, Homo sapiens
  misc_feature: GYAE6OF01BTWIP.16.39.D06.1.454.CMB.1.raw
tcagtgtactactccacgaccggtgctcgatttagtgacatctcgcagttctttggggggagaggagcccagcactgggattccgaggtgtttccattcggtgatcagcactgaacacagaggactcaccatggagttttggctgtagttgggttttccttgctgtcttaattttaaaaggtgtccagtgtgaggtgtacgttggtggagtcgtggaggaggcttgacccgagggcccgggggggtccctgacgacctctccgtgtgcagtcctcgtcgggttcagcgtacaacgtaaccaaccacgtagagtcggtacgggtcccgaccacggcccgtaccggaagggggaacggggtccgtagggtaacgtcgggttaccttacgtaaggtttaacgtttaaaggtaaaaagttggtaagttcgggtacgaaacctaacgtaaactccgtaaccggcccgtaaccgtaccgggtacggaacgggtacccgtacttacccgaacctactccctaccgaaggaactaacctaaacgttaccgaaaggtaaaccgtacgggtaactaacgttaccttaacgaaagtaccgtaaaccgacgtacccgtaaggaaacccgggtaaaccggacggtaaaccggaaccggttaccttaaagtttaacgttttacggttagtttaaagttacggggttttaacgttaggggttaacggtttaaaccgggttccccgggggtaccccgggttacggggggaaccccggttaagggggtaaacccccggtttcgggttaacccccgtaacccccgggttttccccgtaaccccggtttaacccggacccccggttaacccccggttaaacccccggtaaccccgggttaaacccccgggg

SEQ ID NO: 136793 - DNA, 658 bp, Homo sapiens
  misc_feature: GYAE6OF01E4ALP.16.39.D06.1.454.CMB.1.raw
  modified_base (200)..(200): a, c, t, g, unknown or other
  misc_feature (200)..(200): n is a, c, g, or t
  modified_base (394)..(394): a, c, t, g, unknown or other
  misc_feature (394)..(394): n is a, c, g, or t
  modified_base (426)..(426): a, c, t, g, unknown or other
  misc_feature (426)..(426): n is a, c, g, or t
  modified_base (459)..(459): a, c, t, g, unknown or other
  misc_feature (459)..(459): n is a, c, g, or t
  modified_base (471)..(471): a, c, t, g, unknown or other
  misc_feature (471)..(471): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgcttatttaaaggtgtccagtgtgaggtgtacttggnggagtctggaggaggtcttcgacccgaggccgggggggtccctgacgactctcctgtgcagcctgtggtcagcgtacaacgtaaccaaccgacgtagagtggtcgggtcccgcacgcccgtaccggaggggacgggtctggaagtcgggtactacgagtttatagaaagtgagtggtacaactacaatcgtacnccgtacgtcggaggacggtccattccaacgtntctaccagacgaacactaccaaagaccaggtanaactctaacaanacaacgcgtaccagaacgaaccggagacgacgtactaatattaagttacggtaattaggttaagtcgggttacggttaaacggttccccggggacccgttcggggtcccgtaaggggtacccggttcggacccgtacgtacccgttcctacccgaccgtacccctccccgaaacccggtaacccggg

SEQ ID NO: 136794 - DNA, 767 bp, Homo sapiens
  misc_feature: GYAE6OF01BSQGI.16.39.D06.1.454.CMB.1.raw
  modified_base (339)..(339): a, c, t, g, unknown or other
  misc_feature (339)..(339): n is a, c, g, or t
  modified_base (414)..(414): a, c, t, g, unknown or other
  misc_feature (414)..(414): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggtagttttggctgtaggttgggttttccttgctgtcttaatttaaaggtgtcagtgtgaggtgtacgttgggtggagtcgtgggaggaggcttcgacccgacgggcccggggggtcctggagtacctccgtccgtgtacgcacgtcctcgttgggttcaggcgtacaagtaaccaaccgtacgtgagttggtcgggtcccncgacgccgtaccggagggggtaagggcgtaggaagtcgggtactacgtagtttagtaagaaaatggtatgggtanacaactaacgtacgtaccggaccgtacgtaccgtagggaaccggtccgtaataccgacctagtcctacgagaacgtaacctaactaccaaagaaccgtaaggtagtaactacgttaacaaagtacgaacgacgtaccgtaggaaaccgtaaccgggacggaaccctacggtaaccgttaacttaagttttaacggttggtttaaacggttagggtttaacggttcgggttaacggttaacggttacccccgggggcccggttacggggggtaacccgtaacggggtaacccggtccgggttacccacccggtttcacccgttaccgaacgttccccgaacccggtaacccggg

SEQ ID NO: 136795 - DNA, 538 bp, Homo sapiens
  misc_feature: GYAE6OF01B9H9C.16.39.D06.1.454.CMB.1.raw
  modified_base (360)..(360): a, c, t, g, unknown or other
  misc_feature (360)..(360): n is a, c, g, or t
  modified_base (364)..(364): a, c, t, g, unknown or other
  misc_feature (364)..(364): n is a, c, g, or t
  modified_base (397)..(397): a, c, t, g, unknown or other
  misc_feature (397)..(397): n is a, c, g, or t
  modified_base (415)..(415): a, c, t, g, unknown or other
  misc_feature (415)..(415): n is a, c, g, or t
  modified_base (418)..(418): a, c, t, g, unknown or other
  misc_feature (418)..(418): n is a, c, g, or t
  modified_base (425)..(425): a, c, t, g, unknown or other
  misc_feature (425)..(425): n is a, c, g, or t
  modified_base (432)..(432): a, c, t, g, unknown or other
  misc_feature (432)..(432): n is a, c, g, or t
  modified_base (437)..(437): a, c, t, g, unknown or other
  misc_feature (437)..(437): n is a, c, g, or t
  modified_base (471)..(471): a, c, t, g, unknown or other
  misc_feature (471)..(471): n is a, c, g, or t
  modified_base (517)..(517): a, c, t, g, unknown or other
  misc_feature (517)..(517): n is a, c, g, or t
  modified_base (521)..(521): a, c, t, g, unknown or other
  misc_feature (521)..(521): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccaggccgggggggtccctgagactctcctgtgcagcctctgggtcagcgtcagtaacaaccacgtgatgtgggtccgccagcctaccgaggggaaggggtcaggaatgggtctacgagttattagaaaatgatggtnacanaatctacgcgactcgagaacggcgatcacatcncagacacaatccaagacnganaatctanaatgaanacgcngaagacgagacacgtactatattatgtagtagtnggtagtatccgggccgtgggcctagggaccgtggccaccgtctccncganccctccaacgtaaccgg

SEQ ID NO: 136796 - DNA, 752 bp, Homo sapiens
  misc_feature: GYAE6OF01DDD4M.16.39.D06.1.454.CMB.1.raw
  modified_base (306)..(306): a, c, t, g, unknown or other
  misc_feature (306)..(306): n is a, c, g, or t
  modified_base (343)..(343): a, c, t, g, unknown or other
  misc_feature (343)..(343): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctatttaaaggtgtcagtgtgaggtgtacttggtggagtcgtggaggaggcttgacccgaggccgggggggtccctggacgactctcctgtgcagcctcgtgggttcagcgtacagtaacaaccacgtgagtgtcgggtccncacgccgtaccgagggaagggcgtggaagtgggtctntagttaagtagaaaatgagtggtcgaacactaactacgtaaccgcccgtacgtacggaggacggtccgtacttacaccgtatacctaccgaagacgtaacctaacttaaccgaaaggtaaacccgtacggtaacgtaatttacccttaacgaaacgttaacggaaccgtaacgacccgtaaggaaaccgaaacccgggaaggtaaccgaacccggtaccggttaatttaacgtttagttacggttaagttaagggtttacgttaggggtttaacggttaaccggttcccgggggtacccccggtacgggggaacccgtaacggggttaaccccgggttcggtaccccggtacccgttacccgtacccgttaacgccggtacccctcccggaacccggtaaaccccgggg

SEQ ID NO: 136797 - DNA, 831 bp, Homo sapiens
  misc_feature: GYAE6OF01DRY0T.16.39.D06.1.454.CMB.1.raw
  modified_base (480)..(480): a, c, t, g, unknown or other
  misc_feature (480)..(480): n is a, c, g, or t
tcagtgtactactccacgaccggtgctcgatttagtgacatctcgcagttcgtttgggttttggggagaggagcccagcactgggattccgaggtgtttccattcggtgatcagcactgaacacagaggactcaccatggagttttgctgtagtttgggttttccttgctgtacttaagttttaaaaggtgtcctaggttgtggtaggttagttacgtttgggtggtacgttcgtgggaagggtaggtccgttacgaaccccggacggggtccccggggggggttccctaggacgtaccgtccttccgtcggtgccgacgtccgttcgtggttcacgtcgtacaagtaaaccaaccgtacgtagtacgtcggtcggtacccgccgacggtccccgtaccggaagggggaacggggtccgtagggtaacgtcgggttatacgttaagttttaagtaaggtaaaatggtaagttacgggtanaaccgtacgtaaacttaccgacccggtaccgtaaccgttaccggtacgggaaccggtccgtacttaccgaacgtactccgtaacctaagaaccgtaacttaaacgtacccgaaaagaaccgtacggtaataaacttcctaaaagaaagttaccggaaacctggtacccgtaaggaaacggaacccgtaggaccgtaaccggtactttaagttctttaaggtttagttaaacgtaggttttacggtgggttaaggttaaccgggtccccgggtaccccggtggggaaccgtacgggttacccgtcggtccccttacgtccctacaccgtaccgtcccccgtcgaaaccccgg

SEQ ID NO: 136798 - DNA, 989 bp, Homo sapiens
  misc_feature: GYAE6OF01BG6AR.16.39.D06.1.454.CMB.1.raw
tcagtgtactactccacgaccggtgctcgatttagtgacatctcgcagttcgtttggggggagaggagcccagcactgggattccgaggtgtttccattcggtgatcagcactgaacacagaggactcaccatggtagttttggctgtagtttgggttttccttgctgtacttaagttttaaaaggtgtccagtgtgaggtgtacttggtggagtcgtgggaggaggtccgttcggaccccgacgggtcccgggggggtccctggacgtaccttcctcccgtggttcgcgtacgcccgttcgttcgggttccacgccgttacaacgtaaaccaacccgtacgtagagttcggtcgggtccccgccgacggtccccgtaccggaagggggtaacggggtccgtaggggtaacgttcggggtcctacgtagtttaagttaagtaaaagttggtagtggtacgtaaccaacgtaacttccgtaacccggcccgtaaccgttcccgggtaacgggaaccgggtacccgtacttaccctacccgtacctcccgtacccgaaggtaccgtaaaccttaaacgttaaccccgaaaaagtaacccgtaaaccgggttactaaacgtttaccttaaacgaaaacgttaccgaaaaccgtaccgtaacccgtaagggaaaacccggtaaacccgggaccggtaaaccggtacccggttaaccggttttaaactttaaggttttaaacgttttaggttaaaacggtttttacggggttaacggtttaaccgggggtttaagggttttaaaacccccgggttcccccgggggggttacccccgggttacggggggaaacccccgggttaaacgggggggttaaaccccccggtttgggttaaccccccgttaaccccggtttcccgtttaacccccggttaccggtaaaccccgttcccccgttaaacccccgggaaaccccgggttaacccccccggggg

SEQ ID NO: 136799 - DNA, 981 bp, Homo sapiens
  misc_feature: GYAE6OF01AD90V.16.39.D06.1.454.CMB.1.raw
  modified_base (954)..(954): a, c, t, g, unknown or other
  misc_feature (954)..(954): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccagtggagttttggctgagtttgggttttccttgctgtacttaattttaaaaggtgtccagttgtgaggttgtacgttggtggtaggtcgtgggagggaggtccttacggaccccggacggggcccgggggggttacccctggacggtaccctccgttcccgttggtcgaccgtaccggtcccgttcggttcggggtttccacggtccggtaccgtaaacgtaaaaccccaaccccgtacggtaggtacgtttcggggtccggggtacccccgaccccgtaaccggtccccgttacccggggaaaggggggtaacggggtccgttaaggggtaacggttacgggtttccgttaacggttaaggttttaacgtttaaaggtaaaaacggtttacgggtaaggtttacgggttaaccgaaaccgtaaaccgttaaaccgttacccggttaaacccggtacccccggttaaacccggttacccggggttaacggggtaaaccgggggtacccccgtttaacgtttacccccgtaaacccgttaccgttacccccgttaaccgaacggtaaacccgtaaaaccgttaaaccgttaacccgaaaaaccgggtaaacccgtaacgggttaacgtaaccgtttaacctaaaccgaagttaaccgaaccgtacggtaacccgtaacggaacggaaaccccggaggtaaccccgacgggttaaccttagttaacgttaacgttagtaagtttacgggtgttacgggttaggttaccggtccgggtcccggtagggaccccggtagggtcccgtgtacccgtaccttccnccgtacgccgtacccgtccggacccgg

SEQ ID NO: 136800 - DNA, 972 bp, Homo sapiens
  misc_feature: GYAE6OF01D4BHF.16.39.D06.1.454.CMB.1.raw
tcagtgtactactccacgaccggtgctcgatttagtgacatctcgcagttctttggggggagaggagcccagcactgggattccgaggtgtttccattcggtgatcagcactgaacacagaggactcaccatggtagttttggctgtagtttgggttttccttgctgtcttaagttttaaaaggtgtccagtgtgaggtgtacttggtggagtcgtgggaggaggtcttcgacccgagggcccgggggggtccctggagtacctcctccgtggtcgcctacgcctcgtcgggttcagtcgtacaagtaaaccaaccgtacgtgtagtcggtcgggtcccgcccgacggtcccgtaccggaggggggaacggggtcgtaggggtaaacgttcggggttaccttacgtaagttttaagttaagtaaaaagttggtaaggttggtacgaacctaaacgtaacgttaccgtaacccggtacccgtaccgtttacccgggtaacgggaaaccggggtcccttaaaccgtttacccgaacccgtaccgttacccgtaacccggaaggtaaaccgtaaacccgtaaacccgttaaacccgaaaacggtaaacccgtaacgggttaaacgttaaccgtttaacctttaaaccgtaaaagttaaccgaaaccgtaacggtaacccgttaacggggaaaacccggtaaacccgggaaccgggaaacccggtaaaccggggttaaccgtttaaacgttttaagttttaaccggtttaagggtttaaagggttttaaaggggttttacggtttaagggggtttaacccgggtttaaaccgggtttccccgggggtacccccgggttacggggggtaaccccgggtaaagggggtaccccggttacggggttaccccgttacccggttcccgtacccgttaccgacccggttaccccctaacccggaaccccgggtaaccccggg

SEQ ID NO: 136801 - DNA, 694 bp, Homo sapiens
  misc_feature: GYAE6OF01ESB2S.16.39.D06.1.454.CMB.1.raw
  modified_base (307)..(307): a, c, t, g, unknown or other
  misc_feature (307)..(307): n is a, c, g, or t
  modified_base (579)..(579): a, c, t, g, unknown or other
  misc_feature (579)..(579): n is a, c, g, or t
  modified_base (608)..(608): a, c, t, g, unknown or other
  misc_feature (608)..(608): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgcttattttaaaaggtgtccagtgtgaggtgtacttggtggagtctggaggaggcttgacccgaggccggggggtccctgagactctcctgtgcagcctcgtgggttcagcgtcagtaaccaaccagtgatgtggtccnccagcctccggaggggaacgggggctagggaacgtgggtctcgtagttattagaaaatgatggtagacactaatcacgcgactccggtagaacgggtccgattccaacctagtcctaccgagaacgtaacctaattacccgaaagaacccgacggtaagtaacttacctttaacaaaagttcgaaaaccgtagtacccgtaaggaaccggaaccgggacggaacccgtaacgggtaccgttaattacgttacgtggtacggacggtaacggnggggtaacgtttgggtacgggacgggttntaacggttgtacgttaacgtttcggaaacccgttacgggaccgggggtaacccgtaacggggttaaccccgtgggttaaccccccg

SEQ ID NO: 136802 - DNA, 740 bp, Homo sapiens
  misc_feature: GYAE6OF01C8XFD.16.39.D06.1.454.CMB.1.raw
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgcttatttaaaaggtgtccagtgtgaggtgtacttggtggagtctgggaggaggtcttgacccgaggccggggggtccctgagactctcctgtcgcacgcctcgttgggttcaggcgtacaacgtaaccaaaccctacggtgagttggtcgggtcccgccgacggtcccgtaccggaaggggaaggggcgtagggaagttcggggtcctacgaagtatacaacaagcgtaaggtacgtacgtaccgacgagtacggtacgcaacgtaccgtccggtaaggtaccggggttcccgtttaccaaccgtacgtaccctaccgaacgtaacgtaaacctaaacttaacccgaaacgtaaaccgtaccgtactttaacgttactttacgaaactaaagttacgaacgtagttaccgtaggaagtacggtacggaacggaaccgaccgggtactaagttaacttaacgtttacgtaggtacggtaacgggtaaacgggtacgggttaaggtttggggtacgggtcgggttacgacgttgtacgttacttacggacggttacggcggggtaccgtaacccgggg

SEQ ID NO: 136803 - DNA, 894 bp, Homo sapiens
  misc_feature: GYAE6OF01D3M0M.16.39.D06.1.454.CMB.1.raw
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagtttgggttttccttgctgtcttaattttaaaaggtgtccagtgtgaggtgtacgttggtggagtcgtggaggaggcttgacccgagggcccgggggggtccctggacgactcctccgtgtgcagcctcgtggttcagtcgtcaagtaaccaaccgacgtgagttggtcgggtcccgaccgacgccccgtacggaaggggaacgggggtctagggaagttcgggtcctacgtaagtttagtaggtaaaaagtgagttcgggtacgaacctaacgtaaacgttccgtaacccggcccggtaacccgttcccgggtaacgggaaacggggtaccccgtaacgtttaccccaacccgttacttacccgtacccgaaaggtaaaccgtaaacctaaaccgtttacccgaaaaaacgggtaaacccgtaacgggtaagttaaaccttaccgtttaaacaaaagtacgaaaacccgtacgtaccccgtaaggaaacccgggtaaaccccggaaggggtaacccgaacccgggttacccgtttaaagtttaagtttttaaggtttaacggttaaggtttaagggtttaaacggttgggggttaaccggtttaaacggttcccccgggggtaccccggggttacgggggtaaccccgggtaaacggggttacccccgggttagggttaccccctaacccggtttccctaccccggtaccaacccggtcccccgtaacccgaaaccccgggg

SEQ ID NO: 136804 - DNA, 645 bp, Homo sapiens
  misc_feature: GYAE6OF01BIMJ4.16.39.D06.1.454.CMB.1.raw
  modified_base (264)..(264): a, c, t, g, unknown or other
  misc_feature (264)..(264): n is a, c, g, or t
  modified_base (411)..(411): a, c, t, g, unknown or other
  misc_feature (411)..(411): n is a, c, g, or t
  modified_base (416)..(416): a, c, t, g, unknown or other
  misc_feature (416)..(416): n is a, c, g, or t
  modified_base (453)..(453): a, c, t, g, unknown or other
  misc_feature (453)..(453): n is a, c, g, or t
  modified_base (495)..(495): a, c, t, g, unknown or other
  misc_feature (495)..(495): n is a, c, g, or t
tcagtgtactactccacgaccggtgctcgatttagtgacatctcgcaggttcgtttgggttttggggagaggagcccagcgactgggattccgaggtgtttccattcggtgatcagcactgaacacagaggactcaccatggagttttgctgagttggtttccttgctgctatttaaaggtgtccagtgtgaggtgtacgttggtggagtcgtgggaggaggcgttgacccagggccggggggtcctggagctctccgtgtgcngcctcgtgggttcaggtcgtactaacgtaaacaacccgtaggtagtagttcggtcggggtccccgcccgaacggtccccgtaccggaagggggaaggggtccttagggaagttcgggtctacgtagttatagaaaagtgagtcggtnaacanaatcacgccgacgtcgaggaaggcctatccgacctancctcgagacgactaacgtacaaagacaggtacaattacgtanaaatgaacagccgtagacgtaacgagacgacggtacgtatacgttatcgtaagttacggttagtgggttagtaccggtccggacccggttgggaccgacggtaacggtcgtacccgaccgttccgacctacaccgtccctccgaacccgg

SEQ ID NO: 136805 - DNA, 842 bp, Homo sapiens
  misc_feature: GYAE6OF01EGBRD.16.39.D06.1.454.CMB.1.raw
tcagtgtactactccacgaccggtgctcgatttagtgacatctcgcagttctttgggttttggggagaggagcccagcactgggattccgaggtgtttccattcggtgatcagcactgaacacagaggactcaccatggtagttttggctgtagtttgggttttccttgctgtcttaagttttaaaggtgtccagtgtgaggtgttacgttgggtggagttcgtgggaggaggtcttcgacccgacgggcccggggggtccctaggacgtacctccgttccgtgtcgccgacgtcccgttcggttagggtttaccgacggtaccggttaccgaaacggttaaaacccaaacccgtaaccggttggtaacgttcgggttccggggttaccccgccgtaccggaccccggttaccgggaagggggaacggggtccgtagggtaacgttcgggttaccttacggttaagttttaacgttaaagtaaaaagttggtaagtacgggtacgaaaccgtaactaacgtccgtaaccgcccgtaacgtcccggtaaggaaccgggtacctaacgttaccaacccgtacttacccgtaaccgaagtaacggtaaacctaaccgttaaccgaaacggaaccgttaacgtaagtaactttaccgttaacctaaagtacgaacaccgtcgtaacggaaccgaacggaacgaccgtaaccgtacgttaattacgtttagttagttagttaagtaggttaggtacgtttaaccggtccggtacccggtcggggtaaccgacgggtacctcggttcccgaccgttcacccgtacgcccgcccgtacccgtaacccgg

SEQ ID NO: 136806 - DNA, 688 bp, Homo sapiens
  misc_feature: GYAE6OF01E0RH3.16.39.D06.1.454.CMB.1.raw
  modified_base (385)..(385): a, c, t, g, unknown or other
  misc_feature (385)..(385): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccaggccgggggggtccctgagactctcctgtgcagcctctgggttcagcgtcagtaacaaccacgtgatgtgggtccgccagcctccgagggaagggctggaatgggtctcagttatgaaaatgaagtggtgacacgaatctacgccgtactccggngaacgggccaattcacctatcctaccagagacaacttaccaaagaacctacgggtacgtaacttaccttaccaaaagttacgaaacctacgacctacggaacgaaacccggaaggaaccgaaccggaccgttaagttaacgtttaacgttagttaagttaagggtttaatacggggttaggttaaacggttacccgggggccccccgttaggggggaccccgtaaaggggggtacccggttacgggtaccctaacccgggttccttacccgtacctaccggccccgttacccgaaaccccggg

SEQ ID NO: 136807 - DNA, 806 bp, Homo sapiens
  misc_feature: GYAE6OF01BSPET.16.39.D06.1.454.CMB.1.raw
  modified_base (181)..(181): a, c, t, g, unknown or other
  misc_feature (181)..(181): n is a, c, g, or t
  modified_base (279)..(279): a, c, t, g, unknown or other
  misc_feature (279)..(279): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggtagttttggctgagttgggttttccttgctgacttaatttaaaggtntcagtgtgaggtgtacgttggtggagtcgtgggaggaggtccgttcggacccgacggggtcccgggggggtccctggacgtacttcctccgtgtcgcncgtccttcgtgggtcagtcgtcgaacgtaaccaaccgtagtgacgtggtcgggtcccgccacgcccgtaccggagggggaagggtcgtagggtagtcgggtactcgtagtttaataggaaaatggtagtggtacgaacaacgtaactccgtaccgacccgtacgtccgggtaggtaacgggtcccgtaacgttcccaaccgtacttcccgtacgaagtaccgtaactaaccgtaccaaggtaaaccgacgttaacgtaacttaccgttaacaaagtcgaaaccgtacgtccgtaaggaaccggtaaccgaacggtaccggaacccggttaagtttacgtaattttacggtttaaggtttagttaacgggttttaggagggtttaaccgggttaaccgggttccccggggacccgggtttcggggaaaccccggtagggggttaacccgtccgggttaccccttcccccgttacggtccccgtaccggtaaccctccccgttaaccggaaccgggttaaccccccggg

SEQ ID NO: 136808 - DNA, 719 bp, Homo sapiens
  misc_feature: GYAE6OF01DP8ED.16.39.D06.1.454.CMB.1.raw
tcagtgtactactccacgaccggtgctcgatttagtgacatctcgcagttctttggggggagaggagcccagcactgggattccgaggtgtttccattcggtgatcagcactgaacacagaggactcaccatggtagttttggctgtagtttcgggtttttccttgctgtctttaagtttttaaaaggttgtccagttgtgtaggtgttacgtttgggtggagtcgtggagggacggtcttcgacccggacggggtcccgggggggtccctgacgtcctcttccgtgtcgctacgtccgtcgtggtcagtcgtacaacgtaaccaccagtcgatggtcggtccgcgacgccgtaccggaaggggagggtcgtggtaacgtgggtctacgtagttaagtagaaaagtgtaagtggtacactaactactccgtacgccgacgttccgtaggaacggtacgtacttacactactctaccgagactaactacgttacgaaacgtaacgtagtacgtaacttaactaactaagtacgaacgcgtactaggaacgtaacggacgacgaacggttactttaattagtttttaacttttaaggttagtttagttaggtacggttaacggttcccgggccggtacgggaccggtacgggtacccggttcggtccgtacccgttcgtcccgtacgtacccgaccctacccggaaccgtacccggtcccg

SEQ ID NO: 136809 - DNA, 972 bp, Homo sapiens
  misc_feature: GYAE6OF01BIXBS.16.39.D06.1.454.CMB.1.raw
  modified_base (175)..(175): a, c, t, g, unknown or other
  misc_feature (175)..(175): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggtagtttggctgagttggtttcttgctgcttatttaaaggtntccagtgtgaggttgtacgttggtggagtcgtgggaggaggtcttcggacccgacggggtcccgggggggttccctggacgtaccttccgtaccgtggtcgcgacgtcccgttcggttcggggttcacggtccgttacgaaacgttaaaacccaacccgtacggttaggtaacgttcggggttccggggtacccccgacccgtaaccggccccgttaccgggaaacgggggggtaacgggggtccgtaggggtaaacggtttcgggggttaccttacggttaagtttaagttaaggtaaaaagttgtaaggttagggtacgaaacctaacgtaactacccgtaaccggtccccggtaacgtttacccgggaaggtaaccggggtacccttacgtttacccaaccgtacttacccgtaaccgaacggtaacgaacccttaaaccgttaacccggaaaacgtaacccgtaacgggttaactaaaccgtttacctttaaacgaaaacgttaacgaaaacccgcggtacccgtaacgggaaaaccggaaacccgggtaacgggaacccgtaaaccgggttaaccgtttaatttaacgttttaagtttaacggtttaacgttaagggtttaacgtttacgggggtttaacgggttaaccggtttccccgggggacccccgggttagggggaaccccggttaaccgggggtaaccgggttcccgttacccggtaaccccggttcccgtttaccccggacgttaccccggacccccttaacccggaaaccccggtaacccgggg

SEQ ID NO: 136810 - DNA, 851 bp, Homo sapiens
  misc_feature: GYAE6OF01C74LL.16.39.D06.1.454.CMB.1.raw
tcagtgtactactccacgaccggtgctcgatttagtgacatctcgcagttctttggggggagaggagcccagcactgggattccgaggtgtttccattcggtgatcagcactgaacacagaggactcaccatggtagttttggctgtagttgggttttccttggctgtacttaattttaaaaggtgtccagtgtgaggtgtacttggtggagttcgtgggaggaggtcttcggacccgagggcccgggggggtcctagacgtactctcctgtcgcgacgtcctcgttgggttcacgcgtacaacgtaaaccaaccaacggttgagttggtacggtccgccacggtccctaccgggaagggggaaagggtctacgggaagttcggggtaccttcgtaagtttacgttaagtaaaaagtgaacgttggtacgaaaccaacgtaatccgtaacgacccgtacgtaccggtagaacgggtccgtacttaccgacctagtacctacgacgaacgtaacaacttaaccgaaagaacgtacggtacgtaattacgtaactaacgtacgtaaccgtacgtaccgtaacggaaccgtaaccgggacgggtaaccgaaccggggttaccttaaacgttaagttttaacgttaggtttaaccgttttaaagggttacgttaaggggtttaaccggtttaacgggttaccccggggtacccccggtacgggggggtaaacccgttaaccgggggggtaacccggtttacccggggttaccccgtaacccggtttacccgttcccccggtaaccgtaacccggtaccccccgtaaccccggtaaaccccgggtaaaccccgggg

SEQ ID NO: 136811 - DNA, 736 bp, Homo sapiens
  misc_feature: GYAE6OF01A2O9I.16.39.D06.1.454.CMB.1.raw
  modified_base (178)..(178): a, c, t, g, unknown or other
  misc_feature (178)..(178): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctattttaaaggtntccagtgtgaggtgtacttggtggagtcgtggaggaggcttgacccgaggcccggggggtcctggagactctcctgtgcagtcctcgtgggttcagcgtcaacgtaaccaaccgtacgtgagtcggtcgggtcccgccacggcccgtccggaagggggaacggggtcgtagggaagttcggggtctacgtagtttaagttagaaaagttgagttggtacgaacctaactaaacgttcctaacggcccgtaccgtccggtaggaacgggcctacgttacacctactcctacgaagacgtaactaactaccgaaagaacgtaacgtagtaacttacttaacaaactacgaacacgacgtagaacggaaccgaggaccgaccggacttagtaattagttagtaagttaaggttagttagggttacggttaacggttcccggggtaccccggtacgggggtacccgtaacggggtacccggttacgggtccccgtaacccggttcccttacccgtacccggtaaacccgccccttaaaccccggacccggtaaaccccgggg

SEQ ID NO: 136812 - DNA, 742 bp, Homo sapiens
  misc_feature: GYAE6OF01CNXGY.16.39.D06.1.454.CMB.1.raw
  modified_base (329)..(329): a, c, t, g, unknown or other
  misc_feature (329)..(329): n is a, c, g, or t
tcagtgtactactccacgaccggtgctcgatttagtgacatctcgcagtttcgtttggggttttgggggagaggagcccagcactgggattccgaggtgtttccattcggtgatcagcactgaacacagaggactcaccatggagttttgctgtagttgggttttccttgctgtcttaattttaaaaggtgtccagtgtgaggtgtacgttgggtggagtctggaggaggtcttcgacccgagggcccggggggtcctgagactctcctgtgcacgtcctcgtggttcagcgtacaggtaaaccaaccgacgtgagtcggtcgggtccnccgacggccctccggaaggggacgggcgtggaagtcgggtctctagtttagttagaaaagtgagtggacgacaactaaactccgtaaccgccgtacgtccggtaggaacgggtccgattccaacctactccgtaccaacgtagaacctaaacgttacccgaaaggtaaacctacgggtaataaacttcttaacaaagttcgaacgacgtaccgtaagaaccggaaaccgaggaacccgtaacgggtaccgtttaagttactttaaggtttagttaacggtttaggttaaaggttgggttaacggttaaaccggttcccggggtaccccggtaggggtaccggaaccggggttaccggttcggtacccgtaccggttcctaccggtccaccggtaccccgtcccgaaacccggg

SEQ ID NO: 136813 - DNA, 764 bp, Homo sapiens
  misc_feature: GYAE6OF01DY7Z9.16.39.D06.1.454.CMB.1.raw
tcagtgtactactccacgaccggtgctcgatttagtgacatctcgcagttctttgggttttggggagaggagcccagcactgggattccgaggtgtttccattcggtgatcagcactgaacacagaggactcaccatggtagttttggctgtagtttggttttccttgctgtacttaagttttaaaaggtgtcctagtgtggtaggtgtacgttggtggagtcgtgggaggaggtcgttcgacccggtacgggcccggggggtccctaggacgtaccttccgtccgtgtcgccgacgtccttcggtaggttcacggtccgtacgaacgtaaaccaacccgtgtagtagttcggtcgggtccccgccgtacgcccgtaccggaagggggaacgggccttagggaacgttgggtacctagtaagtttaagtaagtaaaagtggtagtggtaacgaactaactaagtccgtacgccgtacgtacggtacggaacggtccgtactaccgactactccacgaagaacgtaactaaacgttaccgaaaagtaaccgtacggtactaaacttaccgttaaacaaagtacgaaacgtcgaccgttaacggaaacgaacccggaggaccgtaccggtaacttattaagtttacgtagtaagttcgtttaaggggttaacgttacccgggtcccggtacccggtaggggaccgtaacgggtccgttcgaccctacccgtacttcgacccgtacgcccctaaccggtaaccccgg

SEQ ID NO: 136814 - DNA, 1013 bp, Homo sapiens
  misc_feature: GYAE6OF01EG09Q.16.39.D06.1.454.CMB.1.raw
tcagtgtactactccacgaccggtgctcgatttagtgacatctcgcagtttctttgggttttggggagaggagcccagcactgggattccgaggtgtttccattcggtgatcagcactgaacacagagactacacagtggtagtttggctgtaggtttggttttccttgctgtacttaagttttaaaaggtcgtacgtaggtggtaggtaggttgttacggttgggtaggtagttcgtagggaggtaggtccgttacggacccgggacgggggtcccggggggttaccctaggacgtaccgttccgtccgtggtcgccgtacgtccgtacggttcggttcacggtcgtacgtaacgtaaaccgtaacgtacggtacgtagtcgggttcccgggtacccgacccgtacccgggtacccggtaaccggggtaacggggggtaacggggtacggttaacggggtaacggttccggggttacgttaacggtttaaaggtttaacgttaaagggttaaaagttggtaacggttacgggtaacgtaacctacgtaaacgttcccggtaacccggtaacccggtaccggttaccgggtaacgggtaacccgggtaccgttaaccgttacccgaacccttaccgtaccgtaaccgtaaggtaaccgtaaacccgttaaacgtaacccgaaaaccggttaacggtacgggttaaactttaaaccgttaacgttaaacggtaaacgtaaccgtaaacggtaccgtaccggaaacgggtaaccgggaaaccgggtaacgggtaaaccccgtacgggtttaactttaaacgtttaagttttaacggttaagtttaacgggtttaacgggttacggttaggggttaaacccgggtttaccgggtaccccggggtaccggggtacccggggtaaccgggttaaccgggggttacccgtacccggttacccgacccggttacccgtaccgttaacccgaccccgttacccggacccggtaaacccggg

SEQ ID NO: 136815 - DNA, 783 bp, Homo sapiens
  misc_feature: GYAE6OF01BSIWJ.16.39.D06.1.454.CMB.1.raw
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccgaggcccgggggggtccctgagactctcctgtgcagcctcgtgggttcagcgtcaacgtaaccaaccacgtgatggtcggtccgccagcctccgaggggaacgggctaggaagtgggtctcgagttatagaaaatgaatggtagacacaatcgtacgccgtacgtccgtaggaacgggccgtattaccgacctacttacctaccgaagaacgaacctaacttacccgaaagaaacccgtaacgggtacgtaaacttacccgttaacgaaacgttacgaaaccgtacgtacccgttaagggaaccggtaaacccgggaacggaacccggtaaccgggtacccgtttaaacgtttaacgttttaacgtttacggttaaggtttaacgggtttaacggttacgggggtttaagggtttaaacccggttccccgggggtacccccggttacggggggtaaccccggtaaacgggggtaaccccggttcgggttaaccccgtaccccggttcccttaccccgtacgtaacccgtcccccgttacccgaaacccccgggg

SEQ ID NO: 136816 - DNA, 820 bp, Homo sapiens
  misc_feature: GYAE6OF01DI5OA.16.39.D06.1.454.CMB.1.raw
tcagtgtactactccacgaccggtgctcgatttagtgacatctcgcagttctttggggggagaggagcccagcactgggattccgaggtgtttccattcggtgatcagcactgaacacagaggactcaccatggtagttttggctgtagtttgggttttccttgctgtcttaagttttaaaaggtgtccagtgtggtaggttgtacgttgggtggagtcgtgggaggaggtcttcggacccgagggtcccgggggggtccctggacgtacctccttccgtgtcgcgacgtccttggtagggttcgacgtccgtacaacgtaaaccaaccgagtgagtcgggtcggtaccccgccgacggcccgtcggaaggggtaacgggtcgtaggtaagttcggggtaccttacgtaagttttataaggtaaaagtggtaagttaggacgtaaaccgtaactaaacgttacccgtaacccggacccgttaaccggtaccccggttaagggaaaccgggtcccgttacttaccccaaacccgtacttcccgtaaccgaacggaacgtaacctaaaccgttacccgaaaacgtaaccgtaacgggttaacttaaccgttacttaaacgaaagttaacgtaaaccgaacgtaccgtaaggaaccgaaccggaacggaaccgaacggttaccgttaattaacgtttaagttagttaaggtttaggttaggtaggttacggttacggtcccggtaccggtacgggtaccggtacgggtaccggtcggtacccgtccgttaccgtccgtacgaccgtcccacgacccgtaccgg

SEQ ID NO: 136817 - DNA, 701 bp, Homo sapiens
  misc_feature: GYAE6OF01E3ON2.16.39.D06.1.454.CMB.1.raw
  modified_base (451)..(451): a, c, t, g, unknown or other
  misc_feature (451)..(451): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccgaggcccgggggggtccctgagactctcctgtgcagcctcgtgggttcagcgtcaagtaaccaaccacgtgatggtcgggtcccgccacgccctccggaaggggaaggggcgtggaagtgggtctcgtagttatagaaatgatggtagacacaatcacgccgactccgtggaacggcctattccaacctatcctacgagacaactaactaccgaaagaccacggtanaacttctaacaaatcgaacacgcctaggaacgaaccggacgaccgacggtaccttaattacgtttaagttgttaagttaagggtttagttaggggttacggttaaaccgttcccgggggacccccgttaggggggtaccccgtaaacgggggttaaccccggttcgggttacccgaaacccccggtttcccgtaacccccgtcggaaacccgttccccccttaaacccggaaccccgggtaaacccgggg

SEQ ID NO: 136818 - DNA, 635 bp, Homo sapiens
  misc_feature: GYAE6OF01DU79Q.16.39.D06.1.454.CMB.1.raw
  modified_base (182)..(182): a, c, t, g, unknown or other
  misc_feature (182)..(182): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaggngtcagtgtgaggtgtacttggtggagtctggaggaggcttgacccaggccgggggggtccctgagactctcctgtgcagcctcgtgggttcagcgtcagtaacaaccacgtgatggtggtccgccagcctacgaggggaaggggctggaatgggtctctagttatagaaaatgatggtgacacaatctacgccgacgtccgtagaacgggccgtattccaaccgtactactaccaagaacgacctaaacttccgaaaaggtaaccgacggtaacgaaattccttaacaaagtcgaacagccctagacgaaccgaggaaccaacggtaccgttatacttagttacgtagttaggttagtgggtaggttaaccgttccgggcccggtaggggacccgaggggtaaccgtcggtacccacccgttctccctacgacgtcccgtacccgtaacccgg

SEQ ID NO: 136819 - DNA, 709 bp, Homo sapiens
  misc_feature: GYAE6OF01DKUB0.16.39.D06.1.454.CMB.1.raw
  modified_base (503)..(503): a, c, t, g, unknown or other
  misc_feature (503)..(503): n is a, c, g, or t
tcagtgtactactccacgaccggtgctcgatttagtgacatctcgcagttctttggggttttggggagaggagcccagcactgggattccgaggttgtttccattcggtgatcagcactgaacacagaggactcacatggtagttttggctgtagtttgggttttccttgctgtcttaattttaaaggtgtcagtgtgaggtgttacgttggtggagtcgtgggaggaggcttcggacccgacggggcccgggggggttccctggacgtactcctccgtgtcgcacgtccgtcgttgggttcaggtcgtacgaacgtaaaccaaccgtacgtgtagtcggtcgggtcccgccgacggcccgtaccggaagggggacggggtcgtagggaagttgggtctacgtagtttataagaaaatgagtgagacacaatccacgccgtacgtccgtaggacggcctatccactactcacagtacgactaactacaaagaacgtaacgtanaacttactaacaaatacgaaactcggacctaggaacaaccgggaacgaaccgtacggtacctttaattaagttacgttagttaaggttaggttaggttaggttagggttaccggtcccgggtacccgggtacgggacccgtaaggggtacccgttcggtaccttacccgtccttacgacccgtaccgccccgtacccgaacccggg

SEQ ID NO: 136820 - DNA, 712 bp, Homo sapiens
  misc_feature: GYAE6OF01CZYAU.16.39.D06.1.454.CMB.1.raw
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccgaggccggggggtccctgagactctcctgtgcagcctcgtgggttcagcgtcagtaaacaaccacgtgatggtggtccgccagcctccgaggggaaggggctaggaagtgggtctcgaagtttattagaaaatgagtggtagacaacaattcctaacgccgtaactccggtaggaacgggccgtattccgaacctactcctcgaagaacgacctaattcccgaaaagaacctaacgggtataaacgttccttaacgaaaatcgtaaacacgtaccttaggaacgaaacccggtaggaacctaaccgggtaccgttaattacttagtttagttaaacgttagggttagttagggttacggttaaacgttcccggggtacccccggttgggggtaaccccgtaacgggggaaccccgtttcggggtaacccacccggtttcccgtaccccgttcgaacccggtcccgtaccccgtaaaccccggg

SEQ ID NO: 136821 - DNA, 674 bp, Homo sapiens
  misc_feature: GYAE6OF01AT4E1.16.39.D06.1.454.CMB.1.raw
tcagtgtactactccacgaccggtgctcgatttagtgacatctcgcagttctttggggttttggggagaggagcccaacactgggattccgagggtgtttcccattccggtgatcagccactgaacacagaggactcaccatggagttttggctggagttgggttttccttgctgctattttaaaaggtgtccagtgtgaggtgtacttggtggagtctggaggagggcttgacccaggccgggggggtcctggagactctcctgtgcagcctcgtgggttcagcgtcaacgtaacaacccacgtgatgtcgggtccgccagccctcgagggaagggcctggaatgggtctcgagttattagaaaatgatggtgacacaatctacgccgactcggtagaacgggcctattccaaccgtattcctccagagacaagttccaaacgacacggtacaatccttaacaatgaactacgtactacggaacgaaccggaagggtaaccaccgggtacgtaacttacgtttaagttacgttaagttaacggttaggttgggttagggtagtttccccgggggcccgttacgggggcggaacggggtaaccgttcgggtacccgtacccggtaccgttacccgtaccaaccggtccccgtcccgaacccgggtaaccccggg

SEQ ID NO: 136822 - DNA, 647 bp, Homo sapiens
  misc_feature: GYAE6OF01C81XU.16.39.D06.1.454.CMB.1.raw
  modified_base (392)..(392): a, c, t, g, unknown or other
  misc_feature (392)..(392): n is a, c, g, or t
  modified_base (621)..(621): a, c, t, g, unknown or other
  misc_feature (621)..(621): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggtttccttgctgtctatttaaaggtgtccagtgtgaggtgtacttggtgagtctggaggaggcttgacccgaggccgggggggtccctggacgactctcctggtgccagcccttgtgggttcagcgtacagtaacaaccacgtgatggtcggtccgcagcctccgagggacgggctaggagtcgggtctacgagtttataggaaatgaagtcggtatacgactatcgtacgccgtactcgngacggctactcgacatctacgagacgtaactaactaccaagtaaccgagttagaacttccttaagaacttagaactacgcctagaacgtaaccgaacgacgtaccggtaccgttagtagtttatacggtttagtaaggtttggtacgggtttaagtaaccggttcccgggacccggtaggggacccggtaagggtaccccggtggtacccgtacccggtccttacccgnaccccgctacccgaaccgtacccggg

SEQ ID NO: 136823 - DNA, 674 bp, Homo sapiens
  misc_feature: GYAE6OF01A4372.16.39.D06.1.454.CMB.1.raw
  modified_base (303)..(303): a, c, t, g, unknown or other
  misc_feature (303)..(303): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaaggtgtccagtgtgaggtgtacttggtgagtctggaggaggcttgacccaggccggggggtccctgagactctcctgtgcagcctgtggtcagcgtacagtaacaccacgtgatggtcggtccncgagcctcgagggagggctggaatgggtctacagttatagaaagtgatggtagacactaagtctacgccgtacgtccgtaggaacgggtccagttccacatccgtaccgaagacgaacctaagttaccccaaaggaactacgggacgtaacttcgttaacaaagtgaaacctagacccgtagaacgaaacccggtacggaccttaccgggaccgttaagttagttaacgttgtaaggtacgttttggtacggttaaggtaaaccgttccccggggcccgttaggggggaccccccgtaaagggggtaacccctttggaaccccgttaccgttccgtccgtaccgtacgtcccccggtaaccctaaccgggg

SEQ ID NO: 136824 - DNA, 875 bp, Homo sapiens
  misc_feature: GYAE6OF01ECMC6.16.39.D06.1.454.CMB.1.raw
  modified_base (314)..(314): a, c, t, g, unknown or other
  misc_feature (314)..(314): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtcgtggaggaggcttcgacccgaggccggggggtccctgagactctcctgtgcagcctcgtgggttcagcgtcaagtaaccaaccgacgtgatggtcgggtccnccacgcccgtccggaggggaacgggggctgggaagtggggtctgtaagttagtagaaaagtgagtggtagaacaactaatccgtaccggcccgtaaccgttccggtaggaacggggtccctattccgaaccctactacctaccgaagtaacgaactaacttaccccgaaaagtaaacccgtaacgggtaacgtaaactttacccgtttaactaaaagttaaccggaaaccgtaaccggtacccgtaaggaaacccggtaaacccggggaacggtaaacccgggtaaccgggtacccggtttaaaacgttttaagtttaaggttttaacggttaacggtttaaggggtttttaaggttaacgggggtttaacggggttttaaaacccggtttccccgggggggtaccccccgggttaacgggggggtaaccccgggtaaacccgggggggttaaccccgggttaacgggggtttacccccgtaaacccccgggttttcccgttaacccccggttacccggtaaaccggttccccccgttaaaccccggaaaaccccccgggg

SEQ ID NO: 136825 - DNA, 542 bp, Homo sapiens
  misc_feature: GYAE6OF01C8UQC.16.39.D06.1.454.CMB.1.raw
  modified_base (300)..(300): a, c, t, g, unknown or other
  misc_feature (300)..(300): n is a, c, g, or t
  modified_base (426)..(426): a, c, t, g, unknown or other
  misc_feature (426)..(426): n is a, c, g, or t
  modified_base (433)..(433): a, c, t, g, unknown or other
  misc_feature (433)..(433): n is a, c, g, or t
  modified_base (437)..(437): a, c, t, g, unknown or other
  misc_feature (437)..(437): n is a, c, g, or t
  modified_base (441)..(441): a, c, t, g, unknown or other
  misc_feature (441)..(441): n is a, c, g, or t
  modified_base (476)..(476): a, c, t, g, unknown or other
  misc_feature (476)..(476): n is a, c, g, or t
  modified_base (493)..(493): a, c, t, g, unknown or other
  misc_feature (493)..(493): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccagccgggggggtccctgagactctcctgtgcagcctctgggttcagcgtcagtaacaaccacgtgatgtgggtccnccacgcctccgaggggaagggctggaatgggtctcagttattgaaaatgagtggtgacacaatctacgccgactccgtgaagggccattcacctatcctaccagacacaattaccaagaacaggtnaatctanaatnaacngctgacgaccgagacacgctatatatgtatagttntggtgtatccgggcccngggccgaggaccgtgtaccaccgtctcctcagtccctcgaccgaaccgg

SEQ ID NO: 136826 - DNA, 836 bp, Homo sapiens
  misc_feature: GYAE6OF01BGID7.16.39.D06.1.454.CMB.1.raw
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccaggccggggggtcctgagactctcctgtgcacgcctctggacttcacctttagtcgccctagtcgccagtgacgtccgtcggggtcccgccgaacggtccgtaccggacggggaaggggtccttaaggaaacgttggggtctaacgtaaacggttactaccgaaacgaaaggacgtaaggttaacggttaacggttacccgacgtaacgttacgggtaaccggaccgtaacgtaacccggttaccccggttaacgggtaaaccgggggtttccccttttaaccgaacccgttaacgttccctacccggaacggttaaacgtaaacccttaaaacgtttacccgaaaaacggtaaccgtaaccggtcctttaacgggtttaatttaccgaacgtaaaacgttcgaaacttaccggtagtacgaacggtacgtaacgggtaacggaacccgacggtaccctaagttaacgttaacgttaccggttgggttaaccggaacgggtaaccggggttaacgggggttacgtttacggggggtacggtaccccgggtttagggaccgtttaccgggttaaacttacgtttaccgggaaaccggtttcccggggg

SEQ ID NO: 136827 - DNA, 688 bp, Homo sapiens
  misc_feature: GYAE6OF01AH20J.16.39.D06.1.454.CMB.1.raw
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccagccggggggtccctgagactctcctgtgcagcctctgggttcagcgtcagtaacaaccacgtgatgtggtccgccagcctccagggaaggggctggaatgggtctcagttatgaaaatgatggtgacacaatctacgccgactccgtggaaggccgagttcaccatcctaccagagacattccgaaagacacggtagaatcgttacaaattgaaactacgcctaggacaaacgtacgggaacaccgggaccgttaagttatttacgttagttaacgttaacgggttattaggggttacgggtttaaaggttcccgggggtacccccgttaggggggggtaccccctaaagggggggttaaaccccggtttcggggttaccccggtacccccgggtttaccttccccccggttaccaacccgggtccccccgttaacccgaaaccccggtaaaaccccgggggg

SEQ ID NO: 136828 - DNA, 709 bp, Homo sapiens
  misc_feature: GYAE6OF01BTZWJ.16.39.D06.1.454.CMB.1.raw
  modified_base (377)..(377): a, c, t, g, unknown or other
  misc_feature (377)..(377): n is a, c, g, or t
  modified_base (499)..(499): a, c, t, g, unknown or other
  misc_feature (499)..(499): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctggagttgggttttccttgctgcttattttaaaaggtgtccagtgtgaggtgtacttggtggtagtctggaggaggcttgacccgaggccggggggtccctgagactctcctgtgcagtccgtcgtggttcagtcgtacagtaacaaccgacgtgatggtacgggtccgccgagcctaccgaggggacgggctaggagtgggtctcgtagttatagaaatgtatggtanacacatctacgccgactcgaggacggtctacttaccgactactcctaccgaagtactaacctaacgttacccgaaacggaacgtacgggtataaacttccttaagaaacgttacgaaacccncggtaaccctgggaaacgtaacccgggaggtaacccgacggttaccggttaattacgtttaagttacggtaagttttaagggtttgtacggggttaacgttaaacgtttcccccggggaacccggttggggaaccctaaggggggttacccgttggtaacccgcccggtttacgacccttaccggaccgtccccgtacccggaaaccggg

SEQ ID NO: 136829 - DNA, 633 bp, Homo sapiens
  misc_feature: GYAE6OF01E00WN.16.39.D06.1.454.CMB.1.raw
  modified_base (121)..(121): a, c, t, g, unknown or other
  misc_feature (121)..(121): n is a, c, g, or t
  modified_base (194)..(194): a, c, t, g, unknown or other
  misc_feature (194)..(194): n is a, c, g, or t
  modified_base (217)..(217): a, c, t, g, unknown or other
  misc_feature (217)..(217): n is a, c, g, or t
  modified_base (311)..(311): a, c, t, g, unknown or other
  misc_feature (311)..(311): n is a, c, g, or t
  modified_base (342)..(342): a, c, t, g, unknown or other
  misc_feature (342)..(342): n is a, c, g, or t
  modified_base (344)..(344): a, c, t, g, unknown or other
  misc_feature (344)..(344): n is a, c, g, or t
  modified_base (353)..(353): a, c, t, g, unknown or other
  misc_feature (353)..(353): n is a, c, g, or t
  modified_base (609)..(609): a, c, t, g, unknown or other
  misc_feature (609)..(609): n is a, c, g, or t
tcagtgtactactccacgaccggtgctcgatttagtgacatctcgcagttctttggggggagaggagcccagcactgggattccgaggtgtttccattcggtgatcagcactgaacacagnggactcaccatggagttttggctgagttgggttttccttgctgcttattttaaaaggtgtccagtgtgaggtntacgtttggtggagtctggaggnggcttgacccgaggcccgggggggtccctgagacctctccctgtcgcgacgcctcgttcgggttcacggcgtcacggtaaccaaccgacgtganggtcgggtccgccagccctcgaggggacggngnggatggctnagttatagaaatgacgtggtcgacacatccgtacgccgactccggtaggaacggctacgtcccaaccgtatcctaccagaacgtactacttaccaagtaaccgagtagtaactctacaaatcgaaactcgacgtaggaccaaccggagacggaccgtacctattacgttattagtagttaggtagttcggtaggttaacggtccggacccgggtcggaccggtagggacccggtagtaccgtcccgtactccgacngcccctaccggacccgtaacccgg

SEQ ID NO: 136830 - DNA, 660 bp, Homo sapiens
  misc_feature: GYAE6OF01DPSHC.16.39.D06.1.454.CMB.1.raw
  modified_base (180)..(180): a, c, t, g, unknown or other
  misc_feature (180)..(180): n is a, c, g, or t
  modified_base (405)..(405): a, c, t, g, unknown or other
  misc_feature (405)..(405): n is a, c, g, or t
  modified_base (641)..(641): a, c, t, g, unknown or other
  misc_feature (641)..(641): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttggttttcctgctgctattttaaaggngtcagtgtgaggtgtacttggtggagtctggaggaggcttgacccgaggcccgggggggtccctggagacctccgtccgtgtgcacgcctcgtgggttcagtcgtcaacgtaaccaaccacgtgagtgtcgggcccgccagccctccggaaggggaacggggcgtaggaagtgggtctcgtagtttataagaaatgatggtagacacatcgaccgccgactccgngaacggctatcacatcacgaagacactaactacgaacgaactacggataatcttaacaaatacgaacgcgaccgtagaaccgaaccggacggaacccgtaccgggtaacctttaagttacgtttagttagtttaacgttaggttaaggtaggttacggtaccggttcccgggtaccccggtacggggcccgtaacggggtacccgtcggtaccctacccgttccgtcctaccgccnccccgtcccgaaacccggg

SEQ ID NO: 136831 - DNA, 840 bp, Homo sapiens
  misc_feature: GYAE6OF01BQ8S8.16.39.D06.1.454.CMB.1.raw
tcagtgtactactccacgaccggtgctcgatttagtgacatctcgcagttcgtttggggggagaggagcccagcactgggattccgaggtgtttccattcggtgatcagcactgaacacagaggactcaccagtggtagttttggctgtagtttgggttttccttgctgtacttaagttttaaaaggtgtccagtgtgtaggtgttacgttggtggagtcgtgggaggaggcgttacgacccgagggtcccggggggtcctggacgtactccgtccgtgtcgcgacgtccgtcgttcggtacgacggtccgtacgaacgtaaaccgaaccgtacggtacgtagttcggtccgggtcccgaccgtaccggtacccgtaccgggaagggggtaacgggtacgttagggtaacggttcgggtaccttacggtaagttttaagttaaacggttaaaaagttggtaacggttcggtaacggtaaacctaacgtaacttacccggtaacccgtacccggtaaccgttccggttaacgggaaccggtacccgtaacgttaccctaacctaccgttaccgaaccgtaacggtaacgtaaccctaaacgttaacccgaaaagtaacgtaacggtaataaaccttactaaacgaaagtacgaaccgtacgtaaccgtaggaaacccgaaccgggaacgtaccgtaaccggttacttaattaacgtttaacgttagttaacgttaggtagtcgggtaacgttaccgggtccccggtaccgggtacgggaccgtaacggggtccttcggcctaccgtcctaccgacacccgtaccctacggaccgtacccgg

SEQ ID NO: 136832 - DNA, 753 bp, Homo sapiens
  misc_feature: GYAE6OF01E1PKR.16.39.D06.1.454.CMB.1.raw
tcagtgtactactccacgaccggtgctcgatttagtgacatctcgcagttctttgggttttgggggagaggagcccagcactgggattccgaggtgtttccattcggtgatcagcactgaacacagagactcaccatggagtttggctgagttgggttttccttgctgctattttaaaaggtgtccagtgtgaggtgtacttggtggagtctgggaggaggcttgacccgaggcccgggggggtccctggagactctcctgtgcagcctgtggttcagcgtcacgtaaccaaccacgtgatggtcgggtccgccagcctaccggagggaaggggcgtggtaagtggggtctcgtagttagttagaaaagtgagtggtagaacacaactcgacgccgacgtccggtaggaacgggtccgtacttaccacccgtactacccgtaccgaaggtaaccgaacctaaactttaacccgaaacggtaaaccgtaaccgggtaataacgttacccttaacgaaaacgtacggaaacctacggtacccgtaacggaaccggaaccggaacggtaacccgaaccggtaccggttaagttaacgtttaagttgttaaacgttacgggtttaagtagggttacgggttaaccggttccccggggtaccccggtacgggggtacccggtaacgggggtaacccggtcggttacccgtacccgtcccgtacccttaccgtacccggtccctaccccggtaacccgg

SEQ ID NO: 136833 - DNA, 894 bp, Homo sapiens
  misc_feature: GYAE6OF01BRPA7.16.39.D06.1.454.CMB.1.raw
tcagtgtactactccacgaccggtgctcgatttagtgacatctcgcagttctttggggttttgggggagaggagcccagcactgggattccgaggtgtttccattcggtgatcagcactgaacacagaggactcacatggtagttttggctgtagtttgggttttccttgctgtacttaagttttaaaaggtgtccaggtggtggaggtgttacgttgggtggagtcgtgggagggaggtcttacggaccccgacggggcccgggggggttaccctggtacgaccttccgttcccgtggttcgaccgacgtccccgttcggttcggggtttaccgacggtccggttaccgaaacggttaaaacccaacccggtaaccggtaggtacggttcgggttaccggggtccccgaccgaaccggtccccggtaccgggaagggggggtaacggggtccggtaggggtaacggttcggggttcctacggttaaggtttaagttaaaggtaaaagttggaggttagggtacaaacgtaactaaacgtacccgtaaccggtcccggtaaccgttacgggtaacggaaccggggtacccgtaaacttacccaaccgtacgtaccctaaccgaaggtacgtaaacctaacgttaacccgaaaacggtaacgtaacgggtaataactttactaactaaagtacgaaacgacgtaccgaacggaaacggaccggacgggtaaccctaaccgggtacttaattaacgtttagttaggttaagtttaggtagttagggttaccggttaaccgggttccccgggccggttaggggacccgtacggggtacccgttcggtacccgttacccggtctacccgaccgtccgtccccgtacccggtaaaccgg

SEQ ID NO: 136834 - DNA, 797 bp, Homo sapiens
  misc_feature: GYAE6OF01E0YPO.16.39.D06.1.454.CMB.1.raw
  modified_base (592)..(592): a, c, t, g, unknown or other
  misc_feature (592)..(592): n is a, c, g, or t
tcagtgtactactccacgaccggtgctcgatttagtgacatctcgcagttcgtttgggttttggggagaggagcccagcactgggattccgaggtgttccattcggtgatcagtcactgaacacagagactcaccatggtagtttggctgtagtttcggttttcctgctgtcttaagtttaaacggtgtctaggtgtggtaggtgttacgttggtggagtcgtagggacggacggtccgttacgacccggacggggcccgggggggtcctaggtacggtaccttcgttcccgtggtcgaccgtacgtccgttcggttacggttacaacggtccgtaacgtaacgtaaccctaaccggtacggtacgtacggttcgggtaccgggtcccacccggtacgtcccggtaccgggaaggggtacggggcctagggaacggttcgggtctacgtagttactaagaacgtggtagttggacaacgtacacgttcggaaccgccgtaacggtccgtaacggacggtccctactaccactcgtaccctagacgaacgtaacctaacgtaacgagtaaccgtagttaactacttacgtaanagtaacgacacgtaacgacgaacggaaccgaggaccgtacggtacctaagttactttaggttacgttacggtaggttacggtacggttacggtttaaccgggcccgggttacccgggtaaggggtaccggtaaccggtaccggggttaccgacccgttcccggttacctaccgtaccgtaccccgtccctacggtaaacccccgg

SEQ ID NO: 136835 - DNA, 847 bp, Homo sapiens
  misc_feature: GYAE6OF01CWU7E.16.39.D06.1.454.CMB.1.raw
tcagtgtactactccacgaccggtgctcgatttagtgacatctcgcagttctttgggttttggggagaggagcccagcactgggattccgaggtgtttccattcggtgatcagcactgaacacagaggactcaccatggtagtttggctgtagtttggttttcctgctgtacttaagtttttaaaaggtgtaccgagttgtggtaggtgttacgtttggtggagtcgtggaggaggtccttcggacccgacggggtcccggggggtccctaggacgtaccttcctccgtgtcgcctacgtccgttcggtgggttccacggtccgttacgaaacgttaaacccaaccgtacgtagtagttcggtcgggtcccgccgtaaccgccgtaccggaaggggaaggtccgtaggtaagtcgggtactacgttaagtttataaagtaaactggtacgtggtaacaacgtaactaacgtccgtaaccggaccgtaacccgtcggtaacggtaacggtccgttaactccgaacctacgtcctaacgaacggaacctaacgttaaaccttaccgaaaacgaaccggttacgtaagtaaaccttactaaacgtaactaacggtaacaaccgttacgaacggaaacgtaaacccgggtacgaaacccgtaccggttaaccttaaagtttaagttaacgtttaggttaacgtttaggtttaacgggttagggttaacccggtaacgggttccccgggtacgggtaccggggtaacccgtaaccggggttcccgtaccggttccccgtacccggttaccttacccgcccgaacccgtccccgtaaccccgtaaacccgggg

SEQ ID NO: 136836 - DNA, 596 bp, Homo sapiens
  misc_feature: GYAE6OF01BXL16.16.39.D06.1.454.CMB.1.raw
  modified_base (307)..(307): a, c, t, g, unknown or other
  misc_feature (307)..(307): n is a, c, g, or t
  modified_base (365)..(365): a, c, t, g, unknown or other
  misc_feature (365)..(365): n is a, c, g, or t
  modified_base (444)..(444): a, c, t, g, unknown or other
  misc_feature (444)..(444): n is a, c, g, or t
  modified_base (463)..(463): a, c, t, g, unknown or other
  misc_feature (463)..(463): n is a, c, g, or t
  modified_base (480)..(480): a, c, t, g, unknown or other
  misc_feature (480)..(480): n is a, c, g, or t
  modified_base (506)..(506): a, c, t, g, unknown or other
  misc_feature (506)..(506): n is a, c, g, or t
  modified_base (567)..(567): a, c, t, g, unknown or other
  misc_feature (567)..(567): n is a, c, g, or t
tcagtgtactactccacgaccggtgctcgatttagtgacatctcgcagttctttgggggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctgggaggaggcttgacccgaggccgggggggtccctgacgactctcctgtgcagcctcgtgggttcagcgtcagtaacaaccacgtgagtgtgggtccnccacgccctcgaggggaacgggcgtggatgggtctcgtagttatagaaatgatggtanacacaatctacgccgactccgtggaacggctactccactactcctcagacgaacctaacttaccaaagtaccagggtanaacttactacaaatgaacngtcagacgaccgagacncggtactatattagtatagtagttangggtaggttaacgttccgggcccgtgggggaccacgggaccggttcgtacccacggttccnccctacgaccgcctacccgccggaaccgg

SEQ ID NO: 136837 - DNA, 738 bp, Homo sapiens
  misc_feature: GYAE6OF01EF7MI.16.39.D06.1.454.CMB.1.raw
  modified_base (378)..(378): a, c, t, g, unknown or other
  misc_feature (378)..(378): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccgaggccgggggggtccctgagactctcctgtgcagcctctggttcagcgtcagtaacaaccacgtgatggtcggtccgccaggccctccgaaggggaaggggcgtaggaagttggggtctcgagtttatagaaaaatgtaagtggtagaacaanaatccgtaacgcccgtactcccggtaggaacggggcctactttccgaacctagttcctaccgaaggaacgtaactaaacctttaccccaaaagtaaaccgtaacgggtagtaaaccttaccgtttaacaaaacgttacggaaaccacggtacccgtaaggaaacggtaaaccccggaagggtaacccgaaccgggtacccggttaattacgtttaatttggttaaagtttaagggttagtaggggtttacggtaaacggttcccgggccccggttagggggacccgtaagggggtaacccgttgggtaccccacccgttcctacccgacgtaccgtcccctacccgaaccgtaacccggg

SEQ ID NO: 136838 - DNA, 1100 bp, Homo sapiens
  misc_feature: GYAE6OF01AJVKD.16.39.D06.1.454.CMB.1.raw
tcagtgtactactccacgaccggtgctcgatttagtgacatctcgcagttctttggggttttgggggtaggagggagcccagcactgggattccgaggtgtttccattcggtgatcagcactgaacacagaggactcacatggtagtttggctgtagtttgggtttccttgctgcttaagtttaaaggtgtcagtgtggaggtgtacgttgggtggtagtcggtgggagggacggtcttacggacccgacggggtcccggggggggttccctggaagtacctcctccgtgtcgcgacgtcctcgttgggtcacggtcgtacaacgtaaaccacgtacggtggtagtcgggtcggtacccggccgaccgtacccgtaccgggaaggggggaacggggtcgtaggggtaacgttcgggtacgttacgtaagggtttaacttaagggtaaaacgttagggtaaggttacggtaacggtaaacgtaaccgttaaaccgtaaccgggtaaccccggtacccggtacccgggttaaccggggttaacggggtaaaccccgggggtaccgttaactttacccccgaaacccgttaaccgtacccttaccggggaaagtacccggtaaaaccggtttaaaccttaacccggaaaaaccggggttaaacccggttaagggttaaccccttaaaagtttaaccccgttaaaaccgttaaaccggtaaacggtaaacccggtaacggttaaccccgggtaaacgggtaaaaccggggtaaaacccggtaacccgggggtaaaccgggtaacccgggggtaaccccgttttaaattttaaccgggtttaaagggttttaaacccgggtttaaaggggttttaacgggtttaaaccggggttttaacggggttccggggttttaaaaaccccgggttcccccgggggggttaaaccccgggggttaccgggggggtaaccccgggtaaacccggggggttaaacccgggttacccccgggggtttaacccaccccgggggtttaacccttacccgggtaaaacccctcccgggggttaacccccccttaaacccccgggggggaaacccccgg

SEQ ID NO: 136839 - DNA, 1165 bp, Homo sapiens
  misc_feature: GYAE6OF01A47MQ.16.39.D06.1.454.CMB.1.raw
tcagtgtactactccacgaccggtgctcgatttagtgacatctcgcagttctttggggggagaggagcccagcactgggattccgaggtgtttccattcggtgatcagcactgaacacagaggactcaccatggtagttttggctgtagtttgggtttttccttgctgtacttaagttttaaaaggtgtcctagtgtgaggtgtacgttggtggagtcgtggaggaggcgttcgacccgacggggtcccggggggtccctggacgtaccttcgtccgtggtcgcgacgtcccttcggttcgggttccgacggtccgtacgtaaaccgttaaaccgaaacccgtacggttaggtacgttcgggttccggggtaccccggacccgtaccggtccccggtaaccggggaaggggggtaaccgggggtaccggttaacggggtaacggttcggggttaccttacggttaaggttttaagttaaaaggtaaaagttggtaacggttagggtaaccgaaaccgttaaacgtaaccggttaacccgtaaccggtaccccgggttaaccgttacccggggtaaccggggaaacccggggtacccgttaaccgttaccccgtaaacccgttaccgttcccgtaaacccggaacggtaaaccgtaaaccgtttaaaacccggtttaacccggaaaaacggtaaaacccggggttaacggttaaacggttaaaacccgttttaaccctttaaaacggaaaaaccggttaccggtaaaaacccggtcccgggttaaaacccggttaggggaaaaacccccgtaaaccgggaaacggggttaaacccccgggtaaccggttttaacccggtttaaaatttttaacgggttttaaccgtttaaggggttttaaaaggtttttaacggggtttagggttttaaccgggggtttaaaacccgggtttaaaccccggggtttccccccggggggtaacccccggggtttaagggggaaaccccccgggggttttaaaaccgggggtaccccgggtttttaaccgggggttaaccccccgttaccccccgtttttacccgggtaacccccctttaaccccgggaaccccgttttaccccccgggtaaacccccgggtaacccccccgggggttaaaccccggg

SEQ ID NO: 136840 - DNA, 581 bp, Homo sapiens
  misc_feature: GYAE6OF01B6RJ2.16.39.D06.1.454.CMB.1.raw
  modified_base (260)..(260): a, c, t, g, unknown or other
  misc_feature (260)..(260): n is a, c, g, or t
  modified_base (435)..(435): a, c, t, g, unknown or other
  misc_feature (435)..(435): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggtttccttgctgctattttaaaaggtgtccagtgtgaggtgtacttggtggagtctggaggaggcttgacccgaggccggggggtcctgagactctcctgtgcagcctntgggttcagcgtcagtaacaaccacgtgatgtcgggtccgccagcctaccgagggaagggctaggaatgggtctcagttatagaaatgatggtagacaacaatctacgccgactcggtagaacgggcatcgacatcaccagtaagactaataccaagaacacggtagaatactanaaatacgaacacgactagaacgaacgagacacggaccgttatattattagtaattaggtagtaggtggtaacgtccgggcccgtggggacctacgggaccgtggtaccaccggttcctccgacacgccctcgaaccggtaacccgg

SEQ ID NO: 136841 - DNA, 1086 bp, Homo sapiens
  misc_feature: GYAE6OF01DQKYT.16.39.D06.1.454.CMB.1.raw
tcagtgtactactccacgaccggtgctcgatttagtgacatctcgcagttctttgggttttggggagaggagcccagcactgggattccgaggtgtttccattcggtgatcagcactgaacacagaggactcaccatggtagttttggctgtagtttgggttttccttgctgtcttaattttaaaggtgtaccagtgtgaggtgttacgttggtggagtcgtgggaggaggtcttcgacccgacggggcccggggggttccctaggacgtacctccgtccgtggtacgcgacgtcccgttcggttgggtttaccacggtcgttaccgaaacggttaaacccgaaacccgtacggtaggtagttgggttaccggggtccccggacccgtaacggtccccgttaccgggaaggggggtaaacgggggcgttacggggtaaaggttccgggggtttaccttaccgtttaaggttttaacgttaaaggtaaaaacgttgggtaaggtttcggtaacggtaacctaaaccggttaaacgtttacccggttaaaccccggaacccgttaacccggtttacccgggtaaacggggaacgggggtcccccgtttaaagtttaccccgtaaaccccgttaaccgtttacccgtaaccccgggtaaaggtaaacccgtaaaacccgttaaaaccgttttaaccccgaaaaacccgggttaaaccgttaaaccggggttaacgtttaaaactttacccgtttaaaccaaaagttaacccggtaaaccgaacggtaacccggtaacggaaaccggtaaacccgggaaccgggtaaccgaacccgggtttaaacctttaaaggtttaactttacggtttaaggtttaacggtttaaggggttttacggttacggggtttaaacgggtttaaaccccgggtttcccggggggtaccccccggttaaagggggggtacccccggttaaaacgggggttacccccggggtttaccgggttaacccgttacccccgggtttacccgtttaccccgtacgggttaaaccccgcccccgttaaccccgggtaaaaccccccgggg

SEQ ID NO: 136842 - DNA, 833 bp, Homo sapiens
  misc_feature: GYAE6OF01CR5X7.16.39.D06.1.454.CMB.1.raw
  modified_base (623)..(623): a, c, t, g, unknown or other
  misc_feature (623)..(623): n is a, c, g, or t
tcagtgtactactccacgaccggtgctcgatttagtgacatctcgctaggttctttgggttttggggagaggagcccagcactgggattccgaggtgtttccattcggtcgatcagcactgaacacagaggactcaccatggagttttggctgagttggtttccttgctgcttatttaaaggtgtaccagtgtcgaggtgttacgttggtggagtctggaggaggcttcgacccgagggcccggggggttccctggacgtaccttcgtcccgtggtcgccgacgtccttacggttcggggtttacacggtaccgttacgtaacggtaaaccaacccgtaacggtacgtaaaggttcggttaccggggtaccccgaccccgaacggtcccccgttaccgggtaagggggacggggtaccgttagggaaacggtttcggggtacctacggttaaggtttaacgttaagaaagttaggaggttggtacgaactaacgtaacgttccgtaaccgccggtacgtaccggaggtaaccggtaccgtagttacccaccgtactccgtaccgaagacgtacctaactaccgaagaacgttacgtagaccttacttacgaaagtcgaaccgngtacccgtaagaacccggaacgacggtaaccgaccggtaaggttaaccttaagttaagtttacgtaagtttaggttaaggttcggggttaagtaacccggtttcccggggacccgtacggggtaaccccgaggggtaaccccggtttcgaaccccgtttaccccggtccgttaccgttaccgcccgtaccccgtcccggaaaaccccggg

SEQ ID NO: 136843 - DNA, 732 bp, Homo sapiens
  misc_feature: GYAE6OF01A96EK.16.39.D06.1.454.CMB.1.raw
  modified_base (268)..(268): a, c, t, g, unknown or other
  misc_feature (268)..(268): n is a, c, g, or t
  modified_base (710)..(710): a, c, t, g, unknown or other
  misc_feature (710)..(710): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgtagttgggttttccttgctgacttaattttaaaaggtgtccagtgtgaggtgtacttggtggagtcgtggaggaggcttcgacccgagggcccgggggtcctgacgactctccgtgtncagcctcgtggttcaggtcgtcgaacgtaaccaaccgacggtgtacgtggtcgggtaccccgccgacggccgtaccggaagggggtaacggggtccgtagggtaagttcgggttcttacgtaagtttagttaagaaaagtgaagtggtacaacgacaaactcgaccgccgaccgtcggtacggaaccgggctacttccacctactaccgtaccgaagaacgacgtaactaccgaaacgtaacgtacggtaataacgtacttaactaaagtaccgaacgacggtacccgtaggtaaaccggaaccggaaggtaaccgacgggtacccgttaagttaacgtttagttaaggttaaggttacgtttaggtagggttaggttaccggtcccgggtccggtcggggaccggtacgggtacgtcggtacctacccgtcctacccgacncccgtcccgccctaaacccggg

SEQ ID NO: 136844 - DNA, 935 bp, Homo sapiens
  misc_feature: GYAE6OF01DC82F.16.39.D06.1.454.CMB.1.raw
tcagtgtactactccacgaccggtgctcgatttagtgacatctcgcagttctttgggttttggggagaggagcccagcactgggattccgaggtgttccattcggtgatcagcactgaacacagaggactcaccagtggtagtttggctggtagtttgggttttccttgctgtacttattttaaaaggtgtccagtagtgaggtgttacttggtggagtcgtgggaggaggtccttggacccgacggtcccgggggggtccctggacgtaccttccgtccgtggtacgcgtacggtccgttcgttggggttccacggtaccgtacgtaaacgtaaaccgaaccgtacggtagtacgttacgggtcgggtaccgaccgtacggtcccggtaccggacgggggtaacggggccgtagggtaacggtcgggttacttactacggtttaagtagtaaagttcggaagtgggtactaaccgtaactaacgtaccgtaccggacccgttacgtaccgggtacggtaacggggtacctacgttaccgtaacgtacttaccgtaaccgaagtaacgtaaccctaaagttaccccgaaaaagtcccgtaaacggggttactaacgtttacccctaaagtaaacggttaccgaaacggaaccgggttacctaacggggaaaccggtaaccgggtaaccgtaccgtaaccggggttaccctttagtttaaacggttactttaaggggttaaccgttaaggggttttaccggaaaggggttttcccggttaaacgggtccccgggggttaacccccggtaggggggtaacccggttaacggggggggttaaacccctttcggggtaccccccgtaaacccgggttttcccaaaccccggggttacccggcccgtaaaccccggttccccggtaaaaacccccggggg

SEQ ID NO: 136845 - DNA, 743 bp, Homo sapiens
  misc_feature: GYAE6OF01DLSFI.16.39.D06.1.454.CMB.1.raw
tcagtgtactactccacgaccggtgctcgatttagtgacatctcgcagttcgtttggggggagaggagcccagcactgggattccgaggtgtttccattcggtgatcagcactgaacacagaggactcacatggtagtttgctgtagttgggttttcctgctgtacttaagttttaaaagtgtacctagtgtggaggttgttacgttgggtggagttcgtgggagggtacggtcttcggaccccgacgggtcccgggggggtccctggacgtactccttccgtgtcgcacgtccgttcgtcggttcacgtccggtactaacggtaaaccaaccgtaacggtgtagtggtcgggtcccgaccacggtccctaccggaaggggaacggggtctaggtaagttcgggtctagtagtttaatagaaaagtgagtggtacacaatactaccgtacgcccgtacgtccggaggaacggcgtacttacacctatcctaccgaagtaccaactaacgtaaccgaaagacgtaacggtataactacgttaacaaataggaaccacgactacggaacgaacggaacgaacgaccgggtacttaagttacgtttagtagtagtttaacggtagtacggttacggttaccggtcccggttaccggacggggtaccggtaacgggtacccgttcggaccctacccggttaccctaccgttaccgaccgtacccctaaccggaacggttacccccgg

SEQ ID NO: 136846 - DNA, 755 bp, Homo sapiens
  misc_feature: GYAE6OF01BGUTM.16.39.D06.1.454.CMB.1.raw
tcagtgtactactccacgaccggtgctcgatttagtgacatctcgcagttctttggggttttggggagaggagcccagcactgggattccgaggtgtttccattcggtgatcagcactgaacacagaggactcaccatggagttttggctgtagttgggttttccttgctgctattttaaaaggtgtccagtgtgaggtgtacgttggtgagtcgtgggaggaggcttcgacccgacggccgggggggtccctgagacctctcctgtgcacgcctcgtggtcaggcgtcaagtaaccaaccgacgtagagtggtcggggtcccgaccacgtcccctacggagggggaaggggtccgtagggtaagtcgggtctcgtagtttattaaggaaaatggtagtcggtagaacctaacgtaatcccgtacgacccgaccgtaccggtagggaaccggggcccgtaacgtttcccgaacctactccgtaccgacgtaacgtaacttaaacgtaccccgtaaaacgaccggtaaaaaaacgggttcgaaactttaaccttacaaacgtacgaaacgacgtaccgtacggaaacgaaccggaaccggtaacggaaccggtaccgttaagttaactttagtttagtagttaggttaagtgggtaggtaccgttccggggtacccggtcggggaccggtacgggtaccggttcgtacccgtacccggttaccgtcctaccggaccgtcccgacccgtaacccggg

SEQ ID NO: 136847 - DNA, 1025 bp, Homo sapiens
  misc_feature: GYAE6OF01BV4LZ.16.39.D06.1.454.CMB.1.raw
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgcttaagttttaaaaggtgtccagtgtgaggttgttacgttggtggtagtcgtgggaggaggtcttcggacccgacgggcccgggggggtccctggacgaccgtcctccgtgtcgcacgccgttcgttcgggtacgagtcgtctaacgtaaaccaaccgacgtagacgttcggtacggtcccgccgacgcccgtaccggaaggggacgggccgtagggtaacgtgggttcctagtagtttaagttagtaaaacgttgtaagttcgggtaacgaacctaacgtaacttaccgtaacccggtaccccggtaaccgttaccccgggtaaggggaaccgggttaccccgtaaacgtttaccctaacccgttaacgttacccgtacccgtaacgggaacgttaaaccctaaacgttaaaccccggaaaacggtaaacccgggttacggttaaaccgttaaacctttacgtttaaaaccgtaaaacgttaacccggttaaaccgaacccggggttaccccgtaaacggggaaaaccgtaaccccgggggaaacccgggtaaacccgggtaaacccggggtttacccgttttaaaacgtttaacggtttttaaacggtttttaacgggttaaaacggttttagggggttttaaaccgttaggggggtttaaaccggttttaacccggggtttccccgggggtaccccgggttacccggggggggtaaccccgggttaaagggggacccccgggttttaacgggtaccccccgttaacccggggtttaccccgttacccccggttaacccggtaaacccccggtttacccccgttaaaccccgggaaacccccggttaaacccccggggg

SEQ ID NO: 136848 - DNA, 1011 bp, Homo sapiens
  misc_feature: GYAE6OF01EQXPQ.16.39.D06.1.454.CMB.1.raw
  modified_base (105)..(105): a, c, t, g, unknown or other
  misc_feature (105)..(105): n is a, c, g, or t
  modified_base (744)..(744): a, c, t, g, unknown or other
  misc_feature (744)..(744): n is a, c, g, or t
tcagtgtactactccacgaccggtgctcgatttagtgacatctcgcagttcttttggggggagaggagcccagcactgggattccgaggtgtttccagtttcggngatcagcactgaacacagaggacctcaccatggtagttttggctgtaggttttcgggttttccttgctgtacttaagtttttaaaaggtctaccgtagtggtaggaggttagttacgtttgggtggtagtcggtgggaggaggtcttaccgacccggacgggtcccggggggtccctagacgtacttccgtccgtggtacgccgtacgtccgttcgtggggttccgacggtacgttacgaaccgtaaccgaaccgtaacggtacggtcggtaccggtccgggtacccgccccgtaccgaccggttaccccggacgggggtaaacggggtgtaacgggtaacgttccggggatttaccgtacgtaaagtttagtttaacgtaaaaggcgaacgttcggtagtaccgtaacgaaacgttacccgttaaaccgtcccggaaaacggttcccccggtaacggttaaaccgggggcccccgaaagttttccccgaaaccccgaaacgtacccgttaccccaacggtaaccggtaaacccgaaaaccgttttaacccccggtaaaacgggtaaaaccctaaacccggggttttaccggaaaacgtttaacccgttaacccgtaaaacgttaaccggttaaaaccncgggtaaccccgtaaccggtaacgggtaaacccgggaaacggggtaaacccgtaaacccggggtaacccggttaacgttaaacgtttaaacgttttaacggtttaacgttaacgggtttaaacggtttacgggttacggggttaaacgtttaccggggtacccccggttccgggggtaccccggtacggggtaaccccgggttaccggttacccggtaccccggacttacccgtaccccgtacccggtaacccggtccccgtacccg

SEQ ID NO: 136849 - DNA, 996 bp, Homo sapiens
  misc_feature: GYAE6OF01B9FA4.16.39.D06.1.454.CMB.1.raw
tcagtgtactactccacgaccggtgctcgatttagtgacatctcgcagttctttggggggagaggagcccagcactgggattccgaggtgtttccattcggtgatcagcaactgaacacagaggactcacagtggtagtttggctgtagtttgggttttcctgctgtacttaagttttaaaggtgtccgtagtgtggtaggttgtacgttgggtggagttcgtgggaggacggtccgttccggacccggtacggggtccccggggggttcctaggtacgtaccttcgttcccgtggtcggtaccaccggttcccgttcgggttcgggttaacgacgtcccggtaacctaaacggtaaaaccctaaacccggtacgttacggtacggttccggggttaccgggtccccggccctaaccggtccccggtaaccgggggaagggggtaaccgggggtacgtcggggttaaagttccggggttacttaacggtttaaggtttaagttaaaagtaaagtttggaacgttacggtacgtaaacctaacttaaacggttcccgtaacccgggtaccccgttacggtttacccgggtaacggggaaaccgggttacccctacgtttaaacccaaccggttaccgttaccccgtaacggtaaacggaaccgtaaaacccttaaaccgttaacccggaaaaggtacccggtaaaggtttaacgaacctttaaaccgtaacgaaaactacggaaccgtacgtaaccgtaggaaaacccggaacgaccgggaacgttacgggttaattaacgtttaagttacggttaaggttaagtttaagggttcgggtaacggttaggggtttaaacccggtccccggggaacccgggtttagggaaaccccgggttaccgggtaaccggttcccggaacccgttttaccccggttcccgttaaaccctaacccgtccccggtaaacccctcccggtaaacccccggtaacccggg

SEQ ID NO: 136850 - DNA, 560 bp, Homo sapiens
  misc_feature: GYAE6OF01CGSCA.16.39.D06.1.454.CMB.1.raw
  modified_base (303)..(303): a, c, t, g, unknown or other
  misc_feature (303)..(303): n is a, c, g, or t
  modified_base (364)..(364): a, c, t, g, unknown or other
  misc_feature (364)..(364): n is a, c, g, or t
  modified_base (448)..(448): a, c, t, g, unknown or other
  misc_feature (448)..(448): n is a, c, g, or t
  modified_base (546)..(546): a, c, t, g, unknown or other
  misc_feature (546)..(546): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctatttaaaaggtgtccagtgtgaggtgtacttggtggagtctggaggaggcttgacccaggccgggggggtccctgagactctcctgtgcagcctcgtgggttcagcgtcagtaacaaaccacgtgatggtgggtccnccaagcctccgaagggaaggggctgggaatgggtctcagttatagaaaatgatggtgacanaatctaacgccgataccgtgaagggccgaattcaaccataccgtcaagagaactaattccaaagtaacaacggtagaatacttnaaatgaacagcctagacaacgagacacggctataattatgtataggtatggtgtaactcgggaccctgggccagggacgtgctaccgctcctacgacncctccgacgaacgg

SEQ ID NO: 136851 - DNA, 576 bp, Homo sapiens
  misc_feature: GYAE6OF01CLHF3.16.39.D06.1.454.CMB.1.raw
  modified_base (323)..(323): a, c, t, g, unknown or other
  misc_feature (323)..(323): n is a, c, g, or t
  modified_base (383)..(383): a, c, t, g, unknown or other
  misc_feature (383)..(383): n is a, c, g, or t
  modified_base (387)..(387): a, c, t, g, unknown or other
  misc_feature (387)..(387): n is a, c, g, or t
  modified_base (420)..(420): a, c, t, g, unknown or other
  misc_feature (420)..(420): n is a, c, g, or t
  modified_base (443)..(443): a, c, t, g, unknown or other
  misc_feature (443)..(443): n is a, c, g, or t
  modified_base (447)..(447): a, c, t, g, unknown or other
  misc_feature (447)..(447): n is a, c, g, or t
  modified_base (453)..(453): a, c, t, g, unknown or other
  misc_feature (453)..(453): n is a, c, g, or t
  modified_base (460)..(460): a, c, t, g, unknown or other
  misc_feature (460)..(460): n is a, c, g, or t
  modified_base (555)..(555): a, c, t, g, unknown or other
  misc_feature (555)..(555): n is a, c, g, or t
tcagtgtactactccacgaccggtgctcgatttagtgacatctcgcagttctttggggttttggggagaggagcccagcactgggattccgaggtgtttccattcggtgatcagcactgaacacagaggactcaccatggagttttggctgagttgggttttccttgctgcttaattttaaaggtgtccagtgtgaggtgtacgttggtggagtcgtgggaggaggcttcgacccgacgggcccgggggggtccctggacgactctcctgtgcacgcctcgtggttcagcgtcacgtaaccaaccacgtgatggtcgggtccnccacgcctcggaggggacgggctaggaagtcgggtctcgtagttatagaaatgagtgganacanactcacgccacgtcgagaacggcctatccactntctacagacactactacaagacngtanatctanaatacancgcagacgaacgagcacggctatattatgtaagtgttagtggtagtacgtccgggccgtgggacgacgggtccgttcggactcccgtcctacccnaccgtcccaccgtaacccggg

SEQ ID NO: 136852 - DNA, 933 bp, Homo sapiens
  misc_feature: GYAE6OF01AGTSN.16.39.D06.1.454.CMB.1.raw
tcagtgtactactccacgaccggtgctcgatttagtgacatctcgcagttctttgggttttgggggagaggagcccagcactgggattccgaggtgtttccattcggtgatcagcactgaacacagaggactcaccatggagttttggctgaggtttgggttttccttgctgtcttaattttaaaaggtgtcctaggtgtgaggtgtacgttggtggagttcgtgggagggacggcgttcggacccgacggggcccgggggggtccgtgacgtacctctccgtgtcgcgtacgtccgttcgtgggttccaggtccgtacgaacgtaaccaaccgtacgtggagttcgggtaccggggtccccgaccccgacggtcccccggtaccgggaaaggggggaacgggggtcgtaacggggaacggttaccgggggttaccttacggttaagttttaaggttaacggtaaaaaagtttcggtaaggttacgggttacggaaactaaaccgtaaagtttaccccgtaacccgggtacccggtaaaccccggtttcccgggtaaacggggtaaccggggtaccccgttaaacgtttacccgaacccgttaactacccgttaaccgaacggtaaaccgtaaccgtaaaccttaaccgaaacggtaaaccgtaacgggtaacgtaacgtttaacgttaaccgtaacgtaacgaaacgtaccgtaccgtacggtaaccggaaccgggtaacggaaccgtaaccgggtacgttaacgttagtttaacgtttagttaaggttacgggtttaaggttaggggttacgttaaaccgggttcccggggaaccccgggttcggggtaacccgggtaaccggggtacccgttcgggtaccccgttaccggtcccttacccgtaccgccgtacccgtacccggtaacccgg

SEQ ID NO: 136853 - DNA, 808 bp, Homo sapiens
  misc_feature: GYAE6OF01BIB7V.16.39.D06.1.454.CMB.1.raw
  modified_base (187)..(187): a, c, t, g, unknown or other
  misc_feature (187)..(187): n is a, c, g, or t
tcagtgtactactccacgaccggtgctcgatttagtgacatctcgcagttctttgggttttggggagaggagccagcactgggattccgaggtgtttccattcggtgatcagcactgacacagaggactcaccatgggtagttttggctgtagttgggttttccttgctgtcttaattttaaaaggngtccagtgtggaggttgtacgttggtggtagtcgtggaggacggcttcgaccgagggtccggggggtcctggacgtacctctccgtgtcgcacgtcctcgttcgggttacacggtccgtacgtacgtaaaccaccgtacgtcgacgtcggccggtccggcctacgccgtaccggaaggggtacgggtcgtagggtacgttgggtaccttcgttagttaagttacgaaagttcggtacgtaggttacgaacgtaactaacgtaccgtaaccggccgtaacggttaccgtacgggaacgggttaccgtacgttacccaaccggtcttacccaccggtaagaaccggttaactaacttacgaaacgtaaaccgtagggtaacttaactacgttacgaaactcggaaacccagggtccgacgtaacggaaacccgttaggaacccgtccgggttaacttagttaagtttacttagggacgtttaacgggtacgggttgggtaaacgggtttcccggacccggggttcccggaagggggtaccccgggttaaggggtacccccgtttgtaaccccgggtacttccccttacggaccgtacccggtccccttaccgggaaacccggg

SEQ ID NO: 136854 - DNA, 831 bp, Homo sapiens
  misc_feature: GYAE6OF01AZ7KZ.16.39.D06.1.454.CMB.1.raw
tcagtgtactactccacgaccggtgctcgatttagtgacatctcgcagttctttggggggagaggagcccagcactgggattccgaggtgtttccattcggtgatcagcactgaacacagaggactcaccatggtagttttggctggtaggtttgggttttccttgctgtacttaagttttaaaaggtgtacctagtgtgtaggttgtacgttggtggagtcgtgggaggaggtcgttcgacccgacggggtcccggggggtccctaggacgtaccttccgtccgtgtcgcgacgtccttcgttcgggttacacggtaccgtacgtaacgtaaaccgaaccgtacggtagagttcgggtccgggtccccgaccgtacggcccgtaccgggaacggggacggggtccgtagggtaacggtcgggttctacgttaagtttagtaagtaaaagtgtagtggtacgaaccgtaactacgttaccgtacgtaccgtacgtaccggtacggaacggtccgtacgtccaaccgtactccgtacgaacgactaaactaccgttaaaccgaacgtaaacccggtaagttaacgtaacttaccgttaaacgtaaccgttaaacgaacgtaacccggttccgaaacgggtaaccggaaacccgggtaacggtacccgaaccgggttaacgttaacgttaacgttttaagttacggtttaaagttagggttagttacgggttacgttaaccggtccgggtaccgtacggggaccgtacggggtaccgtcgtaccgttcccgtcgtccctacgtaccgtacccgtcccggtaaccgtacccggg

SEQ ID NO: 136855 - DNA, 857 bp, Homo sapiens
  misc_feature: GYAE6OF01AYM3L.16.39.D06.1.454.CMB.1.raw
  modified_base (321)..(321): a, c, t, g, unknown or other
  misc_feature (321)..(321): n is a, c, g, or t
  modified_base (838)..(838): a, c, t, g, unknown or other
  misc_feature (838)..(838): n is a, c, g, or t
tcagtgtactactccacgaccggtgctcgatttagtgacatctcgcagttcgtttggggggagaggacgcccagcactgggattccggaggtgtttccattcggtgatcagcactgaacacagaggactccaccagtggtagtttggctgtagttttggttttccttgctgtactttaaggttttaaaaggtcgtcctaggtggtggtaggttagttacgttgggtaggtagtcgtaggggaggacggtctcgacccggacggggtccccggggggtcctaggacgtccgtcctcgtcggtcgcctacgtcctggtcggtnacggcgtacaacgtaaccaccgtacggtgtcgtggcgggccccaccgacggtcccgacggggaaggggacgggtcggtacggtaaggttcgggttacgtacgttaagtttaacgtaaggtaaaacgttgggtaacgttcggaacgtaacctaacgtaaccgtcccgtaaccggacccgttaccggtcggtaacggaccggtcgtacttacccgactacctacgtacgaagaacgtaacctaaaccgtaaccgtaacgtaaccggtacgtaaacgtaactacgttaaccgaaagtacgtaaaccgtccgaaaccgtacgggtaacggaaacccggtcgggtaacccgaacggtttaacgtttaagttaacgtttaggtaacgtttaggttaaggggtttacgttaacgggttaccggggttacccggttcccggggacccggggtacgggtacccgggaaccgggttccgggttcgtacccccgtacgttacccgtcccgtacacccccgggttaccnccccggaaccgggtcccgg

SEQ ID NO: 136856 - DNA, 799 bp, Homo sapiens
  misc_feature: GYAE6OF01BUE7S.16.39.D06.1.454.CMB.1.raw
  modified_base (332)..(332): a, c, t, g, unknown or other
  misc_feature (332)..(332): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccagtggtagttttggctggtaggtttgggtttccttgctgtacttaagttttaaaaggtgtccaggtgtgtaggtgttacgttgggtggtagtcgtgggaggaggtcttacgacccgacggggcccgggggggtccctggacgtaccttccgtcctggtcgcacgtcctcgtaggtacttccgtaccgtttagtctaccgtancgcctatggacgtcggtcgggtcccgaccgacgggtccgtaccgggtaagggggtacgggacggtaagggtaacggttcgggtactaacgtaaaggtactaccgaaacgtaaggtacctaaggttaacgtaacgtaccggtatacggtaaggtacccgtacgacgtaccgtaccgggtagggtaaccggtccctttacgaaccttacgtccgtacctaacggaactaaccgtaacgttaacccgaaaacgtaaccgaccgttacgtaacgtttaattacgaaactaaacgtacgtaaacgtagtacgtagtacggtaacgtacggaacgggtaccacggtaacctagttaacttacgttacgtagtacggtaacgggtaaggtacgggtaggttacggggtcgggtacgggttagtaccggttggtaacttaacggtttacggtaccggttaacggggtacccgggg

SEQ ID NO: 136857 - DNA, 1095 bp, Homo sapiens
  misc_feature: GYAE6OF01B2H9C.16.39.D06.1.454.CMB.1.raw
  modified_base (235)..(235): a, c, t, g, unknown or other
  misc_feature (235)..(235): n is a, c, g, or t
  modified_base (334)..(334): a, c, t, g, unknown or other
  misc_feature (334)..(334): n is a, c, g, or t
tcagtgtactactccacgaccggtgctcgatttagtgacatctcgcagttcgtttgggggggagagggagccccagcactgggattccgaggtgtttccattcggtgatcagcactgaacacagaggactcaccatggagttttggctgtagtttgggttttccttgctgcttaatttaaaggtgtccagtgtgaggtgtacgttggtggagtcgtggaggaggcttcgacccgngggcccggggggtcctggacgaccttcgtccgtgtcgcacgtcctcgtgggttcagtcgtacagtaaccaaccgtacgtagagtcgtcgggtcccgccncggtaaaaccccgttccggaaggggggtaacggggccgtagggtaagttcggggtctacgtaggttttaacgttaggtaaaaagttggtaagttacgggttacgaaacctaaaccttaaagttcccgtttaaaccccgggaccccggtaacccgtttccccgggttaagggaaaccggggtcccgttaaactttccccgaacctaccgtttaccccgtacccggaaaggtaaccgtaacccgttaaaaccgtttaaaccccgaaaacgttaaaccggtaaacccgggttaaacgttaaactttaacccgttttaaacgaaaacgttaacggaaaacccgtaccgggtaaccccgttaagggaaaacccggggtaaaaccccggaaccggggtaaacccggtaacccggggtttaaacccgttttaaaccggtttaaaacgttttttaacggtttttaacgggtttaaaacgggttttaaaccggggtttttaaggggtttaacggggggtttttaaacccgggtttaaacccggggtttttaccccccggggggggttaacccccccggggttaaccggggggggttaaacccccgggtaaaacccgggggggtttaaaccccccgggttaaccggggggtttacccccgttaaccccccgggtttaccccgggtttaaccccccgttaacccggggttaaccccgtccccccccggttaaaacccccggtaccccccgggggtaaaaacccccccggggg

SEQ ID NO: 136858 - DNA, 655 bp, Homo sapiens
  misc_feature: GYAE6OF01BVH7Z.16.39.D06.1.454.CMB.1.raw
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgcttattttaaaagtgtccagtgtgaggtgtacttggtggagtctggaggaggcttgacccgaggcccgggggggtccctggacgactctcctgtgcagcctcgttgggttcagtcgtacaagtaaccaaccacgtgatggtcgggtcccgccgagccctaccggagggggaacggggctaggtaagtgggtctcgtagttattagaaaatgagtggtgaacactaactctacgccgtactcccggtagaacgggcctagtccaacacttacctacgaagacgtaactaacgttaaccaaacgtaaccgtacggtagaacttacgtaaccaaagtacgaaacacgtaccgagaccgaacgaggacgacgacgttaattacgttagttagtagttaggttattgggtacgttacgtcccgggacccgttggggaccgaaggggtaccggtgtcccgtacgtccgtcgtacaccgtccctaccgaccgtacggg

SEQ ID NO: 136859 - DNA, 647 bp, Homo sapiens
  misc_feature: GYAE6OF01BKSH3.16.39.D06.1.454.CMB.1.raw
  modified_base (450)..(450): a, c, t, g, unknown or other
  misc_feature (450)..(450): n is a, c, g, or t
tcagtgtactactccacgaccggtgctcgatttagtgacatctcgcagttcttttggggttttgggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctgggaggaggcttgacccaggccgggggggtccctgagactctcctgtgcagcctcgtgggttcagcgtcagtaacaacacgtgatgtggtccgccagcctccgagggaaggggctagggaatgggtctcgtagttatagaaaatgatggtgacacaatcacgcgactcggtgaacgggccagttcacatcctacagagacaattaccaaagaacgacggtagaattaccttaanaaatacgaaacacgacctaggaacgaacccggtaggaaccgaaccgggccgttaattactttaagttacgttaagttagggtttaagtgggttagggtttaaccgttaccggggtccccgtgggggacccggaacggggtaccggttcgggtaccgacccgttccgtcccgtacgaccgtcccgtccgaaaccccgg

SEQ ID NO: 136860 - DNA, 735 bp, Homo sapiens
  misc_feature: GYAE6OF01DV9DI.16.39.D06.1.454.CMB.1.raw
  modified_base (307)..(307): a, c, t, g, unknown or other
  misc_feature (307)..(307): n is a, c, g, or t
  modified_base (367)..(367): a, c, t, g, unknown or other
  misc_feature (367)..(367): n is a, c, g, or t
tcagtgtactactccacgaccggtgctcgatttagtgacatctcgcagttcgtttgggttttggggagaggagcccagcactgggattccgaggtgtttccattcggtgatcagcactgaacacagaggactcaccatggagttttggctgagttgggttttccttgctgctattttaaaggtgtccagtgtgaggtgtacttggtggagtctgggaggaggcttgacccaggcccggggggtccctgagactctcctgtgcacgcctcgtgggttcagcgtcagtaacaccacgtgatgtcggccnccagcctcgaggggagggctggaagtgggtctcgtagttatagaaatggatggacgacanaacgtcctaacgccgatccggaggaaccggccgtaattccgaacctatcctaccgaagaacaacctaattaacccgaaaggtaacccgtacgggttaacaaactttacctttaaacaaagttacggaaaacctacggtacctaacggaacggaaacccgggtaacgggaacccgaccgggttaacccgttaatttaacgtttacgtttaagttaaggttaaggtttacggttagggtttaacgggttaaacccgttcccgggggacccccgttaggggggaccctaaacggggggtaacccgttccgggtaccctaacccgggttcctaacccctcggaccgtcccccgtacccggtaaacccccggg

SEQ ID NO: 136861 - DNA, 875 bp, Homo sapiens
  misc_feature: GYAE6OF01EN6M2.16.39.D06.1.454.CMB.1.raw
tcagtgtactactccacgaccggtgctcgatttagtgacatctcgcagttctttggggggagaggagcccagcactgggattccgaggtgtttccattcggtgatcagcactgaacacagaggactcaccatggtagttttggctgtagtttgggttttccttgctgtcttaattttaaaaggtgtccagtgtgaggtgttacgttgggtggagtcgtggaggaggtcttcggaccgacggggtcccggggggtcctgacgtaccttcctccgtgtcgcacgtccgttcggttcgggttccaggtccgtacaacgtaaaccaacccgtacgtgtagttcggtccgggtccccgccgaccgtcccgtacgggaagggggaacgggtcggtagggtaacggttcgggtacctacgtaagtttaagttaagtaaagtaggtagtaggtacgaactaacgtaacgtaccgtaccgtacccgtacgttacccggtaagggtaccggtacccgttacgtacccaaccgttacctaccgtaccgaacgaacgtaaaccttaaccgttaaacccgaaagtaaacccggttaggtaacttaacttacccgttaaaacgaaagtacgaaacccgtacgtccgtaaggaaacccggaacccggaggtaacccaaccgggtttactttaaattaacgtttgtttaaacgtaaggtttaagggttagttccggggttaaacggttaccccggggttcccccgggggtaacccgggttagggggaacccccggtaaaacggggtttccccggttacgtaccccccgtaccctttcccggtaccctacccgacccgttacccccgtaaaccggaaccccgggtaacccgg

SEQ ID NO: 136862 - DNA, 784 bp, Homo sapiens
  misc_feature: GYAE6OF01CPHAW.16.39.D06.1.454.CMB.1.raw
  modified_base (456)..(456): a, c, t, g, unknown or other
  misc_feature (456)..(456): n is a, c, g, or t
  modified_base (597)..(597): a, c, t, g, unknown or other
  misc_feature (597)..(597): n is a, c, g, or t
tcagtgtactactccacgaccggtgctcgatttagtgacatctcgcagttcgtttggggggagaggagcccagcactgggattccgaggtgtttccattcggtgatcagcactgaacacagagactcacatggtagttttgctgtagtttggttttccttgctgtacttagttttaaaaggtgtacctagtgtggtaggttgttacgtttgggtaggtagtcgtgggaggtacggtcgttacggacccggacggggtcccgggggggttccctggtaacgcttccttccgtggtcgacgcgtccgttcgttcgggttacacggtccgtactaacgttaaacaaacccgtacggttgaacgttcggtccgggtccccgccgtacgtacccgtaccgggaggggtacgggcgtagggtaacgttcggtctagtaaggttattagaaagtgagtaggtnaactactactacgaccggtaccacggttacgacggaacggtctacgttaccgaacgtcttacccacgagtaacgtaaccgtaacttaccgaaacggtaaccgtaggttaacgtaattaaccgtaataaacgtaagtaaccncggaacttaccgggaacgtaaccggaacggtaaccgacggttacttaaacttagttattacggttaagttaggttacgtagggttacggttacccggttcccggtccgggttacgggcccgggtaaggtaccggtccggttaccgacccgttcgtacctcgaccgtcccgtaccgccgtaccccggg

SEQ ID NO: 136863 - DNA, 756 bp, Homo sapiens
  misc_feature: GYAE6OF01A6Z7C.16.39.D06.1.454.CMB.1.raw
  modified_base (315)..(315): a, c, t, g, unknown or other
  misc_feature (315)..(315): n is a, c, g, or t
  modified_base (541)..(541): a, c, t, g, unknown or other
  misc_feature (541)..(541): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttcctgctgctattttaaaggtgtccagtgtgaggtgtacttggtggagtctggaggaggcttgacccgaggccggggggtccctgacgactcgtccgtgtgcacgcctcgtcggtcagccgtcaagtaaccaaccgcgtgagtggtcgggtcccnccacgtcccgtcggaaggggtaacggggctagggtaacgtcggggtctacgtagtttaagttacgaaaagtggtaagtaggtcgaacgtaactaacgttcccgtaacggtaccccggtaacccggttaccggtagggaaaccggggtccctaacgttaccaacccgtactaccgtaccaaggacctaaaccgtaacgtttaccgaaacgtaaccgtaacgggtaanaactttaaccgtaactaagtaacggaacctacgaccgtaaggaacgtaaccggaggaccgtaacggtacgtactagttacgttagtacgtaaggttacggttgttacggttacggttacccgggtaccggtacggggacccggtaacgggtacccgttcgggtaccgtacccttccggtaccctacgaaccggtccccctaactaaaccccgggg

SEQ ID NO: 136864 - DNA, 856 bp, Homo sapiens
  misc_feature: GYAE6OF01CH7CQ.16.39.D06.1.454.CMB.1.raw
  modified_base (212)..(212): a, c, t, g, unknown or other
  misc_feature (212)..(212): n is a, c, g, or t
  modified_base (645)..(645): a, c, t, g, unknown or other
  misc_feature (645)..(645): n is a, c, g, or t
  modified_base (700)..(700): a, c, t, g, unknown or other
  misc_feature (700)..(700): n is a, c, g, or t
tcagtgtactactccacgaccggtgctcgatttagtgacatctcgcagttctttggggggagaggagcccagcactgggattccgaggtgtttccattcggtgatcagcactgaacacagagctcacagtgtagtttgctgtaggtttgggtttcctgctgtacttaagtttaaacggtgtacgtaggtgtggaggttgtacgttggtaggngtcgtagggaggacggtcttcggacccgacggggtcccggggggtcctaggacgtaccgtccgtcgtcggcgccgtacgccgttcggttcggttaccgaggtacccgtaacggtaaccgtaaaccggtaaaccgtaaccggttggtaaggttccgggttcgggtccccgccgtaccgggtacccggtaaccgggaagggggggaacgggtcggttacggtaacgggttcgggttacttaggtaagtttaaggtaagtaaaggtgggtagtacggtacgaacgtacgtaacgttaccgtacccggacccgttacggtaccggtacggggaaccgtacgaccttaccaacgttcgtaccgtacgtacggtaactaactaaccgttaccgaaacggttacgtaaggttacaaactttacgaaggaactcggaaacncgtacgacgaacggaaccggaataacccgggcgttaagttaacgtttgtttaagnggtttaaacggtagttttacgggtaacgggttaagggttcccggtacccggggtaccgggtaccggggtacgggtaaacccgggttcggtttcccggaaccctcccggttcctacggaccccgtaaccccggtcccaccggaacccgttaccgggg

SEQ ID NO: 136865 - DNA, 837 bp, Homo sapiens
  misc_feature: GYAE6OF01CWO5A.16.39.D06.1.454.CMB.1.raw
tcagtgtactactccacgaccggtgctcgatttagtgacatctcgcagttctttggggggagaggagcccagcactgggattccgaggtgtttccattcggtgatcagcactgaacacagaggactcaccatggagttttggctgtaggttgggttttccttgctgtcttaattttaaaaggtgtccagtgtgaggtgtacgttggtggagtcgtgggaggaggtcgttcggacccgacgggcccgggggggtccctggaacgtaccttcctccgtgtgccacgtccgttcgttcgggttcacggtccgtacgaacgtaaaccgaaacctacggttgagttcggttcgggtcccgccgacggccctaccgggaaggggacggggtcgtagggtaacgttcgggttctacggttaagtttaacgttaagaaaacgtggtaagttaggtacgaactaactaacgttcccgtaacggcccgtacgtccggtacggaaccggtacctacgttaccacccgtatacccgtacgacgaacgtaacctaacgtacccgaaaggaaccgttaacggtaacgttaacttaaccgttaacgaaactacggaaacctacggtacctaaggaaaccggaaacccgggacggtaacccggtaaccggttaactttaacgttacgtttaagttacgttaagtttaacgggttacgtacgggttacggttaccgggtccccgggtccgggtaacggggtacccggtaagggttaccccggttcggtaccccgtaccggttccctacccgttacggaaccccgtccccggtacccgtaaacccgggtacccgg

SEQ ID NO: 136866 - DNA, 906 bp, Homo sapiens
  misc_feature: GYAE6OF01B78E7.16.39.D06.1.454.CMB.1.raw
tcagtgtactactccacgaccggtgctcgatttagtgacatctcgcagtttctttggggggagaggagcccagcactgggattccgaggtgtttccattcggtgatcagcactgaacacagaggactcaccatggtagttttggctgtagtttgggttttccttgctgtacttaatttaaaaggtgtcagtgtgaggtgtacgttggtggtagtcgtagggaggaggtcgttacgacccgacggggtcccgggggggtccctaggacgaccttcctccgtggtcgccacggtcccgttcggttcgggttacgacggtaccggtacgtaaacgtaaaacccgaaacccgtacggttagtacgttcgggttaccggggtccccggaccccgtaccggtccccggtaccgggaacggggggtaacggggtcggtaagggaaggtttccggggttaccgtttaaccgttaaggttttaagttaaggtaaaaagttcggtaaggttacgggtacgaaacctaaccgtaaacgttacccgtaacccggtacccgtaccgttaccgggtacgggtaaccgggtaccgtaccgttaccgaacccttacgtcccgtaaccgaaggaaccgtaactaaaccgttaaccaaagggtaaacccgtaggtaacttaacgttaccttaacgtaaacgtaccgaaacgaccgtaccgtaacggaaccgggaacccggaaggtacccgtaacggtaccttaagttatttaagttacgttaagtttaggttagtttagggttaaccggttaccggttcccggggaccccggttagggggaacccgtaccggggtaccggttcgtaccccgtaccgttcccgtaccctaccgacccgtaccccgtacccgaacccggtaacccg

SEQ ID NO: 136867 - DNA, 985 bp, Homo sapiens
  misc_feature: GYAE6OF01D4NDR.16.39.D06.1.454.CMB.1.raw
tcagtgtactactccacgaccggtgctcgatttagtgacatctcgcagttcgttggggggagaggagcccagcactgggattccgaggtgtttccattcggtgatcagcactagaacacagaggactcacagtggtagtttgctgtagttggtttctgctgtacttaagtttaaaggtctacgtaggtgtggtacggttaggttacgttgggtaggtacgtcggtgggaggagtccgttaccgaccggacggggtccggggttacctaggtcctccgtcgtagcgacgtacgtccttggtcggtactacgtccgtaacgaaccgtaaccaccggagttagtcgttcgggtaccgggtaccccacgtaccggtaccggtaccggggaaagggggtaacggtcggttaacgggtacggtaccggtttacgtaacgtttaaggttaacgtttaaaggaaacggttgggtaaggttacggtaacgtaaaccgtaaacgtaaaccggttacccgtaaaccggtaccccgtttaacggaacccgggggtaacgggtaaccccggttaccgttaacccgtttacccctaaaccgtttaccgacccgttaaacggaacgtaaaccgtttaaaccgtaaccggttaaaaccgaaaccggggtttaaacgtaacggttaactaaaccgttaacgtaaaacgtaaacgtacccgaaacggtaacgtacccgtaaaccgggaaccgggtaacggtaacccggtaaccggtaaccgttaacgtttaacgtttaacggttaagttaacggtttaacggtttagggtaaccggttttacggggttaacggttacccccggggtcggggtaaccccgggttacggggaacccgggttaaacgggttccccggtaaccggttacgttcccccgggttccttaacccgggacccttaacccggcccccggttaaccggtacccgggtaaaccccgttcccccg

SEQ ID NO: 136868 - DNA, 898 bp, Homo sapiens
  misc_feature: GYAE6OF01E29O5.16.39.D06.1.454.CMB.1.raw
  modified_base (233)..(233): a, c, t, g, unknown or other
  misc_feature (233)..(233): n is a, c, g, or t
tcagtgtactactccacgaccggtgctcgatttagtgacatctcgcagtttcttttgggttttggggagaggagcccagcactgggattccgaggtgtttccattcggtgatcagcactgaacacagaggactcacatggtagtttgctggtagtttggttttcctgctgtacttaagttttaaaggtcgtaccgagtgtggtaggtgttagttggtggtagtcgtgggaggngtcgtcgaccgacgggtcccgggggtcctgacgtactcctcgtgtcgcgtacgtccttcggtcggtcaggtccgtacgtaaaccgtaaaccaaccgtcggtagtagttcggtccgggtcccaccgccggtacccgtaccgggaaggggtaacggggtcgtaagggtacggtcggttctagtttaacgttaagtaagtaaaatggtagtcggtacgaacctaacgtaactaccgaccggccgtacggtaccggaagggtaaccgggtaccttaacgttacccaaccgttacgtacccgtaacggtaaacgaaccgtaaaccgtaaccgttaaaccgaaacggtaaacccggttaacggttaaacgtaacctttaaaccgtaaaacgtaaacgttaaaccggaaacccttaaccggtaaccgtaaacgggtaacccggaaacccggtaaggaaaccccgggtttacggtaaaccgtttaagtttaacgtttaacggttaggtttaaaggttaggtttaacggttaggggttaaaccggtttacccggggtacccgggtccccggggttaacgggacccgggttaacggggtaacccggttcggttaacccccgtaccgtttcccacccgtacccgtacccggtaccccaacccgggtaaaccccggg

SEQ ID NO: 136869 - DNA, 565 bp, Homo sapiens
  misc_feature: GYAE6OF01B5VDI.16.39.D06.1.454.CMB.1.raw
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccaggccgggggggtccctgagactctcctgtgcagcctctgggttcagcgtcagtaacaaccacgtgatgtggtcccggccagcctccgaggggaagggctggaatgggtctcagttatgaaaatgatggtgacacaatctacgccgactccgtaggaacgggccgattcaccatcctccagagacaacttccaagaacacggtagaacttcttacaatcgaacagcctagacgaacgaggacacggctatattatgtataggttatggtggtatccgggcccgtggggccagggaccggtggtacgacccgttctcctcacgccctccgaccgtaaccggg

SEQ ID NO: 136870 - DNA, 725 bp, Homo sapiens
  misc_feature: GYAE6OF01ATKBM.16.39.D06.1.454.CMB.1.raw
  modified_base (311)..(311): a, c, t, g, unknown or other
  misc_feature (311)..(311): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgcttattttaaaaggtgtccagtgtgaggtgtacttggtggagtctggaggaggcttgacccgaggccggggggtccctgagactctcctgtgcagcctcgtggttcagcgtcagtaaccaaccacgtgagtggtcgggtccnccgagcccgtccggaggggaaggggctgggaagtcggggtctcgtaagttattagaaaagtgtagtggtcgaacactaacgtctaccgccgacgttccggtaggaacgggtccgtaacttacccgaaccacttaccgtaccgaacgtaagaacctaaacgttacccgaaaaggaaaccgtaacgggtataaacttaccgttaaactaaagtaacgaaaccctaggaccctagggaaaccgtaacccgggacggttaacccgaaccgggttaccgtaatttaacgtttatttaggttaacgttaggtttaaggtcgggttaggtaacgttccccggggcccggtaggggtacccgtaacgggggtaccgttcgggtcctacccggttcgtaccacgccgtccctacgaaccccgg

SEQ ID NO: 136871 - DNA, 769 bp, Homo sapiens
  misc_feature: GYAE6OF01CAAX5.16.39.D06.1.454.CMB.1.raw
tcagtgtactactccacgaccggtgctcgatttagtgacatctcgcagttctttgggggagaggagcccagcactggattccgaggtgttccattcgtgatcagcactgaacacagacgactcaccagtggtagtttcgctgtagttggttttcctgctgtacttaagtttaaaggtgtccaagtgtgaggttcgttattggtggagtcgtggaggagcgttcgaacccgtgggcccggggggttaccctgacgtacctctccgtgtcgctcgccgttcgtacgggttcaggtccgtacgtaaacgtaaaccgaaccgtaggtagtagtcggtcgggtcccaccgacgacccgtaccggaaggggaacgggtcgtaggtaacgtcgggttacctagtaagttttagtaaagtaaaacgtgtacgtagtacgaactataactcgaccgacgtacgtcgtaaggacggtactacttaccactacttcgacgaacgtaactaaccgttaacgttaaccgaaacggtaacggaacgtagtaaactttacaacgaaagtacgaacacgtaaccgtaggaaaccggacgtaacgacggtaacggtacttaagttaagttgttaagttaagttacggtttaatcgggttaagttacccgggtcccgggtacccggtaggggtaacccggtaggttacccgggtccggttaacccttcccggttaccgtaaccgttaccgacccgttacccccgtaaccgtaaaccccggggcccgg

SEQ ID NO: 136872 - DNA, 928 bp, Homo sapiens
  misc_feature: GYAE6OF01BU9UF.16.39.D06.1.454.CMB.1.raw
tcagtgtactactccacgaccggtgctcgatttagtgacatctcgcagttctttgggggggagaggagcccagcactgggattccgaggtgtttccattcggtgatcagcactgaacacagaggactcaccagtggtagttttggctgtaggtttgggtttccttgctgtacttaattttaaaggtgtcctagtgtggtaggtgtacgttgggtggtagtcgtgggagggaggtcttacggacccgagggcccggggggtcctggtacgtaccgttccgtccgtcggtcgccgacgtcccgttcggttcggggttacctacggtaccggtaaccgtaacggtaaaaccctaaaccgtacggttcggtaaggttcgggtaccggggtccccggacccgtaccggtaccccggtacccgggaaggggggaacgggggtccgtaaggggtacggttcggggtaccttacgtaacggtttaagtttaaaggtaaaagtggtaaggttacgggtactaaccgtaactaaccgttaccgtaaccccgggtaccgtacccggttaccggacgggtaaccgggtacccgtacgttacccaaccgtactaccgtaccgaacgtaaccgtaccttaaacgtaacccgaaaggaaccgtaaacggtattaactaacctttaagaaacgtacgtaaccgtaaccgccggtaaacgaacggtaacccgggaaccgaccggtaccggtaacttaacgtttaaggtttaacgttaggtttaaggttacggttaggttacgggttaacggttaacccgggttccccggggaaccccggttagggggaccccgtaaccggggttaaccggttcccgggtaaccccgtacccggttccgtaccccgttacacccggtacccgtacccccgtaggtaaacccccggg

SEQ ID NO: 136873 - DNA, 759 bp, Homo sapiens
  misc_feature: GYAE6OF01BQ4XU.16.39.D06.1.454.CMB.1.raw
  modified_base (127)..(127): a, c, t, g, unknown or other
  misc_feature (127)..(127): n is a, c, g, or t
  modified_base (234)..(234): a, c, t, g, unknown or other
  misc_feature (234)..(234): n is a, c, g, or t
  modified_base (584)..(584): a, c, t, g, unknown or other
  misc_feature (584)..(584): n is a, c, g, or t
  modified_base (735)..(735): a, c, t, g, unknown or other
  misc_feature (735)..(735): n is a, c, g, or t
tcagtgtactactccacgaccggtgctcgatttagtgacatctcgcagttctttggggggagaggagcccagcactgggattccgaggtgtttccattcggtgatcagcactgaacacagaggactnaccagtggtagtttgctgtagttggtttcctgctgtacttaattttaaaggtcgtacgaggtgtgacggtgtagttggtaggagtcgtggaggagcgtacgaccggngggccgggggtcagacgctctcgagtcgcagtccgtcggtggtctacggccgttacaacgtaacctaaccgtcgttaaggcgtacggtccggacctaccgacgtcccgtacggaaggggaacggtcgtagggtaaccgttggtaccgtagtaagttaagtaaggtaaagtggtagttaagggacaaactacgtaacgttaccgtacggtacccgtaacgtccggttaagggaacggaccctttagttacccgaacctacgttaccggaaccgtaaacgtacgtaaaacctaacgttaaaccgaaaagtaaccggtaaccgggtaataaacttacgttaaacgaaagttanaaaccggtacgtaccgaaggaccggtaacggaacggtaccgaagggtacttaaggttacttaagttaacggtagtttaacggtaggtagggtactagggttccccggaggtacggtaccgacggtacggtccgcttaccggtctaccgtanacccgcctaaccgaccgtaccggg

SEQ ID NO: 136874 - DNA, 750 bp, Homo sapiens
  misc_feature: GYAE6OF01ERRMO.16.39.D06.1.454.CMB.1.raw
  modified_base (557)..(557): a, c, t, g, unknown or other
  misc_feature (557)..(557): n is a, c, g, or t
  modified_base (586)..(586): a, c, t, g, unknown or other
  misc_feature (586)..(586): n is a, c, g, or t
  modified_base (595)..(595): a, c, t, g, unknown or other
  misc_feature (595)..(595): n is a, c, g, or t
tcagtgtactactccacgaccggtgctcgatttagtgacatctcgcagtttcttttggggttttggggagaggagcccagcacgtgggattccgaggtgtttccattcggtgatcagcactgaacacagagactcaccatggtgtttggctgtagtttggttttcctgtctgtcttaagttttaaaggtcgtccgtagtgtgtaggttgttacgttgggtggtagttcgtgggaggtacggtaccgttcggaccccggacggggtcccggggggttccctaggtacggtacctccgttccgttggtccgacgtacgttccccgttcggttcgggttcgacggtaccgtaccgtaaacgtaaaacccgtaaccgtcggtaggtacgttcgggtccggtccccgaccgaccggtcccgtaaccggggacggggaacggggttcgtaaggacggtttcgggtcttacgtagtttaattaacgaaagttgtacgtgtaacgactacgtactcgtaccgtaccgtacgtacgggacgaacggtccgtataccactagtccanagaacgactaagtacaacggacacgtaanacttacaanacgcaacgcgtacaggaacgacgacgactaccgtaattaattagttcgtagttaagttaggttacgtacgggttaccgtcgggttccggcccggttcgggaacgtcggttcccgcggttacctcccgtcacccgttgacccctcgacccggtacg

SEQ ID NO: 136875 - DNA, 916 bp, Homo sapiens
  misc_feature: GYAE6OF01CZJDL.16.39.D06.1.454.CMB.1.raw
  modified_base (255)..(255): a, c, t, g, unknown or other
  misc_feature (255)..(255): n is a, c, g, or t
tcagtgtactactccacgaccggtgctcgatttagtgacatctcgcagttcgtttggggggagaggagcccagcactgggattccgaggtgtttccattcggtgatcagcactgaacacagaggactcaccatggagttttggctgtaggtttgggttttccttgctgacttaattttaaaaggtgtccagtgtggaggtgtacgttggtgagtcgtgggaggaggctcgacccgacgggcccggggggtacccnggacgtcctcctccgtgtagccgacgccgttcgtcgggttcacggtccgtaacgtaacgtaaaccaacccgtacggtagtacgtgggtccgggtacccgccgaccgtcccgtacgggaaggggacgggcgtaggagtacgggtcctagtagttaagtaagtaaaagtgtaaggtggacgtaacctaacgtaacgtacccgtaacccggaccgttaccgtaccgggtacggaaaccggggtacccttacttaccgaacccgtacgttcccctaacggaacgtaaaccgtaacttaaccgtaacccgaaaacgtaaccgtaacggtaagtaaccttaaccgtaactaacgtacgaaacgtaccgtaaccggtacgaaaccgggtaaccggaacgaacccgggttaaccggtaacctttaaatttttaagggttaacgtttacgggtttaaagggtttaaacgggtttcgggttaaaggggtttacccgggtttaacccggggtcccccggggggttacccgggttaacccggggggtaacccgttaaacccgggggttaccccgggtttagggaccccccgttttacccggacccccgttaccgtaaccccggaccccggttaccccggtaaaccccgtaaacccccggggtaaacccccggg

SEQ ID NO: 136876 - DNA, 588 bp, Homo sapiens
  misc_feature: GYAE6OF01CKC42.16.39.D06.1.454.CMB.1.raw
  modified_base (380)..(380): a, c, t, g, unknown or other
  misc_feature (380)..(380): n is a, c, g, or t
  modified_base (568)..(568): a, c, t, g, unknown or other
  misc_feature (568)..(568): n is a, c, g, or t
  modified_base (575)..(575): a, c, t, g, unknown or other
  misc_feature (575)..(575): n is a, c, g, or t
  modified_base (577)..(577): a, c, t, g, unknown or other
  misc_feature (577)..(577): n is a, c, g, or t
  modified_base (579)..(579): a, c, t, g, unknown or other
  misc_feature (579)..(579): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtcgtggaggaggcttgacccgaggcccggggggtccctgacgactctcctgtgcacgcctcgtggttcagcgtcagtaaccaaccacgtgagtaggtcggtccgccacgccgtccgagggagggcgtggagtggtctcgtagttattagaaagtgagtggtgacactaancgttttttaccgaccgtacgtccggtagaacgggaccgtactaccaccactctaccacgacgtaactaactacgaacgaacgacgtacgaactactacaaatacgaacacgaccgacgacgaacgacgacgacgcgtatattattgtagtagtagtgtgtacgtcggccgtcggcgacggcgtcgtcncgtctcncncnccgcgaccg

SEQ ID NO: 136877 - DNA, 947 bp, Homo sapiens
  misc_feature: GYAE6OF01C68EN.16.39.D06.1.454.CMB.1.raw
  modified_base (141)..(141): a, c, t, g, unknown or other
  misc_feature (141)..(141): n is a, c, g, or t
  modified_base (217)..(217): a, c, t, g, unknown or other
  misc_feature (217)..(217): n is a, c, g, or t
tcagtgtactactccacgaccggtgctcgatttagtgacatctcgcagttcgtttggggggagaggagcccagcactgggattccgaggtcgtttccattcggtgatcagcactgaacacagagactcacatggtgtttgntgtggttggtttctgctgtacttaagtttaaaggtgtctagtgtgtaggtgtacgttgggtggtagtcgtggaggngtaccgtcgacccggacgggccgggggtccctagacgtactctcgtgtcgtacacgtccttcggtcggtacgacggtcgtactaacgaacccgtaaccgtagtgtagttcgggtccggtacccgaccgacggtcccggtaaccgggagggggtacggggtacgtagggtaacggttcgggttacctttacggtaagttttaaagttaacggtaaagtggtaaacggttacggtacgaaaccgtaaccgttaacgtacccgttaacccggaccgtaccggtaccgggttaacgggaaccggttacccgtactacccgtaacctcggttaccaccgtaagtacctaaccttaaacggtaacccgaaaagtaccggttaacgggttattaaaacctttactaaaaccggtaacgaacgttaaacccggcgtaaacccgtaaacgggggaaaccgtaaacccgggtacgggtaacgtaacccgggtttaacttttaacggttttagttaaggttaaccgggttaaagttttttacgggggtttacgtttaacgggggtacccgggttttaacccggggtccccccgggggtacccggggtaacgggggggtaaccccggttaaacggggttaccccggggtttccaaaccccgggtttttccccgacccgtttaccgggaccccttaacccggttaacccccgggaaccccgtaacggggtttaaaccccccgg

SEQ ID NO: 136878 - DNA, 729 bp, Homo sapiens
  misc_feature: GYAE6OF01DKMFF.16.39.D06.1.454.CMB.1.raw
  modified_base (130)..(130): a, c, t, g, unknown or other
  misc_feature (130)..(130): n is a, c, g, or t
  modified_base (187)..(187): a, c, t, g, unknown or other
  misc_feature (187)..(187): n is a, c, g, or t
  modified_base (211)..(211): a, c, t, g, unknown or other
  misc_feature (211)..(211): n is a, c, g, or t
  modified_base (558)..(558): a, c, t, g, unknown or other
  misc_feature (558)..(558): n is a, c, g, or t
  modified_base (712)..(712): a, c, t, g, unknown or other
  misc_feature (712)..(712): n is a, c, g, or t
  modified_base (719)..(719): a, c, t, g, unknown or other
  misc_feature (719)..(719): n is a, c, g, or t
tcagtgtactactccacgaccggtgctcgatttagtgacatctcgcagttctttgggttttggggagaggagcccagcactggattccgaggtgtttccattcggtgatcagcactgaacacagaggacncaccatggtagtttggctgtagtttgggttttccttgctgtcttaagttttaaaggngtccagtgtgaggtgtacgttggngtagtcgtggaggaggcgttcgacccgagggcccggggggtcccaggtccttcgtcctgtcgcagtccgtcgtgggttcacggtcgtagaacgtaaccaacctacggtgagtcggtccggcccgacctaccggtcccgtaccgggaacggggtaaggggccgtagggtaacgttcggggtacttacggtaggttttaattaggaaaagttggtacgtaggtacgaaccagtaaaccttccgtaccgacccgtacgttaccggaagggtaccggaccgtaccttaccgacctactacacaagtaacgaacctaccgtaaaccgaacgaaccgtaggtaagtaactttnaaaccgtaagtaaccgaacgcgtacgtaggaaccggaacggtacgaaccgtacggtaacgttaactgtttaagttcgttaagttagttagggttagcggtttaaccgccgggtacccgtcgggacgtacggacgtcgacgtcccgtactccacncgaaccncgaacggccg

SEQ ID NO: 136879 - DNA, 836 bp, Homo sapiens
  misc_feature: GYAE6OF01AWPYH.16.39.D06.1.454.CMB.1.raw
  modified_base (278)..(278): a, c, t, g, unknown or other
  misc_feature (278)..(278): n is a, c, g, or t
  modified_base (333)..(333): a, c, t, g, unknown or other
  misc_feature (333)..(333): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaaccatggtagttttggctggagttgggttttcctgctgcttaatttaaaggtgtcagtgtggaggtgtacgttgggtggagtcgtgggaggtaggtcgttcgacccgacgggtcccgggggggtcctggacgtactcctccgtgtcgacngccttcgtgggtcagcgtacgaagtaaccaacgtacgtgagtcggtccgggtccnccgacgcccgtacggaaggggtaacgggcgtaggtacgtgggttctacgtaagttataacgtaaaagtgtaagtggtacgactaaacgtactaccgtaccgaccgtaccgtaccgtagggaacggtccctacgttaccactacgtaccgtactaacgaacaactaaccgtaacgaaaccgtaacggtacggtactaaaccgttaccttaaacgaaacgtacgaaaccgtacggtaaccgtaccggtaaacggaaccgggaacggaaacccggtccggtaaccgttaaacgtttaacggttttaagtttacggttaaacggtttaagggttaaccggtttggggttaacgggttaacccgtttacccggggaaaccccgggttaccggggtaaacccggggtaacgggtaaccccgggttccggtaacccccggttaccgttccccgttaccccgcccggttaacccgaccccccgtaacccgtaaccccggggtaaaccccgg

SEQ ID NO: 136880 - DNA, 771 bp, Homo sapiens
  misc_feature: GYAE6OF01CGVMB.16.39.D06.1.454.CMB.1.raw
  modified_base (348)..(348): a, c, t, g, unknown or other
  misc_feature (348)..(348): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcacatggtagttttggctgagttgggttttcctgctgacttaagtttaaaaggtgtccagtgtgtaggtgttacgttgggtggtagtcgtagggaggtacggcttacgacccgagggcccggggggtcctgacgtctctccgtgtcgacgtagtccgtcgtggttacacgtcgtactaacgtaaaccgaacctacggtgtacgtggtcgggtacccnccgtacgcccggtaccggaaggggacgggtacgtaggtaaaggtcgggtacctaggtaagtttaagtaaggtaaaagtggtaagtgggtacactaactaatcccgtaacgacccgtaccgtaccggtaggaaccggggtcctaatacccacgtacttccgaccgaaggaacaaccttaacgtaccgaaagtaacccgtaacgggtataaccgttactaagtaaatcgaaacgtacgtacccgtaggaaacgaaccggaacggaaccgtacggtaccggtaaattcgttaagttaggttaagttcggttaagtacgggttacgttaccgggtacccgggtccgggtacgggtacgggtaaccgggtcccggtcgtacccgtaaccggtcccttacgccgaaccgtcccgcccggtaaacccggg

SEQ ID NO: 136881 - DNA, 751 bp, Homo sapiens
  misc_feature: GYAE6OF01AD4DJ.16.39.D06.1.454.CMB.1.raw
  modified_base (329)..(329): a, c, t, g, unknown or other
  misc_feature (329)..(329): n is a, c, g, or t
  modified_base (394)..(394): a, c, t, g, unknown or other
  misc_feature (394)..(394): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggacctcaccatggagttttcggctgagttgggttttccttgctgctatttaaaggtgtccagtgtgaggtgtacgttggtggagtcgtgggaggaggcttcggacccgacgggcccggggggggtccctgacgaccgtctcctgtcgccagtcctcgtgggttcaggccgtacagtaaccaccacgtgatgtcggtccgccncgcctcgaggggacgggctagggaagtcggggtctcgtaggtttagtagaaaatgaatgggttanaacacaatcccaaccggtcccacgtccggttacggacggggtaccccgtattacccaacccgacttcccgacgaacggtacgaacctaacttaccgaaacggtaaacccaacgggttaacgaacctttaccgaacgtaaacgttaaccgaacgtacgacccgtaggaaccggtaaaccggacgggtaaccaacgggttcccgtaagtttaacttacgtttaggtaaccgtttaggttacgttaggggtaggttacgttacccgggtcccgtacgggacggttaccggaaccggggtaacccgggttcggacccggtaccgttccctacccgttaccgtaccggccccttaaccccgg

SEQ ID NO: 136882 - DNA, 714 bp, Homo sapiens
  misc_feature: GYAE6OF01AJOQU.16.39.D06.1.454.CMB.1.raw
  modified_base (282)..(282): a, c, t, g, unknown or other
  misc_feature (282)..(282): n is a, c, g, or t
  modified_base (304)..(304): a, c, t, g, unknown or other
  misc_feature (304)..(304): n is a, c, g, or t
  modified_base (623)..(623): a, c, t, g, unknown or other
  misc_feature (623)..(623): n is a, c, g, or t
  modified_base (631)..(631): a, c, t, g, unknown or other
  misc_feature (631)..(631): n is a, c, g, or t
tcagtgtactactccacgaccggtgctcgatttagtgacatctcgcagttcttttgggttttggggtaggaggagcccagcactgggattccgaggtgtttccattcggtgatcagcactgaacacgagaggactcaccatggtagttttggctgtagtttgggttttccttgctgtacttaagtttaaaggtgtcagtgtgtaggtgttacgttggtgagttcgtggaggacgtgttcgacccgagggtccgggggtacctggatccgttctccgtggtcncgacgtccgtcgttcggttacncggacgttcgaacgtaaacctaccgacgtgtagtcggtcggttccgaccgtcgaccgtacggagggacgggtcgtaggtacggtcggtacgtcgttaaggttacttaaagaagtggtacggtgtaagaacccagtaacgtaccgaccgtacggtacccgtaggacggtaacggtcctacggtttaccaaccgtcgtaacctcggtaagaaccgagtaacctaacgacgtaaacgtaacgtagtacttacgttaagctaaacgaactacgcctaagaccgaacgaaggacctacggtagtaacttattactagtaacgtnttaaggtntaacgggttccggtcgtaccggtcggacgtaaccggtgtaaccgtccttaccgtcggacccacgtacgcccgtcaaacccggg

SEQ ID NO: 136883 - DNA, 773 bp, Homo sapiens
  misc_feature: GYAE6OF01CDWIK.16.39.D06.1.454.CMB.1.raw
  modified_base (245)..(245): a, c, t, g, unknown or other
  misc_feature (245)..(245): n is a, c, g, or t
  modified_base (418)..(418): a, c, t, g, unknown or other
  misc_feature (418)..(418): n is a, c, g, or t
tcagtgtactactccacgaccggtgctcgatttagtgacatctcgcagttcttttggggttttggggagaggagcccagcactgggattccgaggtgtttccagttcggtgatcagcactgaacacagaggactcaccatggtagttttggctgtaggtttgggttttccttgctagtacttaaagttttaaaggtcgtcctaggttgtggtaggttgttacgttgggtggtagtcgtgggaggngtcgttacgaccggtacggggccggggggtaccctggacgtacctcctcgtgtcgcgacgtcgttaggtggttcacgcgtagtaacggtaaaccaaccgtggtgacgttcgggtccggtacccgaccgtcgtacccggtacggaagggggtacgggcgtaggtagttcgggtntacgtaagtttacgtaaagtaagtgacgttggaacacaatacgtaccgacgtaccggtacgtacggtaaggaccggaccgtacgttaccaaccgtactcgtaacgaatacgtaaacctactaaaccggtaaacgaacgtaacggtaataacccgtattaaccgaattaacgaacgacgtacgtaaacggacggtaaccggaacggccgtaacggttactaatttcgttaagttagtaagtttaggtagttagggtacgttacgggtacccggtccgggaccgggtaggacgggttacggtccggttacccgtcgggttacccacggtcccaaccgtcccgtaacccgaaccccgg

SEQ ID NO: 136884 - DNA, 916 bp, Homo sapiens
  misc_feature: GYAE6OF01A83UN.16.39.D06.1.454.CMB.1.raw
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgtcttaattttaaaggtgtccagtgtgaggtgtacgttggtggtagtcgtgggaggaggcttgacccgagggccggggggtccctgacgactctcctgtcgcagcctcgtgggttccagcgttacaacgtaaccaaccgtacggtgtatcggtcgggtccgccgacgtcccgtaccgggaaggggaacggggtcctaggggaagttcggggtccttacggtagtttaacgttaaggtaaaaagttggtaacgttcgggtacgtaaaccgtaaccgtaaacgtttaccccgttaaccgggacccggtaccgtttaccccggggttaaggaacccgggggtacccggttaacgtttaccccaaacccgtacgtttaccccgttaacccgggaaaggttaacgaaaccccgtttaaaacgttaaccccggaaaaacggttaaacccggtaaccgggttaacgttaaacgttacccttttaaacgaaaacggtttaacgaaacccgttacggtaaccccgtttaagggaaacccggtaaacccgggacgggtaacccgaaacccgggttacttaaacgtttaattttaaagtttacgggtttaaagtttagggttacggttacggggttaaggtttacccggttacccggggtccccggttaaggggacccgggtaacgggtaacccggttccggtacccgttacccgtcccgttacgtacccgtcggtaaccccgttccggaaaccccggg

SEQ ID NO: 136885 - DNA, 917 bp, Homo sapiens
  misc_feature: GYAE6OF01BQ50Q.16.39.D06.1.454.CMB.1.raw
  modified_base (194)..(194): a, c, t, g, unknown or other
  misc_feature (194)..(194): n is a, c, g, or t
  modified_base (667)..(667): a, c, t, g, unknown or other
  misc_feature (667)..(667): n is a, c, g, or t
  modified_base (676)..(676): a, c, t, g, unknown or other
  misc_feature (676)..(676): n is a, c, g, or t
tcagtgtactactccacgaccggtgctcgatttagtgacatctcgcagttcttttgggttttggggagaggagcccagcactgggattccgaggttgtttccattcggtgatcagcactagaacacagaggactcaccatggtagtttggctgtagtttggttttccttgtctgtactttaagttttaaaggtntacctagtgtagtaggtgttacgttggtggagtcggtagggagggtaggtcgttacggacccggtacggggtcccgggggggttccgtaggacgtaccgttccgttccgtggtcgcgtacgtcccgttcggtttcgggttacgacggttccgtaaccgtaaacgtaaaccgaacccgtaacggttaggtacggttcgggtccgggttaccccgaccgtaccggtacccggtaaccggggaacggggggtacggggtacggtagggtaacgggttcgggttacgttacgttaacgtttaaggttaaacgtaaagtaggtacggtacggaacgtaactaacgtaacgttacccgtaccgtaccgtaccggtaacgggtacggaaccgtaccgtacgttaccacctacgtaccctacgaacggaaccttaaactaccctaaggaaaccgtaacgtacgtataaaccttaacgtaanaaccggtanaaccccgtaggaccgtaaggaaccggaccgtaacgtaacggaccgtttaacttacgtttaagtttcggttaaggttaagggttaacgtttcgggtaacgggtttaccgtaaccggggttaccccgggcccgggtttaacgggggaacccggtaccgggggtttaccctcccggtaaaccggttcccccgtttacaaccccgggttacccacccggttacccgaccccgggtaaacccgggg

SEQ ID NO: 136886 - DNA, 616 bp, Homo sapiens
  misc_feature: GYAE6OF01BYRHP.16.39.D06.1.454.CMB.1.raw
  modified_base (177)..(177): a, c, t, g, unknown or other
  misc_feature (177)..(177): n is a, c, g, or t
  modified_base (306)..(306): a, c, t, g, unknown or other
  misc_feature (306)..(306): n is a, c, g, or t
  modified_base (310)..(310): a, c, t, g, unknown or other
  misc_feature (310)..(310): n is a, c, g, or t
  modified_base (441)..(441): a, c, t, g, unknown or other
  misc_feature (441)..(441): n is a, c, g, or t
  modified_base (457)..(457): a, c, t, g, unknown or other
  misc_feature (457)..(457): n is a, c, g, or t
  modified_base (477)..(477): a, c, t, g, unknown or other
  misc_feature (477)..(477): n is a, c, g, or t
  modified_base (507)..(507): a, c, t, g, unknown or other
  misc_feature (507)..(507): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggtttccttgctgctattttaaaggtntccagtgtgaggtgtacttggtggagtctgggaggaggcttgacccgaggcccgggggggtccctgagactctcctgtcgcagtcctcgtgggttcagcgtcagtaaccaaccacgtgatgtgggtccnccgngcctcgaggggacgggcgtaggagtcgggtctcgagttactagaaaatggatggtacacacatcctaacgccgactcggaggacggcgtactccactatcctcagacaactaactaccaagacctaggtanatactacaatcgaacncgactagaacgaacgcgacncggtactattattattacgtattacggttntaggttcggttaacgttcccggggacccgtacggggaccgtaaggggacccggtgggtacccaccgttcctacccgtacgaccggtccctaccgaacccgtacccgggg

SEQ ID NO: 136887 - DNA, 918 bp, Homo sapiens
  misc_feature: GYAE6OF01B4OGR.16.39.D06.1.454.CMB.1.raw
  modified_base (360)..(360): a, c, t, g, unknown or other
  misc_feature (360)..(360): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccagtggtagttttgctgtagtttgggttttccttgcttgtacttaagtttttaaaaggtgtaccgtagtgtagtaggttgttacgttgggtggagtcgtgggagggagtcgttcgacccgacgggtccggggggtcctgacgactcctcgtgtcgcgacgtccgttcggttcgggttcgaggtccgtaacaacgtaaacccaaccgtacggtagtagtggtccgggtcccnccgacgccgtaccggagggggacgggtcgtaggagtcgggtccttagtagtttaagtaagtaaaatcggagttaggagtaactaacgtaacgtacccgttaccgacccgtaccgtcgggttaacggacgggtaccgtactacccgaaccttactaccgtacccgaaggaaccaaccgttaacgttaaccgaaacggaacgtacgggtaataaactttaaccgaacttaaacgagaaacctaacggtaccgtaacggaaaaccgggaaacccggtaaccgggtaacccgtaaccggttaaccggttttaaaagtttacctttaaagggtttacgtttaaacgggttttaaggtttacggggtttagggggtttaaccgggtttaaacccgggtttccccgggggtaacccgggggtcccgggggttaaaccccggtaacgggggggttaaccccgggtttacccggttccccgggtaaccccccgttttacgtaccccccggtacgtttaaccccgccccccccggttaaaggtaaacccccccgggtaaacccggggg

SEQ ID NO: 136888 - DNA, 1152 bp, Homo sapiens
  misc_feature: GYAE6OF01EB3GH.16.39.D06.1.454.CMB.1.raw
tcagtgtactactccacgaccggtgctcgatttagtgacatctcgcagttctttgggggggagaggagcccagcactgggattccgaggtgtttccattcggtgatcagcactgaaccacagaggactcaccatgggtagtttggctgtaggttttcggttttccttgcttgtactttaaagtttttaaaaggtcgtccgtaggtggtggtagggttagtttacggtttgggtagggtacgttcggtaggggaagggtacggtcgttaccggacccggtaccgggggtccccggggggtccctaggacgtacccttcctccgttggtcgcgcgtccgttcggttgggttaccacggtccgtacgtaacgtaacccaaccgtacggttgtacgttcgggtccggggtccccaccggtaccgtcccggttaccggggaagggggggtacggggtacgtaggggtaacggttcgggttcctacgtttaaggtttaagttaaagggtaaaagtggtaaggttacggtaactaaaccgtaacgtaaccgttacccgaacccgggttacccggttaacccggtacccgggtttaaacgggggaacccggggtccctttaaccgtaacccccgttaaccgtaccgtttacccccgtaaaccggaacggtaaacccgttaaaacccgttaaaccccgttaaccgggaaaaccggtaaacccgggttaaaccggtttaaaccggtaaacccttttaaccgtaaaacgttaaacccgtaaacgttaaacccggtacccggtaaaccgtaaccgggaaacccgggtaaaccccgggaacccgggtaacccgggtaaacccgggtttaacttttaaagttttaccggtttttaaagggtttaggtttaaaacgggttttacgggggttttaaggtttaaaccggggggtttaccggggtttaaacccggggttttccccccggggggggtaacccccgggttaccggggggggttaaaaccccgggttaaccggggggggtttacccccgttacccggggttaccccccgtttaccccggttaccccggttacccccgttaaacccggacccccgttacccccccggtaaacccgggtaacccccgggttaaacccccgggggg

SEQ ID NO: 136889 - DNA, 714 bp, Homo sapiens
  misc_feature: GYAE6OF01EKW61.16.39.D06.1.454.CMB.1.raw
  modified_base (581)..(581): a, c, t, g, unknown or other
  misc_feature (581)..(581): n is a, c, g, or t
  modified_base (670)..(670): a, c, t, g, unknown or other
  misc_feature (670)..(670): n is a, c, g, or t
tcagtgtactactccacgaccggtgctcgatttagtgacatctcgcagttctttgggttttggggagaggagcccagcactgggattccgaggtgtttccattcggtgatcagcactagaacacagagactcaccatggtagtttggctgtagtttgggttttccttgctgtcttaagttttaaaggtgtaccagttgtggtaggttgttacgttgggtggtagttcgtgggaggaggtccttacggaccccgtacggggtccccgggggggttccctggacgtaccttcctccgtggtcgcgtacgtcccttggttcggttaccacgtccgtacgtaaacgtaaaccctaccgtaacggttgtaacgttgggtaccgggtccccgaccgaccgtaccgtaaccggggaagggggtaacggggcgtagggtaacgtcgggttacctacgtaagtctaacgaacgaagtcgtaagtacgtacggccagtagtggacgacaggtacctcggtagtaccgggttccttacaaccgtctacgacagaacactactaacaaacgacgtacgtcttagtattacganaatagaactgtcgtagagatacggagacctagtaacctattactacgttcgagtcgtacggaggtacggtaggttgggtaggtcggtancggttacgttagtacgttagacggttgggacccggtaacccggg

SEQ ID NO: 136890 - DNA, 785 bp, Homo sapiens
  misc_feature: GYAE6OF01CPO0S.16.39.D06.1.454.CMB.1.raw
tcagtgtactactccacgaccggtgctcgatttagtgacatctcgcagtttctttgggttttggggagaggagcccagcactgggattccgaggtgtttccattcggtgatcagcactgaacacagaggactcaccatggtagttttgctgtagtttgggttttccttgctgtacttaagttttaaaggtgtccaggtgtggtaggttgttacgttggtggagtcgtgggaggaggcttacggacccgacggggtcccggggggtcctgacgtaccttctccgttggtcgccgacggtccgttcgtcggttcacggtcgtacgaacgtaaccaaccgtacgtagtagtcggtcggtcccgccgtacgtcccgtacggaaggggacgggtacggtaggtaacgtcgggtctacgttaaggtttaataaggtaaagtggagttggtacaactaacgtaactccgtaccgaccgtaccgtcggtaacggacggtcgtactacgacctacgtctacgaagtaactaacctaacgttaaccgaaacgaaaccgtagggttaactaaacgttacgtaacaaagttaccgaacgtacgtaccgaacggaaccgaaccggtaacggaaccgtacggttaacttagttactttagttagttaagttagttaggttacgggttacggttaccgggtccgggtaccccggtacggggaccgttaaccggggtccggtaccgttcccgtacccgttaccgtcccgtaccgacccggtccccgtaaccgaaccccggg

SEQ ID NO: 136891 - DNA, 671 bp, Homo sapiens
  misc_feature: GYAE6OF01B2IVG.16.39.D06.1.454.CMB.1.raw
  modified_base (386)..(386): a, c, t, g, unknown or other
  misc_feature (386)..(386): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaggtgtccagtgtgagtgtacttggtggagtcgtggaggaggtcttgaccgaggtccggggggtccctggagactctccgtgtgcgtagccgtcgtggttcagtcgtacaacgtaaccaacctagtgagtggtcggtccgccgacgtcctccggaagggagggtcgtaggaagtgggtctcgtagttatagaaatgtagtggagacanaacgtcgtacgaccgtacgtcgtacgaacggtccgtactcacctctaccgtacgagaacgtacctaacgttaccgaaagaaccgtacggtaactaagttaccttagaaacgtagaaactcgacctaaggacgtaaaccgacggaccgaaccggtactagttagttacgttagtaagttaggttagtacgggttacggtacggttcccgggacccggtcggggaccggtaagggtacccgtggtacccgtacccgtcgtccctacgcgtcccgaccgtaaccccgg

SEQ ID NO: 136892 - DNA, 799 bp, Homo sapiens
  misc_feature: GYAE6OF01ED2QL.16.39.D06.1.454.CMB.1.raw
  modified_base (187)..(187): a, c, t, g, unknown or other
  misc_feature (187)..(187): n is a, c, g, or t
  modified_base (223)..(223): a, c, t, g, unknown or other
  misc_feature (223)..(223): n is a, c, g, or t
  modified_base (414)..(414): a, c, t, g, unknown or other
  misc_feature (414)..(414): n is a, c, g, or t
tcagtgtactactccacgaccggtgctcgatttagtgacatctcgcagttctttgggttttggggagaggagcccagcactgggattccgaggtgttccattcggtgatcagcactgaacacagaggactcaccagtggtagtttggctgtagtttggttttcctgctgtacttaagtttaaaggtntaccgagtgtggagtgttacgttgggtggtagtcgngggaggaggtccgttcggacccggacggggtcccggggggtccctaggacgtccttccgtccgtgcgacgtcgtccgttgttcgggtcacgtcgttacgaacgtaaccgaaccgtagtggtagtcggtccgggtccgaccgtacggtacccgacgggtaaggggtaacgggtcgtacggaggtttcgggtnttaccgttaagttacgtaacgtaaagtgtagtggaactacgactaacgtccgtaccggaccgtacgtcggtaggacggtacctacgtaccactactaccgacgtaacgacgtaacaacgtacgaaacgtacgtacgtataacctacgtaactacgacaacgtaccgagtaacggaacggacggtaacggaccgtaaacgttccggttaattaggtttactagttaaaggttggtttacggttacgggttaccggttaccgggttaccccgggtaccgggttaccgggggtccccggtaaaagggggttcccgttaccccgggtaccgtaaccggttccccgttaaacgcccgtttaaccgtacccggaacccgttaaacccgggg

SEQ ID NO: 136893 - DNA, 1072 bp, Homo sapiens
  misc_feature: GYAE6OF01C896L.16.39.D06.1.454.CMB.1.raw
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagtttgggttttccttgctgtctaattttaaaaggtgtccagtgtgaggtgtacttggtggagtctggaggaggcttgaccccgaggcccggggggtccctgagacctctccgtgtcgcacgtccttacgtggggttccaggtccgttaccgaacggttaaaacccaaacccgtacgggttacggaagttcgggttcgggggttaccccgaccccgtaacggtacccccggttacccggaaggggggtaaaccgggggtcgttaacgggggaaacgtttcgggggttaccttaccggtaaagggttttaacgttaacggtaaaaaagtgggtaaacggtagggttaccggtaaacgaaaccgtaaacgttaccggtaacccggtacccggtaaccgttacccgggtaacgggtaaacgggtaccccgttaagttacccgaaccgtacttacccgtaaccgaaacggtaccgtaaaccgtaaccgtttacccgaaaacggtaaccgaacgggttagtaaaaccgttccgtttaaacgaaacgttacgaaaccgtaccgtaccggttaaaggtaacccgaaaccgggtaaccgggaaccgttaaccggggtaccccgtttaaaagtttacggttttaaacgtttaacgggtttaaacgttacgggggtttttaaacgtcgggggtttttaaacccggttaaaacccggggttttccccggggggttaacccccccgggtttaacggggggggtaaccccccggtttaaaaacggggggggtttaaaacccccccgggttcgggggttttaacccccccgggtaaacccccccggttttaccggtttaacccccgggtttaacccccgggttaacccccgggtaaccccccggtttaaaccccccgtaaaaaccccccggggggg

SEQ ID NO: 136894 - DNA, 827 bp, Homo sapiens
  misc_feature: GYAE6OF01CNKR0.16.39.D06.1.454.CMB.1.raw
  modified_base (187)..(187): a, c, t, g, unknown or other
  misc_feature (187)..(187): n is a, c, g, or t
  modified_base (575)..(575): a, c, t, g, unknown or other
  misc_feature (575)..(575): n is a, c, g, or t
tcagtgtactactccacgaccggtgctcgatttagtgacatctcgcaggttctttgggttttggggagaggagcccagcactgggattccgaggtgtttccattcggtgatcagcactgacacagaggactcacatggagttttggctgagttgggtttccttgctgctatttaaaggtgtcagtgngaggtgtacgttggtggagtctggaggaggcttgacccaggccgggggggtcctgaggactcgtcctgtcgcagccttcgtacgggttacacggtacgttacgaacggttaaaaccaccgaacggtggtagtacggtacgggtccccgaccgacggtccccgtaccggtagggggaacggggtcgtacgggaacgtcgggggttatacctaaggtttaaattaggaaaatggaagtggttacgaacgtactaagtaccgttaccgccggtaaccttccgggtaggaaacgggggccctaactttccgaaccctacgttccgttaccgaacgtaacggacctaactttaccgaaacgtaaaccgtacgggttaataaactccgtttaanaaacggttacgaaacgtacggtacccgttaaggaaaccggtaaaccgtaacggggaaaccgtaacccggggtacgttaaacgttacgtttaagttacggtaacggtttacgggttaagttgggggttacgggtaaaccgttccggggtccccggtacgggggtacccgtaacggggtaccccggttagggttacccgtaccccgggttacttacccgtccggtaaccggccccgttaaccggaaaccccggg

SEQ ID NO: 136895 - DNA, 1005 bp, Homo sapiens
  misc_feature: GYAE6OF01BS52P.16.39.D06.1.454.CMB.1.raw
tcagtgtactactccacgaccggtgctcgatttagtgacatctcgcagttctttgggttttggggagaggagcccagcactgggattccgaggtgtttccattcggtgatcagcactgaacacagaggactcacatggtagttttggctgtagttggttttccttgctgtacttaagtttaaaggtgtccagtgtgaggtgtacttggtggtagtcgtgggaggtaggcttacgaccgacgggcccggggggtcctggtacgactcctccgtgtcgcgtacgtccgttcgtcgggttaccgacggtccgttacgtaaccgtaaaaccgtaaacccgtacggttacggtaggttcgggtccggggtaccccgacccgtaaccggtccccgtaccggggaacgggggtaaacgggggtccggttaagggtaacggttcgggttaccgtacggttaagttttaaggttaaaggtaaaagttcggtaagttacgggtaacgtaaaccgtaactaaacgttaccgtaacccggtacccgtaaccggttaccggggtaacggtaaccggggtaccgtaacgttaccctaacccgtactacccgtaaccggagtaacggtaacctaaaccgttaccgaaaaacggtaaacccgtaacggggttaccgtaaaaacttccgttaaacgtaaaacgttaccgaaaaccggttaccgtaaccgtaacggaaaacggaacccgggtaaaccggaccgtaaccgggttaacccgtttaaatttaacgttttaaggtttaacgtttaagggttaaacgggttttacggtttaaacggggttaaccggtttaccccgggtttaccccgggggtacccccgggggtttacggggaaccccgggttaaacccggggttaaacccgggtttcccggttaacccggtaaccccccggttttcccgtaccccgtaaaccgggtaccccccggtttaccccggtaaacccccgtaaaccccggggg

SEQ ID NO: 136896 - DNA, 869 bp, Homo sapiens
  misc_feature: GYAE6OF01CJGT7.16.39.D06.1.454.CMB.1.raw
  modified_base (301)..(301): a, c, t, g, unknown or other
  misc_feature (301)..(301): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagttttggctgtagtttgggttttccttgctgtacttaagttttaaaaggtgtccagtgtgtaggttgtacgttggtggagtcgtggaggaggtcgttcgacccgacgggtcccggggggtccctggacgaccttctccgtgtcgcgacgtccttcgtcgggttacncggtccgtacaacgttaaaccaaccgtacggtaggtacgttcgggtaccggggtccctaccgaccgtcccgtaccgggaacgggggaacggggcgttagggaacgttagggtcctacggttaaggtttaagttaaggtaaaaacgttggaaggttcgggtagtaaccgtaaacgtaaaccgttacccgtacccgggaacccggttaaccgtccgggtaacgggaaccgggtaccgtacttaaccgtaacctaacgtcccgtaaccgagaactaacccgttaaacgtaacccgtaaacgtaaccgtaacggtacgtaaacttaccgttaactaacgtaacgtaaacgacgtaccggtaacggaaacggtaacccgggaacggtaacccgtaaccgggtacccgttaattaacgtttaagttacgttaagtttagggttacgttagggttacggttaccggttcccgggtacccgggtacggggtacccgtacggggttaaccgtccggttaccgtacccgttacccgtccgtaccgtacccgtcccctacccggaaccgtaaccccggg

SEQ ID NO: 136897 - DNA, 973 bp, Homo sapiens
  misc_feature: GYAE6OF01B62XY.16.39.D06.1.454.CMB.1.raw
tcagtgtactactccacgaccggtgctcgatttagtgacatctcgcagttcgtttggggggagaggagcccagcactgggattccgaggtgtttccattcggtgatcagcactgaacacagaggactcaccatggtagttttggctgtaggtttgggttttccttgtctgtacttaagtttttaaaaggtcgttccaggttgtaggtagggttacggttacgtttggggttgggtaggttcgtggggagggtacggtccgtttacggacccccggacgggggtaccccggggggggttcccgtaggacgtaccgttccgttcccgttggtcgacctaccggtcccgttcggttcggggttaccgtaggacccggttacgaaaccgtaaaacccgtaacccgtaccggttaggttaacggttcggggttccgggggttcccccggacccgtacccggtaccccggtaccggggaacgggggggaaccgggggttccggtaggggttaaccggtttacggggtttccgttaaccggttaaaggttttaaggttaaagggtaaaaacgttgggtaaggttacgggtaacgtaaccgtaaactaacgttacccgtaaccccgggtacccgtaccgttacccgggtaacggaaccgggtcctaaccgttaccaaccgttccgtacccttaccgaacgtacgtaacctaaaccttaaccggaaacggtaaccgtacggttaagtaacttaaccttaagaaactcggaaaacctcgtaccgtaaggaacccggtaacggaaccgggcctaggttaaccttattaagttttaggtaagttaacgttagggtttacgtacggggttcgtaccggggtttccccggccgggtacggggacccggttaacgggttcccgggtcgttacccggtcccgtttacgccctaaccgtacccgcccgttaaacccgaacccggtaccgg

SEQ ID NO: 136898 - DNA, 832 bp, Homo sapiens
  misc_feature: GYAE6OF01DPH1K.16.39.D06.1.454.CMB.1.raw
tcagtgtactactccacgaccggtgctcgatttagtgacatctcgcagttctttggggggagaggagcccagcactgggattccgaggtgtttccattcggtgatcagcactgaacacagaggactcaccatggagtttggctgtagttggttttccttgctgacttatttaaaggtgtcagtgtgagtgtacgttggtggagtcgtggaggacggcttcggacccgagggcccggggggtccctggacgtacctcctccgtgtcgctacgccgtcgttcgggtcacggccgttactaacggtaaccaaccgtacggttgtagtcgggtcggtcccgccgacgtccgtacggaaggggtaacgggctaggaacgtcgggtactacgtaagttagttagaaaagtcgtaagttcggacgtactaactaacgtacctaacgcccgtaacgtccggtaagggaaccggtcccgtatacccgacctacgttacctaaccgaagaacgtaaaccgtacttaaccgaaaggaaccgtaaggttactaacgttactaaacgaagtacgaaaccgtcgtaccgtaaggaaacggtaacccggacggaacgtacccggtacggtttaatttaaccgggtttaattagggttaaccgtttaaggggttttagtacggggtttaaccggtttaccgggttaccccgggggtaccccggttacgggggtaaacccggttaaacccgggggttaacccggttcgggttaaccccgttaccccgttcccgttacccgttaacgaccccggtaacccccttacccggaacccgggtaaaccccgggg

SEQ ID NO: 136899 - DNA, 912 bp, Homo sapiens
  misc_feature: GYAE6OF01CWE1V.16.39.D06.1.454.CMB.1.raw
tcagtgtactactccacgaccggtgctcgatttagtgacatctcgcagttctttgggggagaggagcccagcactgggattccgaggtgtttccattcggtgatcagcactgaacacagaggactcaccatggagtttggctgtagttggtttccttgctgcttaatttaaaaggtgtccagtgtgaggtgtacgttggtggagtcgtggaggaggcttcgacccgaggccggggggtccctgacgactctcctgtgcgagtctgtggtcagtcgtacagtaaccaaccgtacgtgacgtggtcggtcccgccgacgtcccgtaccggaaggggaaggggtccgtagggtaacggtcgggttctacgtaaggttttaagtaaggaaaaattggtaaacgtggggtactaaacctaaccgtaaacgttaccctaaccggacccgtaccgttaccccgggtaacgggaaacggggtccccgttaaactttaccccgaaacccgttacgttaacccgtacccgaaacggtacgtaaaccttaaaccgttaacccgaaaacgaaaccggtaacgggttaaactaaactttaacccgtttaaacaaaaacgtttaggaaaacccgtaacgtaccccggttaaagggaaacccgggtaaaacccgggtaaccgggaaccggttaaccggggtaaacccgtttaagtttaaccgttttaaagttacgggtttaaagttttaaccggggttaagttacggggttacggttttaaacccgggccccggggttaccccggtaaccgggggaacccgggtaaccggggttaaacccggttcgggttaccccgttaaccccggtacccgttaccccggtactacccgggtaccccctaacccggtacccgggtaaaaccccggg

SEQ ID NO: 136900 - DNA, 740 bp, Homo sapiens
  misc_feature: GYAE6OF01CCRG5.16.39.D06.1.454.CMB.1.raw
tcagtgtactactccacgaccggtgctcgatttagtgacatctcgcagttctttggggggagaggagcccagcactgggattccgaggtgtttccattcggtgatcagcactgaacacagaggactcaccatggagttttggctgaggtttgggttttccttgctgacttaagttttaaaaggtgtaccagtgtggaggtcgtacgttggtaggagtcgtaggaggaggtcttcggacccgagggccggggggtcctggacgacctctccgtgtgaccgagccttcggtagggttcacggtcctacgaacgtaaacccgaaccgaggttgaagttcggtcggtcccgacccgtacgtaccctacgggaaggggaagggcgtaggaagtcgggtactcgtaagttaataagtaaaagtggtagtaggtacgaaccacgaactaccgtacgaccgtacgtccgtaggacggctactacacactccacgaacgagtaactaactaccgaaacgaacgtagtagaacttacgtaacaaagacgtaaccgacgtacgtacggaacgaaccggaagacgaaccggttaactagttattacgttaagtacggttaagttagtacgggttacgttaacgtccccgggaccggtacgggtaccggtaaccggtaccggttccgtacccggtaacccttcccgtacccgtaacgtacccggtacccctacccggaacccgtaaccccggg

SEQ ID NO: 136901 - DNA, 799 bp, Homo sapiens
  misc_feature: GYAE6OF01ATUXZ.16.39.D06.1.454.CMB.1.raw
tcagtgtactactccacgaccggtgctcgatttagtgacatctcgcagttctttgggttttggggagaggagcccagcactgggattccgaggtgtttccattcggtgatcagcactgaacacagaggactcaccatggtagtttggctgagttggttttccttgctgcttaattttaaaaggtgtccagtgtgaggtgtacgttggtggagtcgtgggagggaggtcgttcggaccccgacgggtcccgggggggtccctggacgtactccgtccgtgtcgcacgccttgtcgggttcaggcgtcgaacgtaaccaaccgacgtgatcggtcgggtcccgtccacggtcccgtccggaaggggaagggcgtggagttcgggtctacgtagtttattagaaaattcggagtggtacgactaacgaactccgtaccgaccgtaccgtaccggtaggaacgggcccgtacttaccgaccctactacccgtacgagaacgaacgtaacgttaaccgaaacgtaaaccgtaacgggttataaactttaccttaagaaaacgtacgaaaccgtacgaccgtaacggaaaccggaaccggaacgggaacccgtaaccgggtaccgttaaattagtttaacgtttaggttaacgtttagggttaacggttaggggttacggtttaaaccgggttccccggggtacccggtacgggggtacccggtaacggggtaaccccgttacgggtacccctaacccggttcccgtaccctacgacccggtaccccgtacccgtaaaccccggg

SEQ ID NO: 136902 - DNA, 784 bp, Homo sapiens
  misc_feature: GYAE6OF01A0BH2.16.39.D06.1.454.CMB.1.raw
tcagtgtactactccacgaccggtgctcgatttagtgacatctcgcagtttctttgggttttggggagaggagcccagcactgggattccggaggtgtttccattcggtgatcagcactgaacacagaggactcaccatggagttttggctgagttgggttttccttgctgctattttaaaggtgtccagtgtgaggtgtacttggtggatctgggaggaggtcttgacccaggcccgggggggtccctggagacctctccgtgtgcagccctcgtggttcagcgtcagtaaccaccacggtgactggtcgggtcccgccacgccccgtaccggagggggaagggtccgtagggtaagttggggtctacgtagtttaagttaggaaaaattgaacggttggtagaaccaacaaacttcccgtaaccgcccggtaaccgttcccgggtaggaaaccggggtcccgtaattaaccgaacccgtattaccccgttaccgaacggtaacgtaaaccctaaaccgtttaccccgaaaaggtaaaccccggtaaccggtaagtaaaccctttaccgttaactaaaagttcggaaactaccggtaccctagggaaccggtaaacccgaaggaccgtaccgggtaccgttaatttaacgtttagtttacgttagtttaaggttattacgggggttaagttaaccggtcccgggtacccggtggggacccgtaggggtaccctggtacctacccggtcgttcccgtacaacccggccctaaccgtaaccccgg

SEQ ID NO: 136903 - DNA, 872 bp, Homo sapiens
  misc_feature: GYAE6OF01D1TD5.16.39.D06.1.454.CMB.1.raw
  modified_base (534)..(534): a, c, t, g, unknown or other
  misc_feature (534)..(534): n is a, c, g, or t
tcagtgtactactccacgaccggtgctcgatttagtgacatctcgcagtttctttgggttttggggagaggagcccagcactgggattccgaggtgtttccattcggtgatcagcactgaacacagaggactcaccatggtagttttggctgtagtttggtttttccttgtctgtacttaagttttaaaaggtcgtcagtgtagtaggttgtacgttggtggtagttcgtaggtaggacggtcgttcgaacccgtacggggtccgggggggtcccctgacgtaccttccgtccgttagcgcgtacgtccgttcgtcggttccgacgtcgtacgtaacgtaacctaaccgtacgtagtacgtcggtcggtacccgccgtacgcccgtaaccggaaggggaacggggtcgtagggtaagttcgggtacttacggtagtttaagttaaagtaattaggtgtacggtacgtaacgtaactaacgtctaccgaccggtacgtaccggtacggaacggtccgtagttacctaacccgtanacccgttaacgacgtaacgtacctaaaaccgtacgtaaaaccgaacggttacgtaaacgttaaacgtttaccgtaaaccgtaaagtacccgaaacggtaccaccgtaaagggaacccgaaaccggtaacccgggtaacgttaaacccgggtactttaaaccgtttaaggtttacctttaagggttaactttaggggttaaccggtttagggtttaaccgggtacccgttcggggacccccggttaggggggaaccccgtttacggggtaaccgggtttacgtccccgtaaccggtttccctacccggttaaccaccgtaccccggtccggaaacccgg

SEQ ID NO: 136904 - DNA, 856 bp, Homo sapiens
  misc_feature: GYAE6OF01A3RUK.16.39.D06.1.454.CMB.1.raw
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttggttttccttgctgctatttaaaggtgtccagtgtgaggtgtacgttggtggagtctggaggaggcttcgacccgaggcccggggggttcctggagtactcctccgtgtgcagtcctcgtcgggttcacggtcgtacaagtaaaccaaccgtacgtggagttcggtcggggtacccgccgaaccggtccctacccgggaagggggaacgggggtccgttagggaaacggtttcgggggttacctaccgttaaagggttttaacgttaacggtaaaaagttcgtaaggtttacgggtaacgaaccgtaaaccgtaaacgtacccgtaaacccgggtaccccgttaacggtaccccgggttaagggaaaccggggtaccccgtaacgtttacccgaacccgtacttacccgtacccaagggtaaccgtaaccctaaacgttaaccccaaaggaaccgtaaccgggttagtaaaacttccttaacgtaaatacgaaaccgtacgaccttacgggaacgaaccgggaacggaacgtaccggtacctaagtttactttagttacgttaaggttaggttagttagggttaaccgttaggttccccggggtacccggtacgggggaacccgtaacgggttacccgggtcgttaccccgtacccggttccgttaccctcggtaacccgtcccgtaccccggaaccgtaccccggg

SEQ ID NO: 136905 - DNA, 808 bp, Homo sapiens
  misc_feature: GYAE6OF01CK86S.16.39.D06.1.454.CMB.1.raw
  modified_base (235)..(235): a, c, t, g, unknown or other
  misc_feature (235)..(235): n is a, c, g, or t
tcagtgtactactccacgaccggtgctcgatttagtgacatctcgcagtttcgtttggggggagaggagcccagcacgtgggattccggaggtgtttccattcggtgatcagcactgaacacagaggactcaccagtggtagtttggctggtagtttggttttccttgctgtacttaagttttaaaaggtgtcctagtgtggtaggtcgttagttgggtggagtcgtagggaggnggtcgttacggacccggacgggtccgggggggtccctaggacgtacttcgtccgtgtcgcctacgtccgttcgtacgggttcgacggtcgtaacgaacgtaaaccgaccgtacggttagacgttcgggtcggtcccgcgacgtcccgacggaaggggacggtcgtaggaagttcgggtctaacgtagtttaagtaagtaaatcgggtagttggacaacctaacgtaactaccggtacgacccgtaacgtcggtacggaacggtcctaatcccgactacaccgtaccgaaggtactaacctaagtacccgaaacggaaccgtagtaaccgtaaacttacctaaagaactacgaacgtacgtacccgaagggaaaccgtaaccggacgtaaccgggtaaccgtacgttttaaagttaacgtttagtttaggtttaaaggttacgggtaaggtttcgggttaaacggttacccggttccccggggtacgggtccggggtaacgtaaccggggtaccggttgtaccccgcgtttccgtaccccgactacccggtacccaacccggtacccggtccgg

SEQ ID NO: 136906 - DNA, 553 bp, Homo sapiens
  misc_feature: GYAE6OF01E0GPI.16.39.D06.1.454.CMB.1.raw
  modified_base (362)..(362): a, c, t, g, unknown or other
  misc_feature (362)..(362): n is a, c, g, or t
  modified_base (453)..(453): a, c, t, g, unknown or other
  misc_feature (453)..(453): n is a, c, g, or t
  modified_base (482)..(482): a, c, t, g, unknown or other
  misc_feature (482)..(482): n is a, c, g, or t
  modified_base (539)..(539): a, c, t, g, unknown or other
  misc_feature (539)..(539): n is a, c, g, or t
tcagtgtactactccacgaccggtgctcgatttagtgacatctcgcagttctttggggttttgggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccagccgggggggtccctgagactctcctgtgcagcctctgggttcagcgtcagtaacaaccacgtgatgtgggtccgccaggcctccgagggaagggggctggaatgggtctcagttatgaaaatgatggtnacacaatctacgcgactccgtgaaagggccgattcaccatctccagagacaattccaagaacacggtgaatcttcaaatgaacagcctganaaccgaggacacgccgtatatattgtaanaggttatggtggtaatcgggcccctggggaccagggaccgtgtacaccgtctcctanacgccctccaaccg

SEQ ID NO: 136907 - DNA, 768 bp, Homo sapiens
  misc_feature: GYAE6OF01B8N8D.16.39.D06.1.454.CMB.1.raw
tcagtgtactactccacgaccggtgctcgatttagtgacatctcgcagttctttggggggagaggagcccagcactgggattccgaggtgtttccattcggtgatcagcactgaacacagaggactcaccatggtagttttggctgtagtttgggttttccttgctgtacttaattttaaaaggtgtccagtgtgaggtgtacgttggtggagtcgtgggaggaggcttcgacccgagggcccggggggtccctgacgactctcctgtgtacgcctcgtggttcagcgtacaacgtaaaccaaccgtacgtgtagtggtcgggtacccaccgacgcccgtaccggaagggggacggggcgtagggaagtcgggtctacgtagttagttaagaaatgagtgtacgacactaatccgtaccgaccgtaccgtccggtaggaacgggcctattaccactactccctacgagaacgaacctaacttaaccgaaagtaacgacggttagtaaacttccttaaacgaaagtcgaaaccacggtaccgtaggaacggtaacccggaaggaacccgaccgggtacttaaattacgtttaagtttacggtaaaggtttacgggtttaaggttaccggggttaacggttaacccgggttccccggggtaccccgggttagggggaccgtaaggggtaccttcgggtacccggttaccccgtacccggttctaccccgtacgaccccgtcccccgtaaccgaacccgggtaaccccggg

SEQ ID NO: 136908 - DNA, 662 bp, Homo sapiens
  misc_feature: GYAE6OF01B8USG.16.39.D06.1.454.CMB.1.raw
  modified_base (186)..(186): a, c, t, g, unknown or other
  misc_feature (186)..(186): n is a, c, g, or t
  modified_base (220)..(220): a, c, t, g, unknown or other
  misc_feature (220)..(220): n is a, c, g, or t
  modified_base (252)..(252): a, c, t, g, unknown or other
  misc_feature (252)..(252): n is a, c, g, or t
  modified_base (468)..(468): a, c, t, g, unknown or other
  misc_feature (468)..(468): n is a, c, g, or t
  modified_base (489)..(489): a, c, t, g, unknown or other
  misc_feature (489)..(489): n is a, c, g, or t
  modified_base (498)..(498): a, c, t, g, unknown or other
  misc_feature (498)..(498): n is a, c, g, or t
  modified_base (504)..(504): a, c, t, g, unknown or other
  misc_feature (504)..(504): n is a, c, g, or t
  modified_base (519)..(519): a, c, t, g, unknown or other
  misc_feature (519)..(519): n is a, c, g, or t
  modified_base (526)..(526): a, c, t, g, unknown or other
  misc_feature (526)..(526): n is a, c, g, or t
  modified_base (558)..(558): a, c, t, g, unknown or other
  misc_feature (558)..(558): n is a, c, g, or t
  modified_base (647)..(647): a, c, t, g, unknown or other
  misc_feature (647)..(647): n is a, c, g, or t
tcagtgtactactccacgaccggtgctcgatttagtgacatctcgcagttcgtttggggggagaggagcccagcactgggattccgaggtgtttccattcggtgatcagcactgaacacagaggactcaccatggtagttttggctgtagtttgggttttccttgactgcttaagttttaaaggtntcagtgtgaggtgtacgtggtgagtcgtggaggnggtcttcgacccggaggcccgggggggttccnggtacgtacctccgtcctggcgacgacgtccgtcgttacgggttcgaggcgttacaggtaaaaccaccgacggtgagttcggtcgggtaccgccaacggccgtaccggaggggaagggctagggaacgtgggtctacgtagtttatacggtaaaatggtatcggtagactacaatcaccgccgtactcggagtacggccatccacatcctacaganactaacacaagaacacggtanaattctaanaactanaacctagctaggaanaccgganacgacgtctaagtactgttatacgtaggttancggtaggttaccgtccggacccggtacgggtaccggacgggtaacgttccggcccgtttaacccgcgtcctacgacccgtaccccgtanacccggtaaccccgg

SEQ ID NO: 136909 - DNA, 904 bp, Homo sapiens
  misc_feature: GYAE6OF01AQR3Q.16.39.D06.1.454.CMB.1.raw
tcagtgtactactccacgaccggtgctcgatttagtgacatctcgcagttctttggggggagaggagcccagcactgggattccgaggtgtttccattcggtgatcagcactgaacacagaggactcaccatggtagttttggctgtagttgggttttccttgctgtacttaagttttaaaaggtgtccagtgtgaggttgtacgttgggtggtagtcgtgggaggaggtcgttcgacccggtaggggcccgggggggtcctggacgtaccttctccgtggtcgactaccggtccttcggttcggggttccacggtcggtaccgtaaacgtaaaccgaacccgtaggtacgtacgttcggggtcgggtccccgacccgtaccggtcccgtaaccgggaggggggaaacgggtcgtagggtaaggttcgggttacctagttaaggtttaacgttaaaggtaaaagtggtaaggttacggtacaaaccgtaacgttaacgtaccccgtaacgggtaccccgtaaccggttacccggtaacggggtaaaccgggtacccgtaacgttaacccgtacccgttaacttcccgttaaccgaacgtaaccggtaaacctaaaccggttaacccaaagggtaaccccggtacggtttaaactacctttaaccgtaaacgtaaggttaacccgaaacggtccgtaaccgtaacgggaaaccgaaccgggtacgaaccggtaccgggttacttaaagtttacgttagtttacgtaaggttacggttacgtacggttacgggttaccgtcccggggtaccggtacgggtacccggtaacgggtacccgttccggacccgtaccccgttacgttacccggcctaaacggtcccctaaacccggtcggtaacccggg

SEQ ID NO: 136910 - DNA, 733 bp, Homo sapiens
  misc_feature: GYAE6OF01ES0UE.16.39.D06.1.454.CMB.1.raw
  modified_base (506)..(506): a, c, t, g, unknown or other
  misc_feature (506)..(506): n is a, c, g, or t
  modified_base (712)..(712): a, c, t, g, unknown or other
  misc_feature (712)..(712): n is a, c, g, or t
tcagtgtactactccacgaccggtgctcgatttagtgacatctcgcagttctttgggggggagaggagcccagcactgggattccgaggtgtttccattcggtgatcagcactgaacacagaggactcaccatggtagttttggctggtagtttgggttttccttgctgcttaatttaaaggtgtcagtgtgaggtgtagttggtggagtcgtgggaggaggtcgttcggacccgacggggtcccgggggggtccctggacgtaccgttctccgtggtcgcacgtccgttcgtggttaccagtcgtacgaacgtaaaccaaccgtacggtagtagttacggtcgggtccccgaccgacggtcccgtaccggaagggggaacgggtcgtaggagttcgggtactcgtagttatagaaagtgagtggtacacactaacgtcgtacgccgtacgtcggtaggaccgctactccactatcacgagacactaacacgaagaacgacgtaanaacttactaacaagtacgtaacgcgtacgtaaggaaccgacggaagaccggtaccggtacttattacgttaagttcgttaagttaggttacggttagggtacggtttaacggtccccggggtaacccgggtcggggtaaacccgtaaggggttccccggtagtaccccgtaccggttcccgttccccgtaacacccggttaccccnccggaacccgggtaaccccgg

SEQ ID NO: 136911 - DNA, 880 bp, Homo sapiens
  misc_feature: GYAE6OF01DZRS6.16.39.D06.1.454.CMB.1.raw
tcagtgtactactccacgaccggtgctcgatttagtgacatctcgcagttctttggggggagaggagcccagcactgggattccgaggtgtttccattcggtgatcagcactgaacacagaggactcaccatggtagttttggctgtagtttgggttttccttgctgcttaattttaaaaggtgtccagtgtgaggtgtacgttggtggagtcgtgggaggaggtcgttcgacccgacgggcccgggggggtccctgacgacctcctccgtgtgcacgtccgtcgttgggttcacgtcgtacgtaacgtaaccaaccgacggtagtagtcggtcgggtcccgccgacgtcccgtaccggagggggacggggcgtaggtaacgtcgggtctacgtaagtttattaaggaaattggagttaggtacaaccgtaactaacgttaccgtaccgacccgtaccgtaccggtaacggaacgggtccctacgttacccaacctacctaccgtaaccgaacgtaacgtaacctaaaccgtttaacccgaaaacggttaaacccggtaaccgggttaataaacccgtttaccgttaaaaccgtaaaacgttaaccggaaaaccccgtacgtaacccgggtaacgggaaaacccggtaacccgggaaaccggggtaacccgtaaacccgggttaccgtttaaatttaacgtttaacgttttaggttaaacgggtttagggtttacggttaggggttaaccgggttaaccggttcccccggggtccccgggtaagggggaccccgttaaacggggttacccggtccggttacccgtacccgttcccgttacccgacacccggtccccctaaccggaacccggtaacccggg

SEQ ID NO: 136912 - DNA, 810 bp, Homo sapiens
  misc_feature: GYAE6OF01EGGIU.16.39.D06.1.454.CMB.1.raw
tcagtgtactactccacgaccggtgctcgatttagtgacatctcgcagttctttgggttttggggagaggagcccagcactgggattccgaggtgtttccattcggtgatcagcactgaacacagaggactcaccatggtagttttggctgtagtttgggttttccttgctgtcttaagtttaaaggtgtccagtgtgaggtgtacgttggtggagtcgtgggaggaggtcgttcgacccgacgggcccggggggtccctggacgtaccgtcctccgtgtcgccacgtccgtcgtcgggttacacgtccgtacaacgtaaaccaacccgacgttggtaagtggttcgggtcccgccgtacggcccgtccggaaggggacggggtacgtgggtaagtcgggtccttcgtaagtttattaacggtaaaagtggtagttggtaacgacgaactaactccgtacccgcgtacgtccggtaggaacgggtacctagttacccaacctactccgtaccagaacgtaacctaacgttaccgaaacgaaccgtaacggtataacgttacttacgtaaacgtacgaaacccgtacgtacccgtaggaaaccggaaccggaacggaccggtaacggttacccggttaatttaacgtttacgtttagtttaaggttacggtttaggttacgggttacggttaccgggttacccgggtacccgggttaccgggggtaccggtaaccggggtacccggttcgggttaccccgacccggttccgtaccccgtaccgacccgttccccgtacccgtaaccccggg

SEQ ID NO: 136913 - DNA, 850 bp, Homo sapiens
  misc_feature: GYAE6OF01BXFAD.16.39.D06.1.454.CMB.1.raw
tcagtgtactactccacgaccggtgctcgattttagtgacatctcgcagtttcgtttgggggggagaggagcccagcactgggattccgaggtgtttccattcggtgatcagcactgaacacagaggactcaccatggtagttttggctgtaggttttggggttttccttgcgtgtactttaagtttttaaaagggtcgtaccgtaggttggtaggtagggttgttacgtttggggtaggtaggttcgtggggagggacggtccgttacggaccccggtacgggggtccccgggggggttccctggacgtaccttccgttccgtgtcgcgacgtcccgttcggttcgggttcccgcgtacgaacgtaaccaaccgtacgtgtagttcgggtccgggtcccgccgtaccggcccgtaccggggaaggggggaacggggttacggtaggggtaacggttcggggtccttaacggttagttttaaggttaaagaaaagttggtaggtaggtaacgaactaactaacttaccgtaccggacccggtacccggttacggtaacgggaaccgggtacctacgtacccaccgtactaccgtaccgacggaactacctaacgttaccgaaacgtaacggtacgtaataccttacttaacaagtacgaacacgcgtagaaccgaacggacgaaccgacggtataatttagttattggttaagttaggttagttacgggttacggttaccggtcccggggtcccggtacggggtacccggtacgggggtacttcccggggccttacccggtacccttccgccgtacccgtaccccgacccgacccggtaacccggtcccg

SEQ ID NO: 136914 - DNA, 835 bp, Homo sapiens
  misc_feature: GYAE6OF01DF5UE.16.39.D06.1.454.CMB.1.raw
  modified_base (221)..(221): a, c, t, g, unknown or other
  misc_feature (221)..(221): n is a, c, g, or t
  modified_base (811)..(811): a, c, t, g, unknown or other
  misc_feature (811)..(811): n is a, c, g, or t
tcagtgtactactccacgaccggtgctcgatttagtgacatctcgcagttcgtttggggggagaggagcccagcacgtgggattccgaggtgtttccattcggtgatcagcactagaacacaggacgactcaccagtggtagttttgctaggtgtttcggtttcctgctgtacttaagtttaaaggtcgtactaggttgtaggtaggtcgttacggttggnggagtcgtagggaggtacggtcgttaccggacccgggcggggtcccggggggttacctaggtacgtaccgttccgtccgtaggtccgaccgtacgtccgttggttacggttccacggtacgtaaccgaacgttaaacccaaccggtaggttaggcgttcgggtcccggcccgtaccgaccggtcccggtaacgggggagggtacggtcgtaaggtacgtcggtacttagtaagtttagtaagtaacgtggtacgtaggtactaaccgtaacgtaccgttaccgacggtaccgttaaccggtaccggacgggtaaccggtaactaccttaccgaactccgtacgaacgtaaggaccctaaacaaccgttacggaaactcggtaaagttactaaaccgtgtaaacgaacgtacgaacgacgttacccgaaaggaacccggtaacggacgtaccggtaacgttacgtattacgttaagtcgttaagttagttacgggtagtacgggtacccggtccgggtacgggtaacgggtcccggtaaaggtaccggttcccccgtaaacgtcccgtttacgcccccgtaggtaaccccncccgtaaacccgaccgggtacccg

SEQ ID NO: 136915 - DNA, 1198 bp, Homo sapiens
  misc_feature: GYAE6OF01CLVIH.16.39.D06.1.454.CMB.1.raw
tcagtgtactactccacgaccggtgctcgatttagtgacatctcgcagttctttggggggagaggagcccagcactgggattccgaggtgtttccattcggtgatcagcactgaacacagaggactcaccatggtagttttggctgtagtttgggttttcctgctgtacttaagtttaaaaggtgtccaggtgtgaggttgtacgttgggtggagtcgtgggagggaggtctcgacccgacgggtccggggggtcctggacgtacgtctccgtggtcgctacggtccttcggttcgggttacgacggtccggttaaccgtaacggttaaaaccaaacccgtaacgggttacggtacggtttacggggttaccggggttaccccgaccccgtaacgggtacccccgttaccgggggaaaacgggggggtaaacggggggttccggtaaccgggggttaaacgggtttaccggggggtttaacccgttaccggttttaaaacggggttttttaacgtttaaaacgggggtaaaaaaaacggttttcggggttaaagggttttaaccgggggtaaccggttaaaaccccggtaaaaacccgtttaaaaccggttaacccccgggttaaacccccggggttaaccccggtttaaaccccgggtttaaccccggggtaaacggggtaaaacccggggggttacccctttaaaaccgtttaacccccggtaaaccccgttaaacgtttacccccggtaaaccccggtaaacgggtaaaacccggttaaaccccgttaaaacccgttttaaccgggaaaaaaccgggtaaaccccgggtttaaaacggggtttaaccgttaaaaaccgttttacccgtttaaaaaccgtaaaaacgggttaacccgggtaaaaacccggttaaccggggtaaccccgtttaaaaccgggggaaaaccgggtaaaacccccggggaaaccgggggttaaaccccggtaaaccccggggttaaccgttttaaacgtttttaaaaccgtttacggtttaaacgggtttttaaaacgggtttaacggggttttaaacgggtttacgggggttttaaacggggtttaaaccccggttaccccccggggggggttacccccgggttaaaccggggggggttaacccgggtaaacccgggggggtttaaaccccgggttccc

SEQ ID NO: 136916 - DNA, 779 bp, Homo sapiens
  misc_feature: GYAE6OF01BQR1Z.16.39.D06.1.454.CMB.1.raw
  modified_base (651)..(651): a, c, t, g, unknown or other
  misc_feature (651)..(651): n is a, c, g, or t
  modified_base (734)..(734): a, c, t, g, unknown or other
  misc_feature (734)..(734): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggtagttttggctggtagtttgggttttccttgctgtcttaattttaaaaggtgtccagtgtcgaggtgttacgttgggtggtacgtcgtgggaggaggtccttgacccgagggcccggggggtccctgacgtactcgtccgtgtcgcacgtccgtcgtgggttacacgcgtacaacgtaaccaccgtaacgtcgagttggtcgggtcccgaccgacgtcccgtaccggaaggggacggggctgggtaacgtgggttactcgtaagtttaacgttagaaatgtagtgtacgactaacgtaactcgtacccggtaccgtacggttacccgtaagggtaaccggaccggtaacttaccgaacccgtcgttacctacgaacgtaaccgtaacctaaattaccccggaaagtaacccgtaacggttaacggtaactttacctaagaacgtgaaaccgagtcccgtaaaggacccggaaacggtaccggacgtaacgggttacctagttaaacgttttnttaacggtagtttacgggttagtagggttaacggttaccggttacccgggcccggttggggaacccggtacgggttacccggngttacccgccgtttacgccctaacgccgtacccgcggtaacccgg

SEQ ID NO: 136917 - DNA, 987 bp, Homo sapiens
  misc_feature: GYAE6OF01BD97G.16.39.D06.1.454.CMB.1.raw
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgcttattttaaaaggtgtccagtgtgaggtgtacttggtggagtcgtgggaggaggcttcgacccgagggcccgggggggtccctggagtacctctcctgtgcacgtcctcgtggttcagtcgtacaagtaaccaaccacggttatagtcggtcgggtccccgcccgacgtccccgtaccggaacggggggaacggggtccgtagggtaacgttcggggtaccttacgtaaggtttaagttaaggtaaaaagtggtaagtttagggtaacgaacgtaaaccgtaaacgttacccgttaaccccgggacccgttaaccggttaccccgggtaaggggaaacccggggtcccgttaaacgtttaccccgaacccgtaacttaccccggtaccgaagggtaaacccgtaaaccttaaaccgttaaccccgaaaacggtaaacccggtaaaccggggtttaaattaaacccgtttaaccgtttaaaaccgtaaaaccgtaacggtaaaacccgtacgtaaccccggtaagggtaaaacccgggaaaccccggggtaacgggtaaacccggtaacccgggttaaccggttttaaacgtttaacgttttaaggttttacggtttaaagggtttaacggggtttttaacggttagggggtttaaaccgggttaacccgggtttccccgggggaccccccggttaagggggggacccccgttaaacgggggggttaaccccgttcccggggttaacccgtaccccggttacccgtttccccgacccgacccggtttaacccccgttaccccgaacccgggtaaaccccgggg

SEQ ID NO: 136918 - DNA, 762 bp, Homo sapiens
  misc_feature: GYAE6OF01CGJMT.16.39.D06.1.454.CMB.1.raw
tcagtgtactactccacgaccggtgctcgatttagtgacatctcgcagttctttgggttttggggagaggagcccagcactgggattcccgaggtgtttccattcggtgatcagcactgaacacagaggactcaccatggagtttggctgtagttggttttccttgcgtgtacttaagttttaaaaggtgtccgagtgtggaggttgttacgttgggtggtagttcgtagggagggtagggtccttacggaccccggtacggggtcccgggggggtcccttaggacgtactcctccgtgtcgcacgtccgttcgtcggttcacgtcgtacgaacgtaacaaccgtagtgtcgtagggtccggtaccgccgaccggcccgtacggtaacggggagggtccggtaggaaggttcgggttactacgttaagtttaagttaacgtaaagtgtagtaggaacgactaacgtaactacccgtacgaccgtaccgtaccggtaacggaacgggccctaacgtaccgaccgtactacctaccgaacgtaacaacctaactaaccgaacgtaaacgtaccggtaataacgtacctaataagtacgtaaccgagtaccgtagaaccggaaccgtaggaaccgtaccggtagttacttaagttacgttagttaagttacggtagttcggttacgtaccggtcccgggtcggtacgggaacggtacgggtaccgccgttaccgtccgtacgaccctgacctcccgctaaccggg

SEQ ID NO: 136919 - DNA, 879 bp, Homo sapiens
  misc_feature: GYAE6OF01B5KZJ.16.39.D06.1.454.CMB.1.raw
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggtttccttgctgactattttaaaggtgtccagtgtgaggtgtacttgggtggagtcgtgggaggaggcttgacccgacgggccggggggtccctgagactctcctgtgcacgcctcgtgggtcacgtcgtcaacgtaaccaaccgtacggtgaagtggtacggggtcccgtaccgacggtcccgttacccgggaagggggtaacggggtactacggggtaagttcgggggttaccttacgtaaggttttaagttaagggaaaaacgtttgggaagttacgggttaaggaaccctaaacgtaaaccgttacccggttaacccggaaccccggtaccgtttacccgggacgggtaaaaccgggggtcccgtacttacccgaacccgtaacgttacccttaccggaagtaaacggaccttaaaaccgtttaaccggaaaacggtaaaccggttaaccggtaacgtaaaccttacccgtttaaacgaaaacgttacgaaaccgtacgtaacccgtaagggaaaccgggaaacccggtacgggaaccggtacccgggtaactttaacttaagtttagtttagggttaagttaacggtttaggttacgggttacggtaacgtttcccgggggacccggtgggggtacccggtaccggggtaacccggttcgggtacccgtaccgttcccgtccgttaccgaccggttacccccacccgaacccggtaacccggg

SEQ ID NO: 136920 - DNA, 851 bp, Homo sapiens
  misc_feature: GYAE6OF01D7YJO.16.39.D06.1.454.CMB.1.raw
tcagtgtactactccacgaccggtgctcgatttagtgacatctcgcagttctttgggttttgggagaggagcccagcactgggattccgagtgttccattcggtgatcagcactgaacacagagactcaccatggtagtttgctgtagtttcggttttccttgcgtgtacgttaagttttaaaaggtcgtccgagtgtgtaggttgttacgttggtggagtcgtggaggtagtccgttacggacccgtacgggcccgggggttccctaggtacgtaccgttccgtccgtacgtcgaccgtacgttccgtcggttggtttacgacggtccgtacgaaccgtaacccgtaaccgtacgttgacgttcggtaccggtaccccgccgccggtaccgtaccggagggggtaacggtcgtgggaagttccgggtacttacgaagttttaactaaggtaaaagttggaagttcggtaaacgacgtaaacacgttaccgaccgtacccggtaccgtacggacggacggtacccgtaacttccaacgtacgtcgaaccgtagaacgtacctaaacgtaccgtaaacgacgtaacggtacgtaagttacgtaacgtaagaacgtaacgtacgtacgacgaaacgtaaccggcgaaacccggtcggttaaccgtaccgtttaaagtttacggtttaacgtttaaggtagtttaacgggtaacggtttaccgggttacggtaccccgggttacccgggtaaccgggtaccggttaacggtccccgggttaacggtaaccccgtaaccccgttccgttaccccgtaaccgtacccccggttcccgtaaccccggtaaccccggg

SEQ ID NO: 136921 - DNA, 830 bp, Homo sapiens
  misc_feature: GYAE6OF01E0N9O.16.39.D06.1.454.CMB.1.raw
  modified_base (217)..(217): a, c, t, g, unknown or other
  misc_feature (217)..(217): n is a, c, g, or t
  modified_base (794)..(794): a, c, t, g, unknown or other
  misc_feature (794)..(794): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttggttttccttgctgcttattttaaaaggtgtccagtgtgaggttgtacgttggtggagtcgtggaggnggtcttgacccgaggcccgggggggtccctgagactctcctgtgcacgcctgtcgggttcaggtcgtacgaacggtaaccaacctacggtgtacgtcgggttcggtcccgccacggccccgttaccggaaggggggtaacggggtcttacggggaagtttcggggttaccttacggtaagtttttaacgttaacggtaaaaagttggtaagtacggttacgaacctaaaccaaagtttcccgtaacccggtccccgtaaccgttaccggtacggggtaaaccggacccggttaactttacccaaccgttaacctcccgttaaccaacgggtaaccaaccgttaaaccttaacccgaaagtaaacccgttcgggttaacaacgtttacttaaaccgaaatcgtaaaccgacgtaacccgtaaggaacccgaaccggtgggaaaccctcggggaccttaattttaacgtattttaaccggtagtttacgtagttacgggtcgtttaaacccggtccggggtaccccgtggggtaccggaacggggttaacccgtggtaccccgttcgtccggttacccncggaaccccgtccgtaaccccgtacgggaaccccgg

SEQ ID NO: 136922 - DNA, 702 bp, Homo sapiens
  misc_feature: GYAE6OF01BP2WM.16.39.D06.1.454.CMB.1.raw
  modified_base (166)..(166): a, c, t, g, unknown or other
  misc_feature (166)..(166): n is a, c, g, or t
  modified_base (168)..(168): a, c, t, g, unknown or other
  misc_feature (168)..(168): n is a, c, g, or t
  modified_base (281)..(281): a, c, t, g, unknown or other
  misc_feature (281)..(281): n is a, c, g, or t
  modified_base (437)..(437): a, c, t, g, unknown or other
  misc_feature (437)..(437): n is a, c, g, or t
  modified_base (444)..(444): a, c, t, g, unknown or other
  misc_feature (444)..(444): n is a, c, g, or t
  modified_base (485)..(485): a, c, t, g, unknown or other
  misc_feature (485)..(485): n is a, c, g, or t
  modified_base (550)..(550): a, c, t, g, unknown or other
  misc_feature (550)..(550): n is a, c, g, or t
tcagtgtactactccacgaccggtgctcgatttagtgacatctcgcagtttcttttgggttttggggagaggagcccagcactgggattccgaggtgtttccattcggtgatcagcactgaacacagaggactcacatggagttttggcgtgttggtttcgttcgntntgtatttaaagttagtcctagtgtgtggtgtagttggttggagtacgtggtagggacggcgtcgtacccgacgggccggggggtccggtcgacgtacgtctcctgtggtaccncgtccgttcgttacggggttcgtacgcggtaccgtaacgtaaccaaccgaccgtagtggtagggtcgggttacccggcccacggacccctcggaggggaacgggcgttagacggtagggtcgtacctagttagttaagaaatagtggtaggtcaanacctaanccgtacgtcgtaccgtcgtaggaacggccgtaactcaaccnctccgacacgactaacgtaactaccgaaacggaacgaccgtagtaactcgtaacaatacggaacngacgtagaacggacggtacgacgttaccacgtaatttaacgttattacgttagttaggtacgtggtcggtaacggttccgaccgggtcgggacgtacgggacgttcggtccccgatttcccgacctcgaccgacccctcggacccgtacggg

SEQ ID NO: 136923 - DNA, 810 bp, Homo sapiens
  misc_feature: GYAE6OF01C20QX.16.39.D06.1.454.CMB.1.raw
  modified_base (596)..(596): a, c, t, g, unknown or other
  misc_feature (596)..(596): n is a, c, g, or t
tcagtgtactactccacgaccggtgctcgattttagtgacatctcgcagtttcttttgggttttggggagaggagcccagcactgggattccgaggtgtttccattcggtgatcagcactgaacacagaggactcacatggtagtttgctgtagtttggttttcctgctgtacttaattttaaaggtgtccagtgtgtaggtgttacgttggtggagtcgtggaggaggcttcgacccgacggggtccggggggtcctgacgtacctcgtccgtgtcgcacgccttcgtggttcacgtacgtacaacgtaaccaactacggtagtagttcggtaccgggtcccgaccacggtccccgtacggaagggggtaacggggtcgtaagggtaacggttcgggttactaacgttaaggttttaacgttaagtaaagtggtaagttggtaacgaactaactaacgttaccggtaacccgaccgtaacccgttccgggtaacggaaccgggtccttacgttacccaacttaccgtaccgtacgaaagtaacgaaacctaacgttaacccgaaagaaccgttacggtaaactacttaacctaanaaacgtacgaacgacgtcgtaaacgaaccgaacgacggaccgaacgtaccgtttaatacgttagttacgttaaggttacgttaaggttcgggttaacggaccggttccccgggccgggtaacggggtacccggtaaacggggttacccgttcccggttacgtacccgttacccgttacccgagtaccccgtccccgtaaacccggtaacccggg

SEQ ID NO: 136924 - DNA, 788 bp, Homo sapiens
  misc_feature: GYAE6OF01BEAF2.16.39.D06.1.454.CMB.1.raw
tcagtgtactactccacgaccggtgctcgatttagtgacatctcgcagttctttggggggagaggagcccagcacgtgggattccgaggtgtttccgattcggtgatcagcactgaacacagaggactcaccatggagttttggctgagttggtttccttgctgctatttaaaggtgtccagtgtgaggtgtacgttggtggagtctgggaggaggcttgacccgaggtcccggggggtcctggagacctctcctgtgcagtcctcgtgggttcagcgtcaggtaacaaccacgtgatggtgggtccgccagcctcgagggagggctaggatgggtctcgtagttatagaaaatgatggtacgacacgaactctaccgccgtaactccggtaggaacgggcctacgttccaaccgtatacccgtaccgaaggtaacgaacctaaacgtttaaccccgaaaggtaaacccggtaacggttaacggtaaactttaccgttaaaccgtaaaaccgttacggtaaaccgtaccggtaacccgttaccgggaaacgtaaaccccgggaacggaacccggtaccgggaacccgtttaagttaacgttttaaccgtttaggttaaagtttaacggtttaacggttagggttaaacgggtttaaccgggttttacccggggacccccgggttaacgggggaaccccggtaacgggggtaacccggttcgttaccccggtacccgttcccgtaccctaccggtaccgccccgtacccgaacccgggtaacccccggg

SEQ ID NO: 136925 - DNA, 1020 bp, Homo sapiens
  misc_feature: GYAE6OF01ETI46.16.39.D06.1.454.CMB.1.raw
  modified_base (242)..(242): a, c, t, g, unknown or other
  misc_feature (242)..(242): n is a, c, g, or t
tcagtgtactactccacgaccggtgctcgatttagtgacatctcgcagttcttttggggttttggggagaggagcccagcacgtgggattccggaggttgtttccattcggtgatcagcactgaacacagagactcaccatggtagttttggctgtagtttggttttcctgctgtacttaagttttaaaggtgtcctaggtgtggtaggttcgttacgttgggtcggtagtcgtagggaagnggtccgttcgaccccggtacggggtcccgggggggttccctaggacgtaccttccgttccgtggtcgaccgacgtcccgtttcggttcgggttaccgacggtaccgtacgtaaacggtaaacccgaacccgtaggttacggtacgttcggggttccgggtccccggtacccgaaccgggttccccgtaaccggggaacggggggtaacgggggtccgttacgggggaacgtttcggggtttacccttacgtttaaaggttttacgttaaaggtaaaacgttgggtaaggtttcggtaacgaaacctaacgttaaacgtaccccggtaccgtaccggtaaccggttccgggtacggtaaccggtaccttacgtacccgacctacgtacccgtaccgtaacggaacttaaccgtaacgttaaccggaaacgtaaccggtaacggttagttaaacccttacgttaaaccctaaaggtaccggtaaacgtaccccgtaacggtaacggggaaaaccggtacccgggtaacgggtaaaccgtacccggtttaacgtttaaatttaaccgggtttttaaagtaacggtttaacggttaagggggttttaggttaaccgggtttaccgggttttaacccgggccccggggtttaaaccccggggtccgggggtaaaccgggttaacccggggggttacccgtttaccgggtacccccgttacccggtttaacccggtccccttaacggaccccggttacccccgtaccccgggtaaacccccggg

SEQ ID NO: 136926 - DNA, 704 bp, Homo sapiens
  misc_feature: GYAE6OF01D1Q6X.16.39.D06.1.454.CMB.1.raw
  modified_base (230)..(230): a, c, t, g, unknown or other
  misc_feature (230)..(230): n is a, c, g, or t
  modified_base (279)..(279): a, c, t, g, unknown or other
  misc_feature (279)..(279): n is a, c, g, or t
  modified_base (282)..(282): a, c, t, g, unknown or other
  misc_feature (282)..(282): n is a, c, g, or t
  modified_base (299)..(299): a, c, t, g, unknown or other
  misc_feature (299)..(299): n is a, c, g, or t
  modified_base (331)..(331): a, c, t, g, unknown or other
  misc_feature (331)..(331): n is a, c, g, or t
tcagtgtactactccacgaccggtgctcgatttagtgacatctcgcagttcgtttgggggggagaggagcccagcactgggattccgaggtgtttccattcggtgatcagcactgaacacagagactcaccagtggtagtttgctgtagtttcggtttcctgctgtacttaatttaaaggtcgtaccgtagtgtggtaggttgttacgttgggtggagtcgtagggaggnggtaccttcggacccgacggggcccgggggtactgacgtctcctcgtgncgntccgtgtagtcagctanaactaaccacctgtggagtcggtaccggtccncgacgtcccgacgggagggacggtgaggtagtcggtatacgtagttaactagaaagtcgtagtgtacgactaacgatacccgacgtcctaaccggttcggaaacggtaccggtactaccgtaccctacgtaacctccctaacggaacgaacctaacgttaacctaaccgaaacggtaaccggtaaaggttacctaacttaccgtaataaccgtaagaactccgacgtacgaacggaacgcgaacgtcggtaactagttatattacgtagttaggtagttaggtacggtcggtcgtaccccggtagggtacccgtacgggtactcggtaccgtaccgttccgctacccgaccgacccgacgtaacccgtcccgg

SEQ ID NO: 136927 - DNA, 714 bp, Homo sapiens
  misc_feature: GYAE6OF01BNGLZ.16.39.D06.1.454.CMB.1.raw
tcagtgtactactccacgaccggtgctcgatttagtgacatctcgcagtttctttgggttttggggagaggagcccagcactgggattccgaggtgtttccattcggtgatcagcactgaacacagagactcacagtggtagtttgctgtagtttggtttcttgctgtacttaagttttaaaggtcgtccgtagtgtaggtaggttgttacgttgggtggtagttcggtagggaggtaggtccttacggacccggacggggtcccgggggtcctggacgtcctcgtccgtgcgcgcgtccgtcgtcggtacacgtcgtactaacgaaccacgtagtgtagtcggtccggtcccgcgaccgtccggtacggaggggacgggtcgtaggtacggtcggtactagtagttaagtaagtaagtgacgtaggacacaacgtactacgcccgacgtacgtacggacgaccggtactactccactactcgaccaagctaactacgtaacgaacgtagtacgtaactaacgttataacaaagtcaaaccgtagaccgtaagaacggaaccgaacggacgtacccgtaagttaacttacgtaacgtagtaccggaaagccgaaccgcggttaacgtaacgttaccgaacctaccttaacgtaaccgttaccgttcggaaacgtccggtacccgggtacgtaacccggccggttccgtaccccg

SEQ ID NO: 136928 - DNA, 735 bp, Homo sapiens
  misc_feature: GYAE6OF01BLJ94.16.39.D06.1.454.CMB.1.raw
  modified_base (452)..(452): a, c, t, g, unknown or other
  misc_feature (452)..(452): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaaccatggagttttggctgtaggttgggttttccttgctgtcttaatttttaaaaggtgttaccagttgtggaggtgttacgttgggtggagtcgtgggaggtacggcgttcgacccgagggtcccggggggtccctaggacgacctcgtccgtgtcgcacgtccgttcgtggttacgagtccgtacaacgtaaccaaccgtacgtaggtacgttacggtccgggtcccgaccgaccggccgttaccgggaagggggtacgggtccgttaggggtagttcgggtactacgttagttacgttaagtaaagtgtagtcgganacgtaactactaccgtaccgaccgtacgtaccggaggacggtacgtacttacccgactcgttacctacgaagtacgtaaccaaccgttacaaacgtacgtaacgtagtaacttacgtaacaataaccgaacgacgtccgtaaggaacgaaccgggacggacgtaacggtaccttaagttagttacgtaggtagaacgtataccgcgtacgacgtacctacgtaccaacgtccgacgtacgacgttccgtaaccggtccggacccggtgggacccgtaacccgg

SEQ ID NO: 136929 - DNA, 629 bp, Homo sapiens
  misc_feature: GYAE6OF01C1UA9.16.39.D06.1.454.CMB.1.raw
  modified_base (184)..(184): a, c, t, g, unknown or other
  misc_feature (184)..(184): n is a, c, g, or t
  modified_base (312)..(312): a, c, t, g, unknown or other
  misc_feature (312)..(312): n is a, c, g, or t
  modified_base (376)..(376): a, c, t, g, unknown or other
  misc_feature (376)..(376): n is a, c, g, or t
  modified_base (462)..(462): a, c, t, g, unknown or other
  misc_feature (462)..(462): n is a, c, g, or t
tcagtgtactactccacgaccggtgctcgatttagtgacatctcgcaggttctttgggttttggggagaggagcccagcactgggattccgaggtgtttccattcggtgatcagcactgaacacagaggactcaccatggagttttggctgagttgggttttccttgctgctattttaaaaggngtccagtgtgaggtgtacttggtggagtctgggaggaggcttgaccccagccgggggggtccctgagactctcctgtagcagccttctgggttcagcgtcagtaacaaccacgtgatgtaggggtccncctaagcctccgagggaaggggccttggaatggggtctacagttattgaaaaatcgaagtggtnacgacctaaatccgtaagccgatcccggtagaaggggcccgaattcaccgatcgtccagagtacaattcccgaagaactaacggtnaagtattaccaaatagaaaccagtacctggaacgaaccgacgacgtaacgccggtatattagttgtaataggtttactgggttggaaagtttgggacccccgtcggggccgacgggtacccgggacggtctacccggtacctccttaccacggcccgttacaccccg

SEQ ID NO: 136930 - DNA, 829 bp, Homo sapiens
  misc_feature: GYAE6OF01C712R.16.39.D06.1.454.CMB.1.raw
tcagtgtactactccacgaccggtgctcgatttagtgacatctcgcagttctttggggttttggggagaggacgcccagcactgggattccgaggtgtttccattcggtgatcagcactagaacacagaggactcaccagtaggtagttttggcttgtaggtttgggtttttccttgctgtacttaaatttttaaaacggtgtccgagttgtggtaggttgttacgtttgggtggagttcgtgggaggacggtcttacgaccccgtacggggtcccgggggggtcctagacgtacctcgtcctggtcggacacgtccgtcgtagggttcctagccgtacaacgtaaacccaacccgtagtagtagttcgggtcggggtaccccaccgtaccggtcccgtacccggaagggggggtacggggtacttacggggaaagttcgggttactacgttaaggtttacttaaaggtaaaacgtgtaaggtggtacagaactacgtccacggaccgacgttacggacggtaaacgcgtaaccttacgacctactcccgtacagtaacgtaacctaagttaacccgaaaggtaaacccacggtaagttaacctacttaacgaaatacgaaacctacggtaccgtagtaaccggaaccggaacggtaaccgaccggttaacggttactttaacgttagtttacggttaagttaacggttaggttacgggttaccggttaaccggttacccgggccgggtaaccggggtacgggtaccggtacggtacgtccccgtaaccgttacctacccgtcctaacctccgtaacccgtaacccggg

SEQ ID NO: 136931 - DNA, 767 bp, Homo sapiens
  misc_feature: GYAE6OF01ARBH0.16.39.D06.1.454.CMB.1.raw
  modified_base (603)..(603): a, c, t, g, unknown or other
  misc_feature (603)..(603): n is a, c, g, or t
  modified_base (725)..(725): a, c, t, g, unknown or other
  misc_feature (725)..(725): n is a, c, g, or t
  modified_base (751)..(751): a, c, t, g, unknown or other
  misc_feature (751)..(751): n is a, c, g, or t
tcagtgtactactccacgaccggtgctcgatttagtgacatctcgcagttctttgggttttggggagaggagccagcactggattccgaggtgttccattcggtgatcagcactgaacacagaggactcacatggagtttggctgtagtttggtttccttgtctgtacttaagttttaaaggtgtcagtgtgaggttgtacgttcggtggacgttcgtgggaggaggcgtttacggacccgtacggggtcccggggggtcccccgagtaccgttcgtccgtcgtagcagtccgttcgtggggttacaggtccgtacaacggtaaccaaccgaccgttaggtagtcggtaggccccgtaccgacggtaccctccgggaagggtagggtccgtaagggtacggtcgggtaccttcggttaaaggtttattaacgggaaattggtaacgttgggtaaccgtaactaacgtaaacgttccggacccgtaccggtaccggttaccgggtaacggacgggtaccctaccttcgtaacccgtactaccggtaacccaaggtaccgtaacgtaaccttaccgaaacggtaccgtaacggtactaaccgttnaaacgtagacgtaatacccgtagtagacggaaacggcgaacgtcggtaccgtattacgttacgttaacgttgtaacgttgtcgggttagtaccggtccggaaccgtgggactacgggtaacncggttaacgcctaccgtcgatacccnctaccggcgtaaccgg

SEQ ID NO: 136932 - DNA, 1022 bp, Homo sapiens
  misc_feature: GYAE6OF01AO31G.16.39.D06.1.454.CMB.1.raw
tcagtgtactactccacgaccggtgctcgatttagtgacatctcgcagttcgtttggggggagaggagcccagcactgggattccgaggtgtttccattcggtgatcagcactgaacacagaggactcaccatggtagtttgctgtagtttcgggttttcctgctgtacttaagttttaaaaggtcgtccgtaggtgtaggtaggttgtacgttgggtggtacgttcgtaggggaggtacggtcgttaccggaccccggtacggggtccccggggggggttccctaggtaccgtaccgttccgttccggtcgtcgcccgtaccgtcccgttcggttcgggtttaccacggtacccggttaccgttaaaacggttaaacccaaacccggttacggttacgtaacggttccgggttacgggggacccccgacccgttaacggtacccccggttacccgggggaaacgggggggaaccggggtacggtttaacggggtaaggtttccggggtttaccgtaaccggtttaagttttaaacggtttaaaggaaaagtttcgggtaacgttaacggggtaactaaaccgtaaacgtaaccgttacccgtaaccgggtacccccggtaacggtttaacccgggtaacgggacccggggtaccgttaaccgtacccgtaaccttacgtaccccgttaacgaaaccggtacgtaaaccgtaaaccttaaccgggaaaccgttaacgggtaccggtaaacgttaacctttaccgttaaacctaaagtaccggtaaacctccggtaacgtaccggaaacccggtaacggaccgttaaaccggccgtaacgggtttacttaacgtttaggtttaacggttaattacgggtttagttccgggttaagttacccggtaccggggaccccggttcggggaacccgggttaccggggtaacggttcccgaacccgttcccggttaccccgtacgtacccggtaccgtaaccccgttccgaccccgggtttaaccccgg

SEQ ID NO: 136933 - DNA, 792 bp, Homo sapiens
  misc_feature: GYAE6OF01D3VMV.16.39.D06.1.454.CMB.1.raw
  modified_base (601)..(601): a, c, t, g, unknown or other
  misc_feature (601)..(601): n is a, c, g, or t
  modified_base (611)..(611): a, c, t, g, unknown or other
  misc_feature (611)..(611): n is a, c, g, or t
tcagtgtactactccacgaccggtgctcgatttagtgacatctcgcagttcgttttgggttttggggagaggagcccagcacgtgggattccgaggtgtttccattcggtgatcagcactgaacacagagactcaccagtggtagtttggctgtaggtttggttttccttgctagtacttaaagttttaaaaggtcgtccgtaggttgtggtacggttgttacgttgggtggtagtcggtagggagggtacggtcgttacggaccccggacggggtcccggggggtccctaggacgtaccttcgtccgtgtacgcctacggtccgttcggttcgggttacacggtccgtaacgtaacgtaaaccgaacccgtaggtgtaacgttcggtacgggtccccgaccgtacgtacccggtacgggaagggggaacggtcgtaaggtaacgttggtactacgttaagtttaataagtaaagtgtagtaggtacaccgaatactcccgaacgtccgtacgtacggtagaacggtcctactacgactactacgacaagtaccgtaaactaaccgtaaccgaaaggtaacgtacggttaataaccttaanaacgtaaagngtaaccacggtaaccctaagaaccggtaacgacgaaccgttaacgtaacgttaatttagtaagtggttaacgtaagttagacgggttaacgtccggtcccggggccggtaggaacccggtaggttaacccggcgttacccgccgttacctaccggactaccggtacccgtacgaaacccgg

SEQ ID NO: 136934 - DNA, 951 bp, Homo sapiens
  misc_feature: GYAE6OF01EJPWW.16.39.D06.1.454.CMB.1.raw
  modified_base (175)..(175): a, c, t, g, unknown or other
  misc_feature (175)..(175): n is a, c, g, or t
  modified_base (244)..(244): a, c, t, g, unknown or other
  misc_feature (244)..(244): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttggttttctgctgcttatttaaaggtntccagtgtgaggtgtacgttggtgagtcgtggaggaggtcttcgacccgagggtcccggggggttcccngacgtacctctccgtgtcgcgacgtccttcggttcgggttaccgcgtcgttacgaacgtaaaccaaccgtacgttaggtagtcggttcgggtcccgtaccgaccggtcccgtacggacggggggtaggggaccggtaggggtaacggtttcggggtacttacggtttaaggtttaacgtttaaaggtaaaagttagggtaggttaacggttacgaaacctaacgttaaacgtttcccgtaaccggaccccgtacggtttaccgggtaaacgggaccgggtaacttaacccgtacccgaacctttaaccgtacccgttaacccgtaaacgggaactaaacccggttaaaacttaacccggaaaaaccggtaaaccgggtttaacggttaaacggtaactttaacccgtttaaaacgaaaacgtttaacggaaaacccgttaacccgggaccgttaaacgggaaccgggtaaaaccgggaaccgggtaaccggttaaaccggttaaccgttaaacggtttttacttaagggttttaccgttaaaaggttttacgggttaaggtttcgggggtttaacgttaccggggtttacccccggggtacgggtcccggggtaaacgggtaccgggtaacccggtcgggttaccctcccggtacccgtttacaccccgggtaacccaccccggttcccgaaaacccgggttcccgg

SEQ ID NO: 136935 - DNA, 812 bp, Homo sapiens
  misc_feature: GYAE6OF01BCLX7.16.39.D06.1.454.CMB.1.raw
  modified_base (789)..(789): a, c, t, g, unknown or other
  misc_feature (789)..(789): n is a, c, g, or t
tcagtgtactactccacgaccggtgctcgatttagtgacatctcgcaggttctttgggttttggggagaggagcccagcactgggattccgaggtgtttccattcggtgatcagcactgaacacagaggactcaccatggagtttggctgagttggtttctgctgctaatttaaaggtgtccagtgtgaggtgtacgttggtggtagtcgtgggaggaggtcttcggaccgagggccggggggtccctggacgactctccgtgtcgcgacgtccgtcgtcggttcacggtcgtacgtaacgtaaaccgaacctacggtacgtagttcgggtccgggtacccgacccgtacggacccgtaccgggaacgggggtaaacgggggtccgttacgggaaacggttcggggtaccttcgtaaagtttaagttaaggtaaaagtggtagttacggtacgtaaaccaacgtaacgttaccgtaaccggaccgaacgttaccggtaacggaaccggtccgtaacttaccgaacccgtacttaccgtaccgaagtaaccgtaaaccctaacgttaaccgaaaggaaaccctaagggtaacttaaacttacctaagaaacggttaccgaaacgacgtacctaagggaaccgaaacggtacgaaccgtaacgggtacgttaaattacggtttagttacgtaaagtagggtttaacgtagggttacggttacccggtccgggtacccgtggggaacccggaaggtaaccgtttcggacccgttaccgtcctacgtaacccnccggtaccgtacccgaaaccggg

SEQ ID NO: 136936 - DNA, 792 bp, Homo sapiens
  misc_feature: GYAE6OF01E0K6H.16.39.D06.1.454.CMB.1.raw
  modified_base (212)..(212): a, c, t, g, unknown or other
  misc_feature (212)..(212): n is a, c, g, or t
  modified_base (773)..(773): a, c, t, g, unknown or other
  misc_feature (773)..(773): n is a, c, g, or t
tcagtgtactactccacgaccggtgctcgatttagtgacatctcgcagttctttgggtttggggagaggagcccagcactgggattccgaggtgttccattcggtgatcagcactgaacaccagaggactcaccatggtagttttggctgtagtttcgggttttcctgctgacttaagtttaaaggtgtccagtgtgaggtgttacgttggnggtacgtcgtgggaggtacggtcttcggaccccgaggggtcccgggggggtcctggacgtacctcctcctggtcgacgtacgtcctcggttcgggttacacggtaccgtacgtaacgtaaacccaaccgtacgtacgaagttccgggtcgggtaccccgaccctacgtaccccgtaaccgggtaaggggtaacggggtactaacggggtaacgttacggggttacctaccggtttaagttaacgttaacggtaaaagtcggtacgtacgggtacgtaactaaccgtaaacgtcccggtaacccggtcccgtaacgtaccgggtaacgggtacgggtacccttaaccttaccgtaacctacttaccgtaacccgaagaccctaactaaccgtacgaacgtacgtacgtatactacagtaagacgactacgacgtaggaacggaccgacgccgtaaccgtagtaatttacgttaagtcggttaagtacggttagtacggttcggtacccggtccgggtcccggagggtacacgggttcgtcccgtcgtaccctccgacgtccnccgttcccgacgtacccgg

SEQ ID NO: 136937 - DNA, 921 bp, Homo sapiens
  misc_feature: GYAE6OF01B2Z0G.16.39.D06.1.454.CMB.1.raw
  modified_base (429)..(429): a, c, t, g, unknown or other
  misc_feature (429)..(429): n is a, c, g, or t
  modified_base (501)..(501): a, c, t, g, unknown or other
  misc_feature (501)..(501): n is a, c, g, or t
tcagtgtactactccacgaccggtgctcgatttagtgacatctcgcagtttcgtttggggggagaggacgcccagcacgtgggattccgaggtgtttccattcggtgactcagcactagaacacaggagactacacaggttggtagtttgctggtaggtttcggtttctgtctgtacttaaagttttaaaggcgtaccgtagttggtaggtaggttgttacggttgggtaggtagtcgtagggacgggtaggtccgttacggaccccggtcgggggtcccggggggttacctggtaactccgttccgttccgtggcgacgtccgtccgttagggttccggtagacgtccgtaacgtaacgaaccgtaacgtaggtcgtaggtccgggttcggccccgaccgtacgcccggtaacggggtaagggccggnggttacggacggttccggtacgttacgttaagttaagtaaaggtaacgttaggaccgtggtaactaacgaanaaccgtccgtacgcccgtaacgtccgggtaaacgccggtacgttaccttaccgaaccttaccacgtaccgaagtacctaaactaacctaacgaaacccgtacggttaaacgtaacgttactaacgttaaaccgtaagtaaacgtaacccacggttaaccggaaccgaaaccgggtaccggaaccgaaccggttaacgtaagtttaccgttaagtttaacgttaaggtttaaggttaacgtttagggttaccgggtttaaccgggttaccccggggttacccggggtaaccccgggtcggggtaaacccgggtacggggttacccggttaacccggttcccgggttaaaccccggttcccgtttaaaccccggccccggttaaacccgtcccgtaaaccccccggtccggtaacccccggg

SEQ ID NO: 136938 - DNA, 882 bp, Homo sapiens
  misc_feature: GYAE6OF01C0RUC.16.39.D06.1.454.CMB.1.raw
  modified_base (128)..(128): a, c, t, g, unknown or other
  misc_feature (128)..(128): n is a, c, g, or t
  modified_base (490)..(490): a, c, t, g, unknown or other
  misc_feature (490)..(490): n is a, c, g, or t
tcagtgtactactccacgaccggtgctcgatttagtgacatctcgcagttctttggggttttggggagaggagcccagcactgggattccggaggttgtttccattcgtgatcagcactgaacacagngactcaccagtggtagtttgctgagtttgggttttcctgctgtcttaagttttaaaggtgtccagtggtcggtaggttgttaacgttgggtggtagttcgtgggaagggtcggtccttacggaccccggacgggggtccccgggggggttaccctggaacgtccttccgtccggttggtcacgtaccgtcctttcgggttaggttacacgtccggttacaacggttaaaccaaccgttacggtcgtaacggtcgggtccggtaccccgacctaacggtccccggtaccgggtaaggggggtaacggtccggttaagggtgggttccggttacctagttaacgttttaaagtaaggtaaaccngggtaagtacggtacaacgtaacgtacgtacccgaccgtacccgtacgggtaccggacggtaacgggtcccctaagttccccgaaacttcccggtacttaaccggaaacgtaaccgttaaactccttaaacgaaccgtaaaccggttgtaactaaccgtttaacgtaataaacgtacgtaaccacggtaaccgtaacgaaccggttaacggacccggttaacgaccggttaagttacgttagtttaacgttagttagttaaggttcggttagggttactcccgggttccgggtacccgggttaagggcccgggttaaaccgggtcgttacccggtacccgtaccttccgggtaccctacccgtaaccgtcccggtaacccgtaaccccgggg

SEQ ID NO: 136939 - DNA, 946 bp, Homo sapiens
  misc_feature: GYAE6OF01BUT70.16.39.D06.1.454.CMB.1.raw
  modified_base (97)..(97): a, c, t, g, unknown or other
  misc_feature (97)..(97): n is a, c, g, or t
  modified_base (577)..(577): a, c, t, g, unknown or other
  misc_feature (577)..(577): n is a, c, g, or t
tcagtgtactactccacgaccggtgctcgatttagtgacatctcgcagttctttgggttttggggagaggagcccagcacgtgggattccgaggttnttcccattcggtgatcagcactagaacacgagagactcaccgtagtggtagtttggactggtaggttttcggtttcctgcgtagtacgtttaaagttttaaacggtcgtaccgtaggtggtagggtaggttcggtttaacggttggggttggacgttcgggtcggggtaaggtacggtccgtttaccgggaacccgggttccgggggccccgggggggttacctacgtacggtaccgttcctccgttaggcgacctaccggtaccggttcggttacggtacggacgtacccggttaacgaaaccgtaaccgtaaccgtacggttacgtacggttccgggttacccggtcccgaccggtccggtaacccggacggggtaacggggacggtaccggtaggtaccggttcgggtaccttaaggttaggtttaaacgttaaagtaaggttaccggtagtggtaaaccgacgttaaccgtaaccncgggtttacgaaccctacgggtaacccggtaggtaacccgggactaccggttaacctactaacccggtcgtaacgaacgttaaccgaaccgttaaccgtaacgtaaaccggtaacccgtaacggttaccctaaacttacggtaacgttaaccgaacgtaaccgacgttaaaccggtagaaccggtaaccgtacggaaccgtacgtaacgttaacgtagtttaacgtagttacgttacgggttacgttcgggtttaccggtaaccgggttcccgggtaccgggttcggtaacgggtacccggttagggttccccctaaacggtcccgtaccgtaccgtacccgtacgtaccccggtaccgtaaccccggg

SEQ ID NO: 136940 - DNA, 719 bp, Homo sapiens
  misc_feature: GYAE6OF01DAQUW.16.39.D06.1.454.CMB.1.raw
  modified_base (510)..(510): a, c, t, g, unknown or other
  misc_feature (510)..(510): n is a, c, g, or t
  modified_base (522)..(522): a, c, t, g, unknown or other
  misc_feature (522)..(522): n is a, c, g, or t
tcagtgtactactccacgaccggtgctcgatttagtgacatctcgcagttctttgggttttggggagaggagcccagcactgggattcccgaggttgtttccattcggtgatcagcactgaacacagaggactcaccatggagttttggctgtagttgggttttccttgctgtactaagttttaaaaggtgtccagtgtggaggtgtacgttggtggagtcgtgggaggagggcttcgacccgacgggcccggggggtccctggacgtacctccttcccgtggtacgcgtacgtccttcgttcggggttcgacggtccgtaacgtaagtaaaccaacccgtacggtagtacgtggtccggtaccgccgacgcccgtaccgaggggaggcgtaggagtcggtctacgtaatttagtagaaatgagtgtagactagactcaccgcgtactcggagacggtcgtactcacactctacgagaactactaacttaccgaagtaacgtacggtaanaacttacttaanaaagttacgaaactacgtaccgtagaaccggaaccgacggaaccgacggtacgtaactttaagttattacgttaagttacggttagtcgggttacgtacggttcccgggacccggttaggggacccggttaacggggccctttacggtccccgaccgttccgaccccttacggaacctccccgtaacccgaacccgg

SEQ ID NO: 136941 - DNA, 755 bp, Homo sapiens
  misc_feature: GYAE6OF01BI79I.16.39.D06.1.454.CMB.1.raw
  modified_base (225)..(225): a, c, t, g, unknown or other
  misc_feature (225)..(225): n is a, c, g, or t
tcagtgtactactccacgaccggtgctcgatttagtgacatctcgcagttctttgggttttggggagaggagcccagcactggggattcccggaggtgtttccattcggtgatcagcactgaacacagacgactcaccatggtagttttcggctgtagtttgggtttccttgctgtcgttaattttaaaagggtctaccagtgtggtaggttagtcgttgggtgnggtcgtgggaggtacggtctcgacccgaggggtcccgggggtccctggactccgtcctccgtaggtgcaccgtccttaggtggttcgacgtcgtaccaagtaccaaccgtgtacgtgttacgggtcgggacccgtacccgacgtcccggtacggacgggggtacggggccgtagggttacgtcggggttactacgttagttaactaaggtaacgtgaagttcggagtacctaacgtactacgtcccgaccgtacggtaccgggtaggaacgggtcctacccttaccactccttaccgcagaacctaactacgtacccgaagtaaccggtagtacgtctaaggttaaccaagtacgaacctacgtacacgggtacgaaccggtacggaaccggtaccgtacggttactagtttacgttacgtaaaggttctaaggggtcgttaacgtccggggtcccgtaccgggtgggttacccgggacggtggtccggtactcccgtccgtacgtaccaccgtcccgtaccggaaccgg

SEQ ID NO: 136942 - DNA, 708 bp, Homo sapiens
  misc_feature: GYAE6OF01DWI08.16.39.D06.1.454.CMB.1.raw
  modified_base (325)..(325): a, c, t, g, unknown or other
  misc_feature (325)..(325): n is a, c, g, or t
  modified_base (671)..(671): a, c, t, g, unknown or other
  misc_feature (671)..(671): n is a, c, g, or t
tcagtgtactactccacgaccggtgctcgatttagtgacatctcgcagtttcgtttggggggagaggagcccagcacgtgggattccgaggtgtttccattcggtgatcagcactgaacacagaggactcaccatggagtttggctgagttgggttttccttgctgcttaattttaaaaggtgtcctagtgtgtaggtgtacgttggtggagtcgtggaggaggtcttcgacccgtacggccgggggggtccctgacgactcctcctgtgcgcgtccttcgtgggttcagacgtcacgtaacaacctacgtgatggtcgggtccncacgcccgtccgtaggggaaggggtcaggtagtgggtctacgtgttaagttaagaaactggagtgtcgaactaccgtaatccgtaccgcccgtaccgtccggtaagggaacgggtccgacgttaccaacccgtatcctaccgagtaacgaaccttaaacgtacccgaaagaaaccgttcggtaagtaaacttcgttaaacaaacgtggaaacctcggtctagaaaccggtaacgacgggtaaccgcggtaccgtatttacgttagttaagtcgttaaggttctaagggttcgttaacggtccccgggacccgtgggacccgagggtaccggttctaccggtacccnccgttaccgccctagtccccctaagccccggtaacgg

SEQ ID NO: 136943 - DNA, 547 bp, Homo sapiens
  misc_feature: GYAE6OF02GQLQX.16.39.D06.1.454.CMB.1.raw
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccaggccggggggtccctgagactctcctgtgcagcctctgggttcagcgtcagtaacaaccacgtgatgtgggtccgccagcctccgaggggaaggggctggaatgggtctcagttatgaaaatgatggtgacacaatctacgccgactccgtgaagggccattcaccatctccagagacaattccaagaacacggtgaatcttacaaatgaacagctgacgaaccgaggacacggacgtatattatagtataggttatggtgtagttcgggcccgtgggccgagggaccgtggtacaccgtctcctcacgcctccaccgacgg

SEQ ID NO: 136944 - DNA, 548 bp, Homo sapiens
  misc_feature: GYAE6OF02HAEJX.16.39.D06.1.454.CMB.1.raw
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccaaccggggggtccctgagactctcctgtgcagcctctgggttcagcgtcagtaacaaccacgtgatgtgggtccgccagcctccagggaaggggctggaatgggtctcagttattgaaaatgatggtgacacaatctacgccgactccgtgaagggccgattcaccatctccagagacaattccaaagaacacggtagaatcttacaaatgaacagcctgaagaaccgaggacacggccgtatattattgtataggttatggtgtattcgggccctgggccagggaccgtggtcaccgtctccgtcacgcctccaccagggccc

SEQ ID NO: 136945 - DNA, 546 bp, Homo sapiens
  misc_feature: GYAE6OF02H7EQU.16.39.D06.1.454.CMB.1.raw
  modified_base (523)..(523): a, c, t, g, unknown or other
  misc_feature (523)..(523): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccagccgggggggtccccgagactctcctgtgcagcctctgggttcagcgtcagtaacaaccacgtgatgtgggtccgccagcctccaggggaaggggctggaatgggtctcagttattgaaaatgatggtgacacaatctacgccgactccgtgaaggccgattcaccatctccagagacaattccaagaacacggtgaatcttacaaatgaacagcctagagaaccgaggacacggacctatattatgtataggtatggtgtaattcgggccctgggccagggaccgtggtccncgtctcctcagcctccacgacgg

SEQ ID NO: 136946 - DNA, 635 bp, Homo sapiens
  misc_feature: GYAE6OF02G1XZ6.16.39.D06.1.454.CMB.1.raw
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccaggccggggggtccctgagactctcctgtgcagcctctgggttcagctcagtaacaaccacgtgatgtgggtcccgccagccctcgagggaaggggctgggaatggggtctcagttattagaaaatgagtggtgacacaatctacgccgactccggtgaagggccgattccgaccatcctccagacgacaacttaccaagaacacggtagaactcttacaaatacgaaacacgacctagaacgaaccgaggaaccgacggtaccgtaagttaacttaagttagttagttacggttagttagggttaggttacgttccgggtacccggttacgggggacccgtaacggggtaacccggttagggtacccgaccgttccgtccgtaccacgtccctaccgtaacccgg

SEQ ID NO: 136947 - DNA, 547 bp, Homo sapiens
  misc_feature: GYAE6OF02H2PTW.16.39.D06.1.454.CMB.1.raw
  modified_base (266)..(266): a, c, t, g, unknown or other
  misc_feature (266)..(266): n is a, c, g, or t
  modified_base (428)..(428): a, c, t, g, unknown or other
  misc_feature (428)..(428): n is a, c, g, or t
  modified_base (436)..(436): a, c, t, g, unknown or other
  misc_feature (436)..(436): n is a, c, g, or t
  modified_base (529)..(529): a, c, t, g, unknown or other
  misc_feature (529)..(529): n is a, c, g, or t
  modified_base (534)..(534): a, c, t, g, unknown or other
  misc_feature (534)..(534): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccagccgggggggtccctgagactctcctgtgcagcctntgggttcagcgtcagtacaaccacgtgatgtgggtccgccagccctccgaggggaaggggctggaatgggtctcagttatgaaaatgatggtgacacaatctacgccgactccgtgaacgggccattcaccatctccagagacaattccaagaacacggtanaatcttanaaattgaacagcctagagaaccgagacacgccgtatattattgtatagtatgtagtagtcgggcccgtgggccagggaaccgtggcaccgtcncctcncgtcctaccaccg

SEQ ID NO: 136948 - DNA, 559 bp, Homo sapiens
  misc_feature: GYAE6OF02I88HN.16.39.D06.1.454.CMB.1.raw
  modified_base (363)..(363): a, c, t, g, unknown or other
  misc_feature (363)..(363): n is a, c, g, or t
  modified_base (407)..(407): a, c, t, g, unknown or other
  misc_feature (407)..(407): n is a, c, g, or t
  modified_base (427)..(427): a, c, t, g, unknown or other
  misc_feature (427)..(427): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccaggccgggggggtccctgagactctcctgtgcagcctctgggttcagcgtcagtaacaaccacgtgatgtgggtccgccagccctccgaggggaaggggctgggaatgggtctcagttattgaaaatgatggtnacacaatctacgccgactcgtgaacgggccatcacatctcaganacaatccaagaacacggtanaactcttacaaatgaacagcctagacgaaccgaggacacggctatattattagtatagttatgtagtagttcgggcccgtgggccaggggtaaccgtggtcacccggtctccctcacgtccctccgaacccg

SEQ ID NO: 136949 - DNA, 547 bp, Homo sapiens
  misc_feature: GYAE6OF02HCP2X.16.39.D06.1.454.CMB.1.raw
  modified_base (352)..(352): a, c, t, g, unknown or other
  misc_feature (352)..(352): n is a, c, g, or t
  modified_base (404)..(404): a, c, t, g, unknown or other
  misc_feature (404)..(404): n is a, c, g, or t
  modified_base (426)..(426): a, c, t, g, unknown or other
  misc_feature (426)..(426): n is a, c, g, or t
  modified_base (530)..(530): a, c, t, g, unknown or other
  misc_feature (530)..(530): n is a, c, g, or t
  modified_base (536)..(536): a, c, t, g, unknown or other
  misc_feature (536)..(536): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggtttccttgctgctattttaaaggtgtccagtgtgaggtgtacttggtggagtctggaggaggcttgacccaggccgggggggtccctgagactctcctgtgcagcctcgtggttcagcgtcagtaacaaccacgtgatgtgggtccgccagcctccgagggagggctaggaatgggtctcagttatagaaaatgatggtnacactaatctacgccgactcgtaggaacgggccattcacactcctaccaganacaattaccgaagaacacgtanaactcttacaaatgaacagcctagacgaaccgagacgacggacgtatatattagtattaggttatggtagtaagttcggcctgggctaggaccgtgtcacgtcnctgacncctccacacgg

SEQ ID NO: 136950 - DNA, 623 bp, Homo sapiens
  misc_feature: GYAE6OF02HCH1W.16.39.D06.1.454.CMB.1.raw
  modified_base (306)..(306): a, c, t, g, unknown or other
  misc_feature (306)..(306): n is a, c, g, or t
  modified_base (391)..(391): a, c, t, g, unknown or other
  misc_feature (391)..(391): n is a, c, g, or t
  modified_base (399)..(399): a, c, t, g, unknown or other
  misc_feature (399)..(399): n is a, c, g, or t
  modified_base (420)..(420): a, c, t, g, unknown or other
  misc_feature (420)..(420): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccaggccgggggggtccctgagactctcctgtgcagcctctgggttcagcgtcagtaacaaccacgtgatgtgggtccncagcctccgagggaaggggctggaatgggtctcagttatagaaatgatggtgacacaatcacgccgactcgtgaaggccatcacntctcaganacaattccaagaacacggtanaatcttacaaattgaaacagacctagaacgaaccgaggaaccgaccggtaccgtaattacgtttaattcgttaagttaaggtttaagttgggttaggttaacgtttccgggggacccccgttggggggaccctaagggggtaacccgttgggtacccgtacccggttcgtcccgttaccgacggtcccctacccgaaccccgg

SEQ ID NO: 136951 - DNA, 531 bp, Homo sapiens
  misc_feature: GYAE6OF02F0INH.16.39.D06.1.454.CMB.1.raw
  modified_base (364)..(364): a, c, t, g, unknown or other
  misc_feature (364)..(364): n is a, c, g, or t
  modified_base (399)..(399): a, c, t, g, unknown or other
  misc_feature (399)..(399): n is a, c, g, or t
  modified_base (404)..(404): a, c, t, g, unknown or other
  misc_feature (404)..(404): n is a, c, g, or t
  modified_base (421)..(421): a, c, t, g, unknown or other
  misc_feature (421)..(421): n is a, c, g, or t
  modified_base (428)..(428): a, c, t, g, unknown or other
  misc_feature (428)..(428): n is a, c, g, or t
  modified_base (432)..(432): a, c, t, g, unknown or other
  misc_feature (432)..(432): n is a, c, g, or t
  modified_base (436)..(436): a, c, t, g, unknown or other
  misc_feature (436)..(436): n is a, c, g, or t
  modified_base (476)..(476): a, c, t, g, unknown or other
  misc_feature (476)..(476): n is a, c, g, or t
  modified_base (511)..(511): a, c, t, g, unknown or other
  misc_feature (511)..(511): n is a, c, g, or t
  modified_base (519)..(519): a, c, t, g, unknown or other
  misc_feature (519)..(519): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccaggccgggggggtccctgagactctcctgtgcagccctctgggttcagcgtcagtaacaaccacgtgatgtgggtccgccagcctccgaggggaaggggctggaatggggtctcgagttattagaaaatgatggtgacanaatctacgccactccgtgaaggtcattcaccatcncaganacatccaagacacgtanaatctanaatnaacngctagacgaaccgaggacacggactatattattgatagtntgtagtatcggcctgggcaggacgtgtcaccgtcncctcgacncctccacgacgg

SEQ ID NO: 136952 - DNA, 677 bp, Homo sapiens
  misc_feature: GYAE6OF02GSVWP.16.39.D06.1.454.CMB.1.raw
  modified_base (475)..(475): a, c, t, g, unknown or other
  misc_feature (475)..(475): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccaggccgggggggtccctgagactcctcctgtgcagcctctgggttcagcgtcagtaacaaccacgtgatggtgggtccgccgacgcccgtccgaggggaaggggctagggaagtgggtctcgtaagttagttagaaaagtgaagtggtagaacaactaatcctacgccgtacgtccgtaggaacgggccgtatccaccatctaccagagacaattaccaagaacgacggtagaatctacaaagtanaacgacgcagagaaccggaaggaccgaaccgggcccttaagtactttagttagttaacttaaggttagttagggttaggttaacgtttcccggggtaccccggtagggggtacccggtaaaggggtaacccggttacgggtacccgtaacccggttcccgttacccgtacccgaaccggtccccctacccgtaaaccccggg

SEQ ID NO: 136953 - DNA, 603 bp, Homo sapiens
  misc_feature: GYAE6OF02JXVB3.16.39.D06.1.454.CMB.1.raw
  modified_base (434)..(434): a, c, t, g, unknown or other
  misc_feature (434)..(434): n is a, c, g, or t
tcagtgtactactccacgaccggtgctcgatttagtgacatctcgcagttctttggggggtaggaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccaggccgggggggtccctgagactctcctgtgcagcctcgtgggttcagcgtcagtaacaaccacgtgatggtggtccgccagcctccgaggggaagggctggaagtgggtctcgagttagtagaaaatgagtggtgacacaatctacgccgactccgtagaacgggccattcaccatctccagacgacaattccaaagaacacggtanaattccttacaaattgaacacgactagaacgaaccggaggacaccggtcctaagttattaagttgtaattaaggttagtaggttgtaagttccgggcccgtcggggcctaaggggaccgtggtaccgaccgttacgtcctaccgactccccgtacgaccccgtaacggg

SEQ ID NO: 136954 - DNA, 556 bp, Homo sapiens
  misc_feature: GYAE6OF02HXI0D.16.39.D06.1.454.CMB.1.raw
  modified_base (438)..(438): a, c, t, g, unknown or other
  misc_feature (438)..(438): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgaccccaggccgggggggtccctgagactctcctgtgcagcctctggggttcagcgtcagtaacaaccacgtgatgtgggtccgccagccctccaggggaaggggctggaatgggtctcagttattgaaaatgatggtgacacaatctacgccgactccgtgaaggccgattcacatctccagagacaattccaagaacacggtgaaatcttanaaatgaaacagacctgagaaccgaggaccacggcctaatattatgtataggtatggtgtagttcgggccctggggccaggggaacctggtccaccgtctcctccagccctccaaccgg

SEQ ID NO: 136955 - DNA, 539 bp, Homo sapiens
  misc_feature: GYAE6OF02H61RC.16.39.D06.1.454.CMB.1.raw
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccagccgggggggtccctgagactctcctgtgcagcctctgggttcagcgtcagtaacaaccacgtgatgtgggtccgccagcctccgaggggaaggggctggaatggggtctcagttatgaaaatgatggtgacacaatctacgccgactccgtgaacggccgattcaccatctaccagagacaattaccaaagaacacggtagaatcttacaaatgaacagctagagaaccgaggacacggcctatattatgtatagtatggtgtatcggccgtgggccagggacgtggtcacgtctctcacgcctccacgacgg

SEQ ID NO: 136956 - DNA, 539 bp, Homo sapiens
  misc_feature: GYAE6OF02F2ZOC.16.39.D06.1.454.CMB.1.raw
  modified_base (431)..(431): a, c, t, g, unknown or other
  misc_feature (431)..(431): n is a, c, g, or t
  modified_base (448)..(448): a, c, t, g, unknown or other
  misc_feature (448)..(448): n is a, c, g, or t
  modified_base (523)..(523): a, c, t, g, unknown or other
  misc_feature (523)..(523): n is a, c, g, or t
  modified_base (525)..(525): a, c, t, g, unknown or other
  misc_feature (525)..(525): n is a, c, g, or t
  modified_base (527)..(527): a, c, t, g, unknown or other
  misc_feature (527)..(527): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctatttaaaaggtgtccagtgtgaggtgtacttggtggagtctggaggaggcttgacccagccgggggggtccctgagactctcctgtgcagcctctgggttcagcgtcagtaacaaccacgtgatgtgggtccgccagccctccgaggggaaggggctgggaatgggtctcagttattgaaaatgatggtgacataatctacgccgactccggtagaacgggccattcaccatcctccagacgaacaattaccaagaacacggtanaatctacaaatgaaacngcctagacgaaccgagacacggactatattatgtatagtatgtgtatcggccgtgggcaggacgtgcacgtctcncncncctccacgacgg

SEQ ID NO: 136957 - DNA, 571 bp, Homo sapiens
  misc_feature: GYAE6OF02IMTHS.16.39.D06.1.454.CMB.1.raw
  modified_base (434)..(434): a, c, t, g, unknown or other
  misc_feature (434)..(434): n is a, c, g, or t
  modified_base (455)..(455): a, c, t, g, unknown or other
  misc_feature (455)..(455): n is a, c, g, or t
  modified_base (472)..(472): a, c, t, g, unknown or other
  misc_feature (472)..(472): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccaggccgggggggtccctgagactctcctgtgcagcctctgggttcagcgtcagtaacaaccacgtgatgtgggtccgccagccctccgaggggaaggggctgggaatgggtctcagttatagaaatgatggtgacacaatctacgccgactcgtgaacgggccattcaccatctaccagacgactaattccaaagaacacggtanaacttcttacaaatcgaaacncgcctagaacgaaccgnggaccacggaccgtatattatgtagtagttatggtagtagttcggcccgtgggccaggggtacctggtaccaccgtctcctcacgtccctaccaaccgg

SEQ ID NO: 136958 - DNA, 549 bp, Homo sapiens
  misc_feature: GYAE6OF02FOXW0.16.39.D06.1.454.CMB.1.raw
  modified_base (299)..(299): a, c, t, g, unknown or other
  misc_feature (299)..(299): n is a, c, g, or t
  modified_base (375)..(375): a, c, t, g, unknown or other
  misc_feature (375)..(375): n is a, c, g, or t
  modified_base (414)..(414): a, c, t, g, unknown or other
  misc_feature (414)..(414): n is a, c, g, or t
  modified_base (432)..(432): a, c, t, g, unknown or other
  misc_feature (432)..(432): n is a, c, g, or t
  modified_base (516)..(516): a, c, t, g, unknown or other
  misc_feature (516)..(516): n is a, c, g, or t
  modified_base (522)..(522): a, c, t, g, unknown or other
  misc_feature (522)..(522): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagttttggctgagtgggtttccttggctaggctatttaaagtagtccagtgtgaggtgtacttggtggagtctggaggaggcttgacccagccgggggggtccctgagactctcctgtgcagcctctgggttcagcgtcagtaacaaccacgtgatgtgggtccnccagcctccgaggggaggggctggaatgggtctcagttattagaaatgatggtagacacaatctacgccgactcgngaaggccatcacatctcagagacaatcaagacacggtanaatcttacaaatcgaacncgctagacgaaccgaggacacggcctatattatgtataggttatggtagtaacgttcggccgtgggcgacggaaccgtggtacncccgtntccgtacgacgccctaccacgtaacgg

SEQ ID NO: 136959 - DNA, 565 bp, Homo sapiens
  misc_feature: GYAE6OF02GVKP0.16.39.D06.1.454.CMB.1.raw
  modified_base (427)..(427): a, c, t, g, unknown or other
  misc_feature (427)..(427): n is a, c, g, or t
  modified_base (441)..(441): a, c, t, g, unknown or other
  misc_feature (441)..(441): n is a, c, g, or t
  modified_base (446)..(447): a, c, t, g, unknown or other
  misc_feature (446)..(447): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccagccgggggggtccctgagactctcctgtgcagcctctgggttcagcgtcagtaacaaccacgtgatgtgggtccgccagccctccgaggggaaggggctgggaatggggtctcagttattagaaaatgatggtgacacaatctacgccgactccgtgaacgggccattcacatctaccagagacaattccaagaacacggtnaactcttacaaatnaaacnncctagagacgagacacggcctatattatgtataggttatggtagtaattccgggcccgtggggccaaggggtaccgtggtacctaccgtctcctcgacgtcctacccacgtaaccggg

SEQ ID NO: 136960 - DNA, 559 bp, Homo sapiens
  misc_feature: GYAE6OF02HN62L.16.39.D06.1.454.CMB.1.raw
  modified_base (354)..(354): a, c, t, g, unknown or other
  misc_feature (354)..(354): n is a, c, g, or t
  modified_base (489)..(489): a, c, t, g, unknown or other
  misc_feature (489)..(489): n is a, c, g, or t
  modified_base (539)..(539): a, c, t, g, unknown or other
  misc_feature (539)..(539): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggtttccttgctgctattttaaaaggtgtccagtgtgaggtgtacttggtggagtctggaggaggcttgacccaggccgggggggtccctggagactctcctgtgcagcctctgggttcagcgtcagtaacaaccacgtgatgtgggtccgccagcctccgaggggagggctggaagtgggtctcagttatagaaaatgatggngacacatctacgccgactcgtgaacgggccgattcaccatcctcagagacaattccaaagaacgacggtagaactcttacaaatgaacagacctagacgaaccgaggacacggacctatattattgtatggttanggttagtagttcgggccgtaggggcacgggaccgtggtaccacgtctccncacgccctaccgaccaacgg

SEQ ID NO: 136961 - DNA, 555 bp, Homo sapiens
  misc_feature: GYAE6OF02HI1JL.16.39.D06.1.454.CMB.1.raw
  modified_base (355)..(355): a, c, t, g, unknown or other
  misc_feature (355)..(355): n is a, c, g, or t
  modified_base (538)..(538): a, c, t, g, unknown or other
  misc_feature (538)..(538): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctatttaaaaggtgtccagtgtgaggtgtacttggtggagtctggaggaggcttgacccaggccggggggtccctggagactctcctgtgcagcctctgggttcagcgtcagtaacaaccacgtgatgtgggtccgccagccctccaggggaaggggctgggaatgggtctcagttatgaaaatgatggtnacacaatctacgccgactccgtgaagggcgattcacatctccagacgacaattccaaagaacacggtagaactcttacaaatgaaacagcctagagaaccgaggacacggcgtaatacttatgttataggttatggtagtattcgggcccgtgggccagggtaccgtggtccaccgtctcctnacgcctccgacaccggg

SEQ ID NO: 136962 - DNA, 544 bp, Homo sapiens
  misc_feature: GYAE6OF02HH6HX.16.39.D06.1.454.CMB.1.raw
tcagtgtactactccacgaccggtgctcgatttagtgacatctcgcagttctttgggttttggggagaggagcccagcactgggattccgaggtgtttccattcggtgatcagcactgaacacagaggactcaccatggagttttggttgagttgggttttccttgctgctattttaaaaggtgtccagtgtgaggtgtacttggtggagtctggaggaggcttgacccagccgggggggtccctgagactctcctgtgcagcctctgggttcagcgtcagtaacaaccacgtgatgtgggtccgccagcctccagggaagggctggaatgggctcagttatgaaaatgatggtgacacaatctacgccgactcgtgaagggccattcaccatctccagagacaattccaagaacacggtgaatcttacaaatgaacagcctagacgaaccgaggacacggccgtatatattgtataggttatggtgtaatcgggccctggggccagggaccgtggtcaccgtctcctcacgcctccaccacgg

SEQ ID NO: 136963 - DNA, 680 bp, Homo sapiens
  misc_feature: GYAE6OF02GLWC2.16.39.D06.1.454.CMB.1.raw
  modified_base (444)..(444): a, c, t, g, unknown or other
  misc_feature (444)..(444): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccagccgggggggtccctgagactctcctgtgcagcctctggggttcagcgtcagtaacaaccacgtgatggtgggtccgccagccctccgagggagggcgtggaagtgggtctcgagttatagaaatgatggtgacacaatctacgccgactccgtaggaacgggccgattccaccatcctaccgagacgactaacttaccaaagaacacgggtanaacttcttaacaaattacgaacacgaccctagaacgaaacccggagggaaccgaccgggtacccgttaaagttacgtttaagtttacgtaagtttaagggtttaagttaggggttaggttaacggttcccggggcccccgggttagggggacccggtaacgggggtaacccggtttcgggtacccgtacccgggttccttccccgtacgaccggtccccttaccccgaaccccggg

SEQ ID NO: 136964 - DNA, 635 bp, Homo sapiens
  misc_feature: GYAE6OF02H8QFW.16.39.D06.1.454.CMB.1.raw
  modified_base (443)..(443): a, c, t, g, unknown or other
  misc_feature (443)..(443): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggagggcttgacccaggccgggggggtccctgagactctcctgtgcagcctctggggttcagcgtcagtaacaaccacgtgatgtgggtccgccagccctccgaggggaaggggctaggaagttgggtctcgagttatagaaaatgaatggtgacacaatcacgccgactccggagaacgggccattcaccatctaccagacgtacaacttccaaagaaacacggtnaaactcttacaaaattgaaacagcctagaacgaaaccggaggaaccgaaccgggtccgtaaattaacgtttagttacgttaagttaggtttaagttgggttacgtaacgtttcccggggaccctgggggacccaagggggtaacccgtggttaccgaccggttctcccgttacacgtccctaccgaacccgg

SEQ ID NO: 136965 - DNA, 544 bp, Homo sapiens
  misc_feature: GYAE6OF02FHQHP.16.39.D06.1.454.CMB.1.raw
  modified_base (533)..(533): a, c, t, g, unknown or other
  misc_feature (533)..(533): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccagccgggggggtccctgagactctcctgtgcagcctctgggttcagcgtcagtaacaaccacgtgatgtggtccgcagcctccagggaaggggctggaagtgggtctcagttattgaaaatgatggtgacacaatctacgccgactccgtgaagggccgattcaccatctccagagacaattaccaagaacacggtagaatctacaaatgaacagcctgacgaaccgaggacacggacgtatattattgtataggttatggtgtagtcgggcccgtgggccagggaccgtggcacgtctcctcncgcctcgaccg

SEQ ID NO: 136966 - DNA, 546 bp, Homo sapiens
  misc_feature: GYAE6OF02F3FL8.16.39.D06.1.454.CMB.1.raw
  modified_base (362)..(362): a, c, t, g, unknown or other
  misc_feature (362)..(362): n is a, c, g, or t
  modified_base (427)..(427): a, c, t, g, unknown or other
  misc_feature (427)..(427): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccagccgggggggtccctgagactctcctgtgcagcctctgggttcagcgtcagtaacaaccacgtgatgtgggtccgccagcctccagggaaggggctggaatgggtctcagttattgaaaatgatggtgacanaatctacgccgactccgtgaagggccgattcaccatctccagagacaattccaaagaacacggtnaatctacaaatgaacagcctagacgaaccgaggacacggccgtatattattgtataggttatggtgtattcggcccgtgggccagggacctggtcaccgtctccgtcacgcctcaaccg

SEQ ID NO: 136967 - DNA, 683 bp, Homo sapiens
  misc_feature: GYAE6OF02HCSXZ.16.39.D06.1.454.CMB.1.raw
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaggtgtccagtgtgaggtgtacttggtggagtctggaggaggcttgacccgaggccggggggtccctgagactctcctgtgcagcctcgtggttcagcgtcagtaacaaccacgtgatgtcgggtccgccagccctccgaggggaacgggctaggaagtgggtctcgtagttattagaaatgagtggtagacaacaatctacgccgtacgtcggtaggaacggccgtattaccaccacttcctaccgaagtacgaactaaacgttaccaaaacggaacgtaacggtagtaaacttacttaacaaaagttacgaaacacggtacctaaggaaaccgaaccggaaggaacccgaaccggtaccgttaagttaatttaagttagttaaggttaggttaagttagggttaggttaaccggttcccgggaccccggtaggggacccgaggggtaacccgtgggtaccctaccgtcccgtaccgtaccgaccgtccctacccgtaacccgg

SEQ ID NO: 136968 - DNA, 634 bp, Homo sapiens
  misc_feature: GYAE6OF02IW72M.16.39.D06.1.454.CMB.1.raw
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccaggccgggggggtccctgagactctcctgtgcagcctcgtgggttcagcgtcagtaaccaaccacgtgatgtcgggtccgccagccctcgaggggagggctaggaagtgggtctcgagttattagaaatgagtggtagacacaagtctacgccgtactcgtaggaagggccgattcaccatctaccagaacgactaattaccaaagaaccacggtagaaattcctacaaatcgaacagcctagaacgaaccggaggacgaccggtaccgtaattacgtttaagttagttaagttaggtttaagtgggttaggtaacgtttcgggaccccggttggggacccgtaaggggaacccgttggtacccgaaccggttactcccgtacgacgtcccctaccgtaacccgg

SEQ ID NO: 136969 - DNA, 554 bp, Homo sapiens
  misc_feature: GYAE6OF02G2OIC.16.39.D06.1.454.CMB.1.raw
  modified_base (356)..(356): a, c, t, g, unknown or other
  misc_feature (356)..(356): n is a, c, g, or t
  modified_base (421)..(421): a, c, t, g, unknown or other
  misc_feature (421)..(421): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctattttaaagggtgtccagtgtgaggtgtacttggtggagtctggaggaggcttgacccagccgggggggtccctgagactctcctgtgcagcctctgggttcagcgtcagtaacaaccacgtgatgtgggtccgccagccctccagggaaggggctgggaatggggtctcagttattgaaaatgatggtnacacaatctacgcgactcgtgaagggccattcacatctaccagagacaattcaagaacacggtanaatctacaaatgaacagcctagagaaccgaggacacggccgtatattattgtataggttatggtagtaattcgggccctggggcccagggtaaccgtggtacaccgtctcctcacgtcctccaccgtaacggg

SEQ ID NO: 136970 - DNA, 529 bp, Homo sapiens
  misc_feature: GYAE6OF02H7HZH.16.39.D06.1.454.CMB.1.raw
  modified_base (358)..(358): a, c, t, g, unknown or other
  misc_feature (358)..(358): n is a, c, g, or t
  modified_base (379)..(379): a, c, t, g, unknown or other
  misc_feature (379)..(379): n is a, c, g, or t
  modified_base (395)..(395): a, c, t, g, unknown or other
  misc_feature (395)..(395): n is a, c, g, or t
  modified_base (515)..(515): a, c, t, g, unknown or other
  misc_feature (515)..(515): n is a, c, g, or t
  modified_base (517)..(517): a, c, t, g, unknown or other
  misc_feature (517)..(517): n is a, c, g, or t
  modified_base (519)..(519): a, c, t, g, unknown or other
  misc_feature (519)..(519): n is a, c, g, or t
  modified_base (524)..(524): a, c, t, g, unknown or other
  misc_feature (524)..(524): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccaggccgggggggtccctgagactctcctgtgcagcctctgggttcagcgtcagtaacaaccacgtgatgtgggtccgccagcctcccaggggaagggggctgggaatgggtctcagttattgaaaatgatggtnacacaatctacgccgactcgngaagggccattcaccntctccagagacaattccaagaacacgtagaatcttacaaatgaacagcctagagaaccgaggacacggccgtatattatgtatagtatgtgtatcggccgtgggcaggacgtgcacgtcncngncctcncacgg

SEQ ID NO: 136971 - DNA, 565 bp, Homo sapiens
  misc_feature: GYAE6OF02G8VNV.16.39.D06.1.454.CMB.1.raw
  modified_base (438)..(438): a, c, t, g, unknown or other
  misc_feature (438)..(438): n is a, c, g, or t
  modified_base (446)..(446): a, c, t, g, unknown or other
  misc_feature (446)..(446): n is a, c, g, or t
  modified_base (471)..(471): a, c, t, g, unknown or other
  misc_feature (471)..(471): n is a, c, g, or t
  modified_base (485)..(485): a, c, t, g, unknown or other
  misc_feature (485)..(485): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaggtgtccagtgtgaggtgtacttggtggagtctggaggaggcttgacccaggccgggggggtccctgagactctcctgtgcagcctctgggttcagcgtcagtaacaaccacgtgatgtgggtccgccagcctccaggggaaggggctggaatggggtctcagttattagaaaatgatggtgacacaatctacgccgactccggtaggaacgggccgattccacctatctccgagacgacaattcccaagaacacggtnaactctanaaattgaacagcctagacgaaccgngacacggctatatntgtatagttatggtagtatccgggcccgtgggaccagggaaccgtggtaccaccggtcctcctccacgtcctaccaccgg

SEQ ID NO: 136972 - DNA, 546 bp, Homo sapiens
  misc_feature: GYAE6OF02H2QKV.16.39.D06.1.454.CMB.1.raw
  modified_base (402)..(402): a, c, t, g, unknown or other
  misc_feature (402)..(402): n is a, c, g, or t
  modified_base (421)..(421): a, c, t, g, unknown or other
  misc_feature (421)..(421): n is a, c, g, or t
  modified_base (429)..(429): a, c, t, g, unknown or other
  misc_feature (429)..(429): n is a, c, g, or t
  modified_base (449)..(449): a, c, t, g, unknown or other
  misc_feature (449)..(449): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaggtgtccagtgtgaggtgtacttggtggagtctgggaggaggcttgaccccagccgggggggtccctgagactctcctgtgcagcctctgggttcagcgtcagtaacaaccacgtgatgtgggtccgccagcctccgaggggaaggggctgggaatgggctcagttatgaaatgatggtgacacaatctacgccgactcgtgaggccgatcacatctccaganacaattccaagaacaggtnaatcttanaaatgaacagctgagaaccnggacacggctatattatgtataggttatggttagtagttccgggcccgtggggcctaggggaccgtggctaccgtctcctcgacgccctccaaccgg

SEQ ID NO: 136973 - DNA, 555 bp, Homo sapiens
  misc_feature: GYAE6OF02FSJ1V.16.39.D06.1.454.CMB.1.raw
  modified_base (358)..(358): a, c, t, g, unknown or other
  misc_feature (358)..(358): n is a, c, g, or t
  modified_base (428)..(428): a, c, t, g, unknown or other
  misc_feature (428)..(428): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccaggcccgggggggtccctgagactctcctgtgcagcctctgggttcagcgtcagtaacaaccacgtgatgtgggtccgccagcctccaggggaaggggctgggaatggggtctcagttattgaaaatgatggtnacacaatctacgccgactccgtgaacgggccgattcaccatcctcagagacaattccaagaacacggtanaatctacaaatgaacagcctagaagaaccgaggacacggaccgtatattattgtataggttatggtagtatcgggccctggggccagggaccgtggtcaccgtctcctcacgcctaccacgtaccgg

SEQ ID NO: 136974 - DNA, 686 bp, Homo sapiens
  misc_feature: GYAE6OF02I92EQ.16.39.D06.1.454.CMB.1.raw
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctatttaaaaggtgtccagtgtgaggtgtacttggtggagtctgggaggaggcttgacccgaggccgggggggtccctggagactctccgtgtgcagcctctgggttcagcgtcagtaacaaccacgtgatgtcggtccgcacgcctccgaggggaagggcgtaggaagtcgggtctcgtagtttagtagaaaatgatggtagacaacaatctacgccgacgtccgtaggaacgggccattaccaccatcctacgagactaacaattaccgaaacgaactacggtagtaactacttaacgaaaatcgaaaccagtaccctaaggaacgtaaccggaagggaacctaaccgggtaccttattaacgttacgtttaaggtaacgtttaaggttagttacggggttaggtaaacgtttcccggggtacccgtacgggggaaccgtaacggggttacccggtggtacccgtaaccgttcccgttaccgtccgtaacggccccttacccggaacccgtaacccgggg

SEQ ID NO: 136975 - DNA, 570 bp, Homo sapiens
  misc_feature: GYAE6OF02JGH4X.16.39.D06.1.454.CMB.1.raw
  modified_base (397)..(397): a, c, t, g, unknown or other
  misc_feature (397)..(397): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccagccgggggggtccctgagactctcctgtgcagcctctgggttcagcgtcagtaacaaccacgtgatgtgggtcccgccagcctccaggggaaggggctgggaatgggtctcagttatgaaaatgatggtgacacgaatctacgccgactccgtgaagggccattcaccatcnccagagactaattccaagaacacggtgaatcttacgaaatgaaacagcctagaacgaacccgaggaccacggccgtatacttattgtataggttatgggtagttaattccgggccgtgggccgacgggaccgtggtaccgtacgtctcctacgacgtcctccaccgtaaccgg

SEQ ID NO: 136976 - DNA, 566 bp, Homo sapiens
  misc_feature: GYAE6OF02I0CKX.16.39.D06.1.454.CMB.1.raw
  modified_base (360)..(360): a, c, t, g, unknown or other
  misc_feature (360)..(360): n is a, c, g, or t
  modified_base (401)..(401): a, c, t, g, unknown or other
  misc_feature (401)..(401): n is a, c, g, or t
  modified_base (406)..(406): a, c, t, g, unknown or other
  misc_feature (406)..(406): n is a, c, g, or t
  modified_base (427)..(427): a, c, t, g, unknown or other
  misc_feature (427)..(427): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggagtttggctgagttgggttttccttgctgctattttaaaaggtgtccagtgtgaggtgtacttggtggagtctggaggaggcttgacccaggccgggggggtccctgagactctcctgtgcagcctctgggttcagcgtcagtaacaaccacgtgatgtgggtccgccagccctcgaggggaaggggctggaatgggtctcagttatagaaaatgatggtnacacaatctacgccgactccgtgaagggccattccacatcncaganacaattccaagaacacggtanaatctacaaatgaacagcctagaacgaaccggagaacgacggaccgtatattagttagtaagtaggttatgggtagttacgttcgggcccgtgggccgaagggaccgtggtccaccgtctcctcgacgtccaccgaccg

SEQ ID NO: 136977 - DNA, 539 bp, Homo sapiens
  misc_feature: GYAE6OF02I4ORW.16.39.D06.1.454.CMB.1.raw
  modified_base (395)..(395): a, c, t, g, unknown or other
  misc_feature (395)..(395): n is a, c, g, or t
  modified_base (398)..(398): a, c, t, g, unknown or other
  misc_feature (398)..(398): n is a, c, g, or t
  modified_base (416)..(416): a, c, t, g, unknown or other
  misc_feature (416)..(416): n is a, c, g, or t
  modified_base (430)..(431): a, c, t, g, unknown or other
  misc_feature (430)..(431): n is a, c, g, or t
  modified_base (505)..(505): a, c, t, g, unknown or other
  misc_feature (505)..(505): n is a, c, g, or t
  modified_base (520)..(520): a, c, t, g, unknown or other
  misc_feature (520)..(520): n is a, c, g, or t
tcagtgtactactccacgaccggtgctcgatttagtgacatctcgcagttctttgggggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccaggccggggggtccctgagactctcctgtgcagcctctgggttcagcgtcagtaacaaccacgtgatggtgggtccgccagcctcgaggggagggctggatggggtctacgagttattagaaaatgagtggtagacacaatctacgccgactcgtaggaaggcattcacntcncagagacatcaagacagnatctacaatgaacnncagacgaccgagacacggctatattatgtagttagtagtggtagtagttccgggccgtgggccgagggtaccgnggtccaccgtctccncacgcctccaccgaaccgg

SEQ ID NO: 136978 - DNA, 596 bp, Homo sapiens
  misc_feature: GYAE6OF02H8RU4.16.39.D06.1.454.CMB.1.raw
  modified_base (366)..(366): a, c, t, g, unknown or other
  misc_feature (366)..(366): n is a, c, g, or t
tcagtgtactactccacgaccggtgctcgatttagtgacatctcgcagttctttggttttggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccaggccgggggggtccctgagactctcctgtgcagcctcgtgggttcagcgtcagtaacaaccacgtgatggtcgggtccgccagccctaccgaggggaaggggctggaagtggtctctagttatagaaatgatggtanacacatcacgccgactcgtagacggcactcaccatcctcagacgacaacttaccaaagaacgaggtacgtaactcttaacaaatgaaaccagacctagaacgaaccgaggaccacggcctaagtattattagtagtaggtagttgggtagtacgttcggcccggtgggaccgacgggtaaccgttcggtaccgtacccgtctcccgtaccgacgtccctacctaacccgg

SEQ ID NO: 136979 - DNA, 679 bp, Homo sapiens
  misc_feature: GYAE6OF02JJ89A.16.39.D06.1.454.CMB.1.raw
  modified_base (226)..(226): a, c, t, g, unknown or other
  misc_feature (226)..(226): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccgngccgggggggtcctggagacgtctcctgtcgcagcctcgtggttcagcgtcagtaacaccacgtgactgtggtccgcaggcctccgagggagggctagggaatggggtctcgtagttattacggaaatgtagtggtgacacaatcgtacgcgtactccggtagaacggggtcaagttccaacctacttccgacacgaacgtaactaactttaccggaaacgtaaaccgaccggttagaaacgttccgtttaacgaaaagttcgaaacgtacgtacccgttagaaacgaacccgaagggaacccgtaccgggaacccgttatacgtttaacttaggttaacttaacgggttatgggttacgtaacgtttccggggcccgttaggggtaccccgaagggtaccgtacgggttcaacccgttcgtacctccgaagtcccctacgaccgtaaccggg

SEQ ID NO: 136980 - DNA, 539 bp, Homo sapiens
  misc_feature: GYAE6OF02GP792.16.39.D06.1.454.CMB.1.raw
  modified_base (299)..(299): a, c, t, g, unknown or other
  misc_feature (299)..(299): n is a, c, g, or t
  modified_base (303)..(303): a, c, t, g, unknown or other
  misc_feature (303)..(303): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctattttaaaaggtgtccagtgtgaagtgtacttggtggagtctggaggaggcttgacccagccgggggggtcctgagactctcctgtgcagcctctgggttcagcgtcagtaacaaccacgtgatgtgggtccnccancctccagggaaggggctggaatgggtctcagttatgaaaatgatggtgacacaatctacgccgactccgtgaaggccgattcaccatctcagagacaattccaagaacacggtgaatctcaaatgaacagcctgagaaccgaggacacggccgtatattattgtataggtatgtgtaagttcggcccgtgggccagggaaccgtggtcacgtctccgtcacgcctaccaccaacgg

SEQ ID NO: 136981 - DNA, 689 bp, Homo sapiens
  misc_feature: GYAE6OF02JO83M.16.39.D06.1.454.CMB.1.raw
  modified_base (357)..(357): a, c, t, g, unknown or other
  misc_feature (357)..(357): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaggtgtccagtgtgaggtgtacttggtggagtctggaggaggcttgacccaggccggggggtccctggagactctcctgtgcagcctcgtgggttcagcgtcagtaacaaccacgtgatgtggtccgccagcctccgagggaagggctggaatgggtctcagttatagaaatgatggtnacacaatctacgccgactcgtagaacgggcctattaccacctactcctaccgaagacgaactaacttaccaaaggaaccacggtagtaaactccttaacaaagtcgaaaccacgccgtagaacgtaaccggaacggaaccgaccgggtacccgttaaattaacgttaacgtttagttaacgttagggtttaagttaggggttaggttaaccgttccggggtacccccggttagggggtacccgtaacgggggtaacccggttacgggttacccgtaacccgggttcccgttacccggtccgtaacccggttccccgtaccccgtaacccggg

SEQ ID NO: 136982 - DNA, 569 bp, Homo sapiens
  misc_feature: GYAE6OF02HVTDZ.16.39.D06.1.454.CMB.1.raw
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctattttaaaaaggtgtccagtgtgaggtgtacttggtggagtctggaggaggcttgacccagccgggggggtccctgagactctcctgtgcagcctctgggttcagcgtcagtaacaaccacgtgatgtgggtccgccagcctccaggggaaggggctgggaatgggtctcgagttattgaaaatgaatggtgaacacaatctacgcgactccgtgaacgggccaattcaccatctccagagactaattccaaagaacacggtgaaatcttacaaatgaaacagcctagaagaaccggaggacacggccgtaatacttaattgtattaggttatggtgtaattcgggacccgtgggccgtagggacgtggtctaccgtctcctcgacgcctaccaccgtaacgg

SEQ ID NO: 136983 - DNA, 551 bp, Homo sapiens
  misc_feature: GYAE6OF02JG09P.16.39.D06.1.454.CMB.1.raw
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccagccgggggggtccctgagactctcctgtgcagcctctgggttcagcgtcagtaacaaccacgtgatgtgggtccgccagcctccagggaaggggctggaatgggtctcagttatgaaaatgatggtgacacaatctacgccgactccgtagaagggccgattccaccatctcagagacaattccaaagaacacggtgaatcttcaaatgaacagcctgagaaccgaggacacggccgtatacttattagtataggttatgggtaggtaattcgggccctggggccagggaccgtggtacaccgtctcctcagccctccaccacggg

SEQ ID NO: 136984 - DNA, 554 bp, Homo sapiens
  misc_feature: GYAE6OF02GGZ3Q.16.39.D06.1.454.CMB.1.raw
  modified_base (429)..(429): a, c, t, g, unknown or other
  misc_feature (429)..(429): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatgggagttttggctgagttgggttttccttgctgctattttaaaaggtgtccagtgtgaggtgtacttggtggagtctggaggaggcttgacccagccgggggggtccctgagactctcctgtgcagcctctgggttcagcgtcagtaacaaccacgtgatgtgggtccgccagcctccgaggggaaggggctggaatgggtctcagttatagaaaatgatggtgacacaatctacgccgactccgtgaacgggccattcacatctccagagacaattccaagaacacggtanaactcttacaaatgaacagcctagacgaaccgaggacacggccgtatattattgtataggttatggtagtattcgggccctggggccagggaccgtggtcaccgtctccgtcacgtcctcaaccg

SEQ ID NO: 136985 - DNA, 631 bp, Homo sapiens
  misc_feature: GYAE6OF02JPVJV.16.39.D06.1.454.CMB.1.raw
  modified_base (369)..(369): a, c, t, g, unknown or other
  misc_feature (369)..(369): n is a, c, g, or t
  modified_base (402)..(402): a, c, t, g, unknown or other
  misc_feature (402)..(402): n is a, c, g, or t
  modified_base (434)..(434): a, c, t, g, unknown or other
  misc_feature (434)..(434): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaggtgtccagtgtgaggtgtacttggtggagtctggaggaggcttgacccaggccgggggggtccctgagactctcctgtgcagcctcgtgggttcagcgtcagtaacaaccacgtgatggtgggtccgccagccctccgaggggaacgggctgggaatgggtctcgtagttatagaaatgatggtgacanatctacgccgactcgtgaagggcctattcaccntctcgagagacaacttccaaagtacacggtanaactctacaaatcgaaacacgccgtagaacgtaaccggaggaaccgacgggaccgttaatagtttagttagttaagttaggttaagtgggttacggttacgttcccggggtaccccgtgggggtacctaacggggtaacccgttcgggtaccgtacccggtccgtcccgtacgtaccgtcccgtacccgtaacccgg

SEQ ID NO: 136986 - DNA, 593 bp, Homo sapiens
  misc_feature: GYAE6OF02GPGT6.16.39.D06.1.454.CMB.1.raw
  modified_base (585)..(585): a, c, t, g, unknown or other
  misc_feature (585)..(585): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccgaggccgggggggtccctgagactctcctgtgcagcctctgggttcagcgtcagtaacaaccacgtgatgtgggtccgccagccctccgaggggaaggggcgtggaagtgggtctcagttattagaaaatgatggtgacacaatcgtacgccgactccggtaggaacgggccgattccaccactcctccagacgaactaattaccaaagaaccacggtagaatacttacaaatgaactagacctgaacgaaccgaggacgaccggtcgtatattagttgtaagtaggttatggtagttacgtcgggtcccgtggggacctaggggaccgtcggtccgaccgtcgtcctcacgcccnccacccgg

SEQ ID NO: 136987 - DNA, 595 bp, Homo sapiens
  misc_feature: GYAE6OF02GP0ZZ.16.39.D06.1.454.CMB.1.raw
  modified_base (357)..(357): a, c, t, g, unknown or other
  misc_feature (357)..(357): n is a, c, g, or t
  modified_base (434)..(434): a, c, t, g, unknown or other
  misc_feature (434)..(434): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccagccgggggggtccctgagactctcctgtgcagcctctgggttcagcgtcagtaacaaccacgtgatgtgggtccgccagcctccgaggggaggggctgggaatgggtctcagttatagaaaatgatgggtanacacaatctacgccgactccgtaggaacgggcctattccacctatcctccagagaacaattaccaagaacacggtanaatccttacaaatagaacacgacctaggaacgaaccggaggacgacggaccgtatacttattagtattaggttagtggtagtattccgggcccgttggggccaggggtaccgtggttaccgaccgtcctccgtacgaccgcccgtaccgaccgtaaccggg

SEQ ID NO: 136988 - DNA, 646 bp, Homo sapiens
  misc_feature: GYAE6OF02GVLSP.16.39.D06.1.454.CMB.1.raw
  modified_base (378)..(378): a, c, t, g, unknown or other
  misc_feature (378)..(378): n is a, c, g, or t
  modified_base (451)..(451): a, c, t, g, unknown or other
  misc_feature (451)..(451): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccgaggccgggggggtccctggagactctcctgtgcagcctcgtgggttcagcgtcagtaacaaccacgtgatggtgggtcccgccagccctccgaggggaacggggctagggaatggggtctcgtagttattagaaaatgatggtgacanaatcacgccgactccggtagaacgggccattccaccatcctaccagacgacaacttaccaaagaacacggtanaacttctacaaatcgaaacacgacctagaacggaaccggaggaccgacgggtaccgtaattacgttaatttagtaattaaggttagttagggttaggttacgttccggggtaccccgtagggggtacccgtaacggggtaacccgtcggtacccgtacccggttcctcccgtcgaccgtccctacccgaacccgg

SEQ ID NO: 136989 - DNA, 702 bp, Homo sapiens
  misc_feature: GYAE6OF02I3816.16.39.D06.1.454.CMB.1.raw
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgcttattttaaaaggtgtccagtgtgaggtgtacttggtggagtctggaggaggcttgacccgaggcccgggggggtccctggagtactctcctgtgcagcctgtgggttcagcgtcaagtaaccaaccacgtgatggtcgggtccgccaagcccgtcgaagggggaagggctaggagtgggtctgagtttatagaaaatgagtggtagaacaactaaatcctaacgccgtaaccgtccggtaggaacgggtaccattcgaaccctaactcctacccgaaggacgtaaactaaacttacccgaaaaggtaaccgaacgggttaagaaacttcgttaaccaaaagttacgaaacacggtaccttaggaaaccggtaaacccgaaggaccgaacggtaccgtaattagttacgttagttacgtttaaggttacgtagggtacggttacgttccggggaccccggtggggacccgaacggggtaacccgttcgaccgtacccgtcgtccctacgacggacccttacccgaccggtaaccggg

SEQ ID NO: 136990 - DNA, 537 bp, Homo sapiens
  misc_feature: GYAE6OF02FE3C9.16.39.D06.1.454.CMB.1.raw
tcagtgtactactccacgaccggtgctcgatttagtgacatctcgcagttctttggggggagaggagcccagcactgggattccgaggtgtttccattcggtgatcagcactgaacacagaggactcaccatggagtttttggctgagttgggtttttccttgctgctattttaaaaaggtgtccagtgtgaggtgtacttggtggagtctggaggaggcttgacccagccgggggggtccctgagactctcctgtgcagcctctgggttcagcgtcagtaacaacacgtgatgtgggtccgccagcctccaggggaaggggctgggaatgggtctcagttattagaaaatgatggtgacacaatctacgccgactccgtgaagggccgattcaccatcctcagagacaattccaagaacacggtgaacttctacaaatgaacagcctagacgaacgaggacacgcgtatattatgtatagttatggtgtattcggcctgggcaggaccgtgtcacgtctcctcacgcctcacacgg

SEQ ID NO: 136991 - DNA, 566 bp, Homo sapiens
  misc_feature: GYAE6OF02FV9JJ.16.39.D06.1.454.CMB.1.raw
  modified_base (506)..(506): a, c, t, g, unknown or other
  misc_feature (506)..(506): n is a, c, g, or t
  modified_base (552)..(552): a, c, t, g, unknown or other
  misc_feature (552)..(552): n is a, c, g, or t
  modified_base (559)..(559): a, c, t, g, unknown or other
  misc_feature (559)..(559): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccagccgggggggtccctgagactctcctgtgcagcctctgggttcagcgtcagtaacaaccacgtgatgtgggtccgccagccctccgaggggaaggggctggaatggggtctcagttattgaaaatgatggtgacacaatctacgccgactccgtgaacgggccgattcaccatcctccagacgactaacttcccaaagaaccacgggtagaaacttcttacaaattcgaaacagcctagacgaaccgaggacaccggctatattattgattaggtntggtagtagttcgggccctgggccagggaccgtgtccacgtctccnacgtccnccaaccg

SEQ ID NO: 136992 - DNA, 735 bp, Homo sapiens
  misc_feature: GYAE6OF02HN3B0.16.39.D06.1.454.CMB.1.raw
  modified_base (445)..(445): a, c, t, g, unknown or other
  misc_feature (445)..(445): n is a, c, g, or t
tcagtgtactactccacgaccggtgctcgatttagtgacatctcgcaggttctttggggggagaggagcccagcactgggattccgaggtgtttccaattacggtgatcagcactgaacacagaggactcaccatggagttttggctgagttgggtttccttgctgctattttaaaaggtgtccagtgtgaggtgtacttggtggagtcgtggaggaggcttgacccaggccggggggtccctgagactctcctgtgcagcctctgggttcagcgttcagtaacaaccacgtgatgtcgggtcccgccgagccctccgaaggggagggcgtaggaagtgggtctcgagtttatagaaaatgaatggtgacaacaatctacgccgactccgtagaacggcacttccaaccatacctccagacgaacaattccgaaagacacggtanaacttcttaccaaagtcgaaacgacgcccgttaggaacgtaaacccggagggtaaaccaccggggtacccgttaagttaacgtttaacgtttacggttaaacgttaacggggttttaagttacgggggttttagggttaaaccggttttccccggggggacccccgttttagggggggtaccccgaaacggggggttaacccggtcggggtttaccccgaaccccgggttcctttaccccggtaccggtaaccggtacccccgttccccgtaacccggtaaaccccgggg

SEQ ID NO: 136993 - DNA, 774 bp, Homo sapiens
  misc_feature: GYAE6OF02H4ZK4.16.39.D06.1.454.CMB.1.raw
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccaggccgggggggtccctggacgactctcctgtgcagcctcgtgggttcagcgtcaagtaacaaccacgtgatggtcgggtccgccagccctaccgagggaagggctaggaagtcggtctcgtagttagtagaaagtgagtaggtagaacaacgtaatactacgaccgtacgtaccggtaggaccggggacctacgttaccgaacctagttcccgtaccgaagaacgtaacctaaaccgttaccgaaaaggtaaaccgtaagggttacgaaacctttcttaacaaaagttcgaaaaccgacgtcccgttaaggaaaccgaaacccggtaagggaacccgaaccgggtacctaagttaacgtttaagtttagtaaacggtttagggttaacgttaggggttaacggttaaccggtttcccggggtacccccggtggggggttaaccccgaaacgggggttaaccccggttcgggttacccgtacccggtttacccgtacccgtttacccggaaccggttacccccgtaacccggtaaacccccgggg

SEQ ID NO: 136994 - DNA, 693 bp, Homo sapiens
  misc_feature: GYAE6OF02H12YJ.16.39.D06.1.454.CMB.1.raw
tcagtgtactactccacgaccggtgctcgatttagtgacatctcgcagttctttgggggaggaggagcccagcactgggattccgaggtgtttccattcggtgatcagcactgaacacagaggactcaccatggagttttggctgagttgggtttccttgctgctatttaaaggtgtccagtgtgaggtgtacttggtggagtctggaggaggcttgacccaggccgggggggtcctgagactctcctgtgcacggtcctccgtggggttccaggtcgtcgagtaaacgaaccacgtcgagtggtggtccgcgagcccgtccgagggaaggggctaggaatgggtcctcgaagtttagttagaaaattgaagttgggtgaacaacaagtacctacggccgtaacgtcccggtaggaaacgggtccgtaattcgacctacgtctaccgaagagaacgtaaacttccgaaagaaaccgacggttagaaacgttactctaaaacgtagtaaaaccgagaccgtaggtaaagaaccggtaaggaccgaaccggtacccgttaataagtttaacgttagttaacgttaggttaagtagggttaggtaacgttaccggggcccgttacggggacctaacgggtacggtcggtaccgaccgttcgtacccgtccgaccgtccgtacccacgtaacccggg

SEQ ID NO: 136995 - DNA, 565 bp, Homo sapiens
  misc_feature: GYAE6OF02JB0JJ.16.39.D06.1.454.CMB.1.raw
  modified_base (299)..(299): a, c, t, g, unknown or other
  misc_feature (299)..(299): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccagccgggggggtccctgagactctcctgtgcagcctctggttcagcgtcagtaacaaccacgtgatgtgggtccnccagccctccaggggaaggggctggaagtgggtctcgagttattgaaaatgaatggtgacacaatctacgccgactccgtgaaggccgattcaccatcctccagagacaattccaagacgagtgaatcttacaaatgaaacagcctagacgaaccggagacacggtccgtaatattaatgtattagttatgtggtaatcgggccctgggccgagggaaccgtggtaccgaccgttctcgtccacggccctaccgaccgtaaccggg

SEQ ID NO: 136996 - DNA, 565 bp, Homo sapiens
  misc_feature: GYAE6OF02JD2NJ.16.39.D06.1.454.CMB.1.raw
  modified_base (363)..(363): a, c, t, g, unknown or other
  misc_feature (363)..(363): n is a, c, g, or t
  modified_base (447)..(447): a, c, t, g, unknown or other
  misc_feature (447)..(447): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccagccgggggggtccctgagactctcctgtgcagcctctgggttcagcgtcagtaacaaccacgtgatgtgggtccgccagcctccaggggaaggggctggaatgggtctcagttattgaaaatgatggtgacanaatctacgccgactccgtgaagggccgattcaccatctccagagacaattccaaagaacacggtagaatcttacaaatgaacancctagagaaccgaggacacggcgtatattattgtataggttatggtgtattcgggcccgtggggaccaggggtaacccgtggtaccaccggttctacccgtcgacgtcctccaaccgg

SEQ ID NO: 136997 - DNA, 863 bp, Homo sapiens
  misc_feature: GYAE6OF02I9JQT.16.39.D06.1.454.CMB.1.raw
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctatttaaaggtgtccagtgtgaggtgtacttggtggagtctggaggaggcttgacccgaggccggggggtccctgacgactctcctgtgcagcctcgtgggttcagcgtcagtaaccaaccacgtgagtggtgggtccgccacgccgtaccgaaggggaagggctggaagtcggtctcaggttatagaaatgagtggtagacacaactcgtacgccgactccggtaggaacgggccgtacttaccgacctaacgttccgtaccaggaaccggtaactaaaacgtttcccaaaaacgggtaaacccgtaccggggtttaagaaaacctttcccgttaaaacgaaaactttacgggaaaaccctaacggttaaaccccgtgggtaaaacccgggtaaaaaccccggacggggggttaaaaccccgacccggggttaaccccgtttaaaaggtttacccttttaaaaggttttaccgggtttaaaaacgggtttaaggggttttaaacggttaggggtttaaaccgggtttaaacgggtttccccccgggggttacccggggtaaaccggggggttccccgggggtaaaaaccggggttacccggtttaacgggggttcccctaaaccccgggttccccgtttaccgtaacccggtaacccggtacccccttaccccgggaaacccgggtaaaccccgggg

SEQ ID NO: 136998 - DNA, 576 bp, Homo sapiens
  misc_feature: GYAE6OF02HP5MV.16.39.D06.1.454.CMB.1.raw
  modified_base (356)..(356): a, c, t, g, unknown or other
  misc_feature (356)..(356): n is a, c, g, or t
  modified_base (389)..(389): a, c, t, g, unknown or other
  misc_feature (389)..(389): n is a, c, g, or t
  modified_base (418)..(418): a, c, t, g, unknown or other
  misc_feature (418)..(418): n is a, c, g, or t
  modified_base (436)..(436): a, c, t, g, unknown or other
  misc_feature (436)..(436): n is a, c, g, or t
  modified_base (441)..(441): a, c, t, g, unknown or other
  misc_feature (441)..(441): n is a, c, g, or t
  modified_base (485)..(485): a, c, t, g, unknown or other
  misc_feature (485)..(485): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggtttccttgctgctatttaaaggtgtccagtgtgaggtgtacttggtggagtctggaggaggcttgacccaggccgggggggtccctggagactctcctgtgcagcctcgtgggttcagcgtcagtaacaaccacgtgatgtgggtccgcagcctcgaggggagggctagggaatgggtctcgagttattagaaaatgatggtanacacatctacgccactcgtagacggcatccacntctcagagacaataccgaagaacaggtanaatacttacaaatgaacncgacngaacgaccgaggacacggacctatactagttagtattaggttangggttagtaacgttccggggccctagggggacctacggggtaccgtcggtcctaccggtcctaccgtccgacgtcctccgaccgtaaccgg

SEQ ID NO: 136999 - DNA, 648 bp, Homo sapiens
  misc_feature: GYAE6OF02I6AGX.16.39.D06.1.454.CMB.1.raw
  modified_base (302)..(302): a, c, t, g, unknown or other
  misc_feature (302)..(302): n is a, c, g, or t
  modified_base (402)..(402): a, c, t, g, unknown or other
  misc_feature (402)..(402): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccaggccgggggggtccctgagactctcctgtgcagcctctgggttcagcgtcagtaacaaccacgtgatgtcgggtccncagcctccgaggggaagggctaggaagtgggtcctacaggtttattagaaaatgagtggtgaacacaatcacgccgactccgagaacggctacttcaccntctaccaagactacaagttccgaaagacacggtgaaatcctaagaaatgaacagccagacgaaccggagaccgacggtaccgtaattagttagtacgtaagttacggtagttacgggtaaggttaacgttcccggggaccccgttacgggggacccgtaaacgggggaccccgttaggggtacccctaaccgggttccgtccccgttacgaacccggtccccttaccccgaacccggtaacccggg

SEQ ID NO: 137000 - DNA, 584 bp, Homo sapiens
  misc_feature: GYAE6OF02GGPRM.16.39.D06.1.454.CMB.1.raw
  modified_base (371)..(371): a, c, t, g, unknown or other
  misc_feature (371)..(371): n is a, c, g, or t
  modified_base (438)..(438): a, c, t, g, unknown or other
  misc_feature (438)..(438): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctgggaggaggcttggaccccaggccggggggggtccctggagactctcctgtgcagcctctgggttcagcgtcagtaacaaccacgtgatgtgggtccgccagccctccgaggggaagggctggaatggggtctcagttattagaaatgatggtgacanaactctacgccgactccgtggaagggccattcaccatctccagagacaattccaaagaacacggtanaatcttacaaatgaacagcctagacgaaccgagacacggcgtatattatgtataggttatgggtagttagttccgggacccgttggggacccgtaggggaacccgtggtaccaccggttcctccgtacgcgtccctccgaacccgg

SEQ ID NO: 137001 - DNA, 636 bp, Homo sapiens
  misc_feature: GYAE6OF02HWKF4.16.39.D06.1.454.CMB.1.raw
  modified_base (363)..(363): a, c, t, g, unknown or other
  misc_feature (363)..(363): n is a, c, g, or t
  modified_base (444)..(444): a, c, t, g, unknown or other
  misc_feature (444)..(444): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctattttaaaaggtgtccagtgtgaggtgtacttgggtggagtctgggaggaggcttgacccaggccgggggggtccctgagactctcctgtgcagcctctgggttcagcgtcagtaacaaccacgtgatgtgggtccgccacgcctccgaggggaggggcgtaggaagtgggtctcgagttattagaaaatgaatggngacacaatctacgccgactccgtaggaacgggccaattccaaccatcctacaagacgacaaattcccaaagaacacggtanaacgtacttacgaaatgaaacgacgtacctaggaacgaaccggaaggaccgaaccgggaccgtaagttaatttaagttagttaattagggttaatgggtaggttaacgttccgggccccgtggggaccgaacggggtaaccgtgggttaccacccggttcctccgtcacggccctccgaaccgtaacccggg

SEQ ID NO: 137002 - DNA, 587 bp, Homo sapiens
  misc_feature: GYAE6OF02GOGEE.16.39.D06.1.454.CMB.1.raw
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccagccgggggggtccctgagactctcctgtgcagcctctggggttcagcgtcagtaacaaccacgtgatgtgggtccgccagcctccgaggggaaggggctggaatgggtctcagttattgaaaatgatggtgacacaatctacgccgtactccgtgaacggccgattcaccatcctcagacgacaattccaaagaacacggtagaatcttacaaattacgaacagacctagaacgaaccgacggaacgacggccgtaatattattagtataggttagtaggtgtagttccgggcccgtggggaccgaggggtaccgtacggtccaccggtctccctcgacgtccctaccgtaacccgg

SEQ ID NO: 137003 - DNA, 550 bp, Homo sapiens
  misc_feature: GYAE6OF02IN6GD.16.39.D06.1.454.CMB.1.raw
  modified_base (400)..(400): a, c, t, g, unknown or other
  misc_feature (400)..(400): n is a, c, g, or t
  modified_base (405)..(405): a, c, t, g, unknown or other
  misc_feature (405)..(405): n is a, c, g, or t
  modified_base (424)..(424): a, c, t, g, unknown or other
  misc_feature (424)..(424): n is a, c, g, or t
  modified_base (444)..(444): a, c, t, g, unknown or other
  misc_feature (444)..(444): n is a, c, g, or t
  modified_base (540)..(540): a, c, t, g, unknown or other
  misc_feature (540)..(540): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccagccgggggggtccctgagactctcctgtgcagcctctgggttcagcgtcagtaacaaccacgtgatgtgggtccgccacgcctccgaggggaaggggctagggaatgggtctcagttatagaaaatgatggtgacacaatctacgccgactccgtgaaggccgattcaccatccncaganacaaatccaaagacaggtnaatctacaaatgaacagccngacgaacgagacacggactatattattgtattagtgtaggtgtacttcggcccgtgggcctagggaccgtggtccaccgttcgcctcgacctcccnccgaccacgg

SEQ ID NO: 137004 - DNA, 611 bp, Homo sapiens
  misc_feature: GYAE6OF02I7P25.16.39.D06.1.454.CMB.1.raw
  modified_base (361)..(361): a, c, t, g, unknown or other
  misc_feature (361)..(361): n is a, c, g, or t
  modified_base (447)..(447): a, c, t, g, unknown or other
  misc_feature (447)..(447): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccaggccgggggggtccctgagactctcctgtgcagcctcgtggttcagcgtcagtaacaaccacgtgatgtcgggtccgccagccctccgaggggaacgggctggaagtgggtctcgagttatagaaaatgagtggtnaacacaatcgtacgccgtactccggtaggaacgggtccattccacctatcctacgagacgactaacttaccaaacgtacacggtanaattccttacaaatcgaaacagacctagaacgaaccgaggaccgacggtaccttaagtacttagttagttaattagggttatagggttagtacgttcgggcccgtagggaccgagggtaccgtggtaccacgttcctctaccgacgccctaccgaccgtaccgg

SEQ ID NO: 137005 - DNA, 559 bp, Homo sapiens
  misc_feature: GYAE6OF02HUTVQ.16.39.D06.1.454.CMB.1.raw
  modified_base (300)..(300): a, c, t, g, unknown or other
  misc_feature (300)..(300): n is a, c, g, or t
  modified_base (356)..(356): a, c, t, g, unknown or other
  misc_feature (356)..(356): n is a, c, g, or t
  modified_base (415)..(415): a, c, t, g, unknown or other
  misc_feature (415)..(415): n is a, c, g, or t
  modified_base (423)..(423): a, c, t, g, unknown or other
  misc_feature (423)..(423): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccagccgggggggtccctgagactctcctgtgcagcctctgggttcagcgtcagtaacaaccacgtgatgtgggtccncagcctccaggggaaggggctggaatgggtctcagttatgaaaatgatggtgacanatctacgccgactccgaggaacgggccattccacctatcctccagagacaattccaaanaacaggtnaaatcttacaaatgaacagcctagaacgaaccgaggaccacggaccgtatattattgtataggttatggtgtaagttcggcctgggccagggaccgtggtaccaccgtctcctcacgccctaccgaccgtaaccgg

SEQ ID NO: 137006 - DNA, 613 bp, Homo sapiens
  misc_feature: GYAE6OF02JGSTN.16.39.D06.1.454.CMB.1.raw
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccagccgggggggtccctgagactctcctgtgcagcctctgggttcagcgtcagtaacaaccacgtgatgtgggtccgccagcctccgaggggaaggggctgggaatgggtctcagttattgaaaatgatggtgacacaatctacgccgactccgtgaacgggccattcaccatctccagagacaattccaagaacacggtgaatccttacaaagttcgaacacgtacctgaacgaacccggaggaccaccgggaccgtaagtaatttacttagttacgttagtttagtgggtaggttaacgttcgggaccccgttggggacccaagggggtaacccgtgggttaccaccggttcctccgtacgacggtcccttacccaacccggg

SEQ ID NO: 137007 - DNA, 583 bp, Homo sapiens
  misc_feature: GYAE6OF02G1USR.16.39.D06.1.454.CMB.1.raw
  modified_base (304)..(304): a, c, t, g, unknown or other
  misc_feature (304)..(304): n is a, c, g, or t
  modified_base (349)..(349): a, c, t, g, unknown or other
  misc_feature (349)..(349): n is a, c, g, or t
  modified_base (409)..(409): a, c, t, g, unknown or other
  misc_feature (409)..(409): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccgaggccgggggggtccctggagactctcctgtgcagcctcgtgggttcagcgtcagtaacaaccacgtgatgtgggtccnccagcctcaggggaaggggctgggaatgggtctctaacttttagnggtagtggtggtcacgcctactacgcagagtccgtgaagggccattcaccatctccaganacactcgagaacacgctgtatctgcgaatgaacagcctgagagtcgaaggacacggccaattatattacgtgtagacgtaaaagctaccgtaggaacggtcccttaataccccaaccttcgaacggttccaacggttccttacggggtttaccccaccccgggttaccgggggg

SEQ ID NO: 137008 - DNA, 569 bp, Homo sapiens
  misc_feature: GYAE6OF02FIL2A.16.39.D06.1.454.CMB.1.raw
  modified_base (444)..(444): a, c, t, g, unknown or other
  misc_feature (444)..(444): n is a, c, g, or t
  modified_base (511)..(511): a, c, t, g, unknown or other
  misc_feature (511)..(511): n is a, c, g, or t
  modified_base (557)..(557): a, c, t, g, unknown or other
  misc_feature (557)..(557): n is a, c, g, or t
  modified_base (562)..(562): a, c, t, g, unknown or other
  misc_feature (562)..(562): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccaggccgggggggtcctgagactctcctgtgcagcctctgggttcagcgtcagtaacaaccacgtgatggtgggtcccgccagccctccgaggggaaggggctggaatggggtctcagttattagaaaatggatggtagacacaatctacgccgactccggtagaacgggcctattccaccatctccagagacaattacccaaagaaccacggtanaactcttacaaatgaaacagcctagacgaaccggagaccacggtactattatattgtaataggttanggtagtagtcggcccgtgggaccagggaccgtgacaccgtctcctnctccnccaaccg

SEQ ID NO: 137009 - DNA, 648 bp, Homo sapiens
  misc_feature: GYAE6OF02HIMQQ.16.39.D06.1.454.CMB.1.raw
  modified_base (371)..(371): a, c, t, g, unknown or other
  misc_feature (371)..(371): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccaggccgggggggtccctgagactctcctgtgcagcctcgtgggttcagcgtcagtaaccaaccacgtgatgtcgggtccgccagccctccgaggggaacggggctggaagtgggtctcgagttattagaaaatgagtggtanacacaatctacgccgactccgtagaagggccatccaccatcctaccaagacgactaacttaccgaaagaacacggtagaaacttcttaacaaattcgaacacgtcctagaacgaaaccggagaaccgaccgggtaccgtaattaattagttagtaaagttaggttaagttgggttaggttacgttccgggtaccccggtgggggaccctaagggggtaacccgttggtacccgtacccggttcctcccgtacgaccgtccccttacccgaaccccgg

SEQ ID NO: 137010 - DNA, 634 bp, Homo sapiens
  misc_feature: GYAE6OF02GLPI4.16.39.D06.1.454.CMB.1.raw
  modified_base (360)..(360): a, c, t, g, unknown or other
  misc_feature (360)..(360): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctattttaaaggtgtccagtgtgaggtgtacttggtggagtctggaggaggcttgacccaggccgggggggtccctgagactctcctgtgcagcctctgggttcagcgtcagtaacaaccacgtgatgtgggtccgccagcctccgaggggaaggggctgggaagtgggtctcagttattgaaatgatggtgacanaatctacgccgactccgtagaacgggccgattccacatcctaccgagacgaactaacttaccaaagaaccgtacggtagaaacttcttaacaaattgaacacgcctaggaacgaaccgaggaccgacggaccgttaatacgtttaagttcgttaattaggttacgttgggttagtaacggtttccggggaccccgtgggggacccgaagggtacccggtggtaccctcccggttctaccgttccgacggtccccgttaccgaccgtaacccggg

SEQ ID NO: 137011 - DNA, 708 bp, Homo sapiens
  misc_feature: GYAE6OF02H7HY0.16.39.D06.1.454.CMB.1.raw
  modified_base (305)..(305): a, c, t, g, unknown or other
  misc_feature (305)..(305): n is a, c, g, or t
  modified_base (366)..(366): a, c, t, g, unknown or other
  misc_feature (366)..(366): n is a, c, g, or t
  modified_base (450)..(450): a, c, t, g, unknown or other
  misc_feature (450)..(450): n is a, c, g, or t
tcagtgtactactccacgaccggtgctcgatttagtgacatctcgcaggttctttggggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccaggccggggggtccctgagactctcctgtgcagcctcgtgggttcagcgtcaagtaacaaccgacgtgatggtgggtccnccagcctacgaggggaaggggctaggaagtgggtcacgtagttactagaaaatgatggtanacactatctagcctactccgtggaacggcgtattcacctatcctccgagacgaactaattacccgaaagaacccgtaacggtanaacttaccttaacgtaaacgtagtaaaaccgagtacccgttaaggaaaccggtaaaccggtaaacgggaacgtaaccgggtaaccgtattaaacgttttaattacggttaaagttaacgggtttagttaagggtttacggttaacggttcccggggtacccccgtgggggtaacccgtaacggggtaacccggtggtttacccgaacccggttccgttccctacggtacccgtacccctacccgaacccgtaaccggg

SEQ ID NO: 137012 - DNA, 553 bp, Homo sapiens
  misc_feature: GYAE6OF02F9X86.16.39.D06.1.454.CMB.1.raw
  modified_base (407)..(407): a, c, t, g, unknown or other
  misc_feature (407)..(407): n is a, c, g, or t
  modified_base (539)..(539): a, c, t, g, unknown or other
  misc_feature (539)..(539): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccaggccgggggggtccctgagactctcctgtgcagcctctgggttcagcgtcagtaacaaccacgtgatgtgggtccgccagccctccgaggggaaggggctagggaatggggtctcgagttattagaaaatgatggtgacacaatctacgccgtactccgtgaacgggccgattccaccatcncagacgacaattccaaagaacacggtgaaattctacaaatgaaacagcctagagaaccgaggacacggctatattattgtaatagtatggtgtaatcggcccgtgggccagggaccgtggccacgtctctcncgctccaccgacgg

SEQ ID NO: 137013 - DNA, 698 bp, Homo sapiens
  misc_feature: GYAE6OF02JI7J9.16.39.D06.1.454.CMB.1.raw
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccaggccggggggtccctgagactctcctgtcgcagcctcgtgggttcagcgtcagtaacaaccacgtgatgtgggtccgccgtagccctccgaggggaagggcgtggaagtgggtcctcgagtttattagaaagtgagtgtagacaacaagtctacgccgtacgtccgtaggaacgggccgtacttccaaccgtatcctaccgaagtacgaaactaacttacccgaaaggtaaacccgacggtaacgtaacttaccgttaacgaaagttacgtaaacacgtcccgtaaaagacggaaaccggaaggaaccgaaccgggtacctaagttaattagtttagttaacgtaaggtttaaggttaggttaacggttagttcccggggacccgttcgggggtacctaacgggggtaaccgttacggtaccgtacccggttcgttacccacggaccgtacccctacccgaaacccgg

SEQ ID NO: 137014 - DNA, 609 bp, Homo sapiens
  misc_feature: GYAE6OF02JIN4X.16.39.D06.1.454.CMB.1.raw
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccaggccggggggtccctgagactctcctgtgcagcctctggttcagcgtcagtaacaaccacgtgatgtgggtccgccagcctccgagggaaggggctggaatgggtctcgagttattgaaaatgatggtgacacaatcacgccgactccgtagaacggcgatcacatctcagagacaattccaagaacgacggtagaaactctacaaatcgaacacgacctagacgaaccggagaccgacggaccgttaataacttattagtattaaggttagttagggtaggttaacgttccgggtacccgtgggggtaccgaggggtaacccgttggtaccgtacccggtcgttacccgtcgtaccggtaccctacccgtaacccggg

SEQ ID NO: 137015 - DNA, 643 bp, Homo sapiens
  misc_feature: GYAE6OF02I5XX0.16.39.D06.1.454.CMB.1.raw
  modified_base (286)..(286): a, c, t, g, unknown or other
  misc_feature (286)..(286): n is a, c, g, or t
  modified_base (301)..(301): a, c, t, g, unknown or other
  misc_feature (301)..(301): n is a, c, g, or t
  modified_base (368)..(368): a, c, t, g, unknown or other
  misc_feature (368)..(368): n is a, c, g, or t
  modified_base (470)..(470): a, c, t, g, unknown or other
  misc_feature (470)..(470): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctatttaaaaggtgtccagtgtgaggtgtacttggtggagtctgggaggaggcttgacccaggccggggggtcctgagactctcctgtgcacgcctcgtggttcagcgtcagtaaccaaccncgtgatgtgggtccncacgcctccgaaggggagggctggaagtgggtctacgagttatagaaaatgaactgggtagaaccanaagtcgtaaccgccggtactacccggtagaaacgggtccaacgttcaaccgtactccgtaccgaagacgtaacaaacttccgaaaaggaacctaacgggtanaaataccgttacaaagtacgaactagacctaggaacgaaccggaacggacgacggtaccgtatactttatacgtagtagttacgtaggttcgaattccggggcccgtaggggaccaacggggaccgttcggacgtccgttccgctaccgacggcccttaccgaccgtaaccgg

SEQ ID NO: 137016 - DNA, 541 bp, Homo sapiens
  misc_feature: GYAE6OF02FNTZA.16.39.D06.1.454.CMB.1.raw
  modified_base (376)..(376): a, c, t, g, unknown or other
  misc_feature (376)..(376): n is a, c, g, or t
  modified_base (441)..(441): a, c, t, g, unknown or other
  misc_feature (441)..(441): n is a, c, g, or t
  modified_base (526)..(526): a, c, t, g, unknown or other
  misc_feature (526)..(526): n is a, c, g, or t
tcagtgtactactccacgaccggtgctcgatttagtgacatctcgcagttctttgggggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccagccgggggggtccctgagactctcctgtgcagcctctgggttcagcgtcagtaacaaccacgtgatgtgggtccgccagcctccaggggaaggggctggaatgggtctcagttatgaaaatgatggtgacacaatctacgccgactccgngaagggcattcaccatcctccagagaccaattccaaagaacacggtagaactctacaaatgaacngacctagagaaccgaggacacggctatattatgtatagttatggtgtattcggccgtgggccaggaccgtgtacacgtctcctcncgcctccactaccgg

SEQ ID NO: 137017 - DNA, 641 bp, Homo sapiens
  misc_feature: GYAE6OF02GICCS.16.39.D06.1.454.CMB.1.raw
  modified_base (351)..(351): a, c, t, g, unknown or other
  misc_feature (351)..(351): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccaggccggggggtccctgagactctcctgtgcagcctcgtgggttcagcgtcagtaacaaccacgtgatggtggtccgccagcctccgaggggagggctggaagtgggtctcgaagtatcaanaagcaagtagtacgtaccgcatggtacgcagacctcgtgaacgggtccttcaccatctaccagagacaatccaaagacacgtcttagtatttacgactaaagtcgaaactagtactaggaaggtacggtaccggaaggaaccaaccgggacctaagttaacttaacgtttaaccgtggttacggacggaaacgggtaggggttaaacgtttggggtacggggtccggttaaggtaccgttaggtaccgtttagttacgggtaacccgttacggtcgggggtaaccccggg

SEQ ID NO: 137018 - DNA, 582 bp, Homo sapiens
  misc_feature: GYAE6OF02GS6S2.16.39.D06.1.454.CMB.1.raw
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccaggccgggggggtccctgagactctcctgtgcagcctctgggttcagcgtcagtaacaaccacgtgatggtgggtccgccagcctccgaggggaaggggctggaatgggtctcagttatgaaaatgatggtgacacaatctacgcgactcgtgaaggccattcaccatctaccagagacaattccaaagaacgacggtagaacttccttacaaattgaacagacctgaacgaaccggaggaccgacggccgtaatacttagttagtataggttagtgggtagtagttccgggcccgtggggaccaggggaaccgttggtaccaccgttctccgtcacgtccctccgaacccgg

SEQ ID NO: 137019 - DNA, 581 bp, Homo sapiens
  misc_feature: GYAE6OF02HBZTB.16.39.D06.1.454.CMB.1.raw
  modified_base (219)..(219): a, c, t, g, unknown or other
  misc_feature (219)..(219): n is a, c, g, or t
  modified_base (310)..(310): a, c, t, g, unknown or other
  misc_feature (310)..(310): n is a, c, g, or t
  modified_base (411)..(411): a, c, t, g, unknown or other
  misc_feature (411)..(411): n is a, c, g, or t
  modified_base (415)..(415): a, c, t, g, unknown or other
  misc_feature (415)..(415): n is a, c, g, or t
  modified_base (439)..(439): a, c, t, g, unknown or other
  misc_feature (439)..(439): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggnggcttgacccaggccggggggtccctggagactctcctgtgcagcctcgtgggttcaggcgtcagtaacaaccacgtgatggtgggtcccnccagccctccaggggaaggggcctggaagtggggtctcgtagttatagaaaatggatggtgacacaactctacgccgactccggagaagggccgatccacnctcnccagagacattaccaagacacgtnaatctacaaatgaacagctgacgaacgagacacggacgtatatagttatagtacgttatgggtagtagttccgggacccgtggggaccaggggaaccgtcgggtaccaccggttccgtcccgtcgaccgcctcctaacccgg

SEQ ID NO: 137020 - DNA, 625 bp, Homo sapiens
  misc_feature: GYAE6OF02IE5BT.16.39.D06.1.454.CMB.1.raw
  modified_base (306)..(306): a, c, t, g, unknown or other
  misc_feature (306)..(306): n is a, c, g, or t
  modified_base (373)..(373): a, c, t, g, unknown or other
  misc_feature (373)..(373): n is a, c, g, or t
  modified_base (431)..(431): a, c, t, g, unknown or other
  misc_feature (431)..(431): n is a, c, g, or t
tcagtgtactactccacgaccggtgctcgatttagtgacatctcgcagttctttgggtttttggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccaggccggggggtccctgagactctcctgtgcagcctcgtggttcagcgtcagtaacaaccacgtgatggtggtccnccagcctacgagggaacggggctggaagtgggtctcgtaagttagtagaaaagtgagtggtagacanatctacgcactcgagacggcgatcaccatctacagacacaacttccaaagtacacggnaacttctacaaattgaaacagtacgagacgaaccgagaacgtaccgacgttatactttagtacgttagtaggttaagttggtacgttaagttcccgggacccgttgggggacccgtaagggggaccccgtttgggtacccctaaccggttccgttccccgtaccggtaccggttaccccaccccgtaacccggg

SEQ ID NO: 137021 - DNA, 669 bp, Homo sapiens
  misc_feature: GYAE6OF02FOOHH.16.39.D06.1.454.CMB.1.raw
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccagccgggggggtcctgagactctcctgtgcagcctcgtggttcagcgtcagtaacaccacgtgatgtggtccgcagcctcgagggaagggctggaatgggtctcgagttatgaaatgatggtagacacgaatctacgccgtactccgtagaacgggccgaattcgacctatcctaccgagacgaactaacttacccgaaagtaaccgacggtagaaacttccgttacaaagtacgaaacacggtaccctaggaacgtaacccgaaggaccgaacggtaccgtaattacgttagttaggtacgttaagggtttacttagggttaggttaacgttccggggaccccgttagggggtaccctaagggggtaacccgttacgggtaccgtaccccggttccgttacccgtaccgtaccggtccccgttacccgaacccgtaaccccggg

SEQ ID NO: 137022 - DNA, 701 bp, Homo sapiens
  misc_feature: GYAE6OF02I334R.16.39.D06.1.454.CMB.1.raw
  modified_base (307)..(307): a, c, t, g, unknown or other
  misc_feature (307)..(307): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaggtgtccagtgtgaggtgtacttggtggagtctggaggaggcttgacccaggccgggggggtccctggagactctcctgtgcagcctcgtggttcagcgtcagtaacaaccgacgtgatgtgggtccncagcctcgagggaagggctaggaatgggtctcgagttatagaaatgatggtagacacaatcgtaccgccgtactccgtagaacgggccattccgaccatcctaccagacgtaactaacttaccgaaagtaaccgacgggtagtaaacttccttaacaaagttacgaaacacggtacctaggaacgtaaacccgggaggaaccgaaccgggtaccgttaattaacgtttagttaggttaaacgttagggtttaagttcggggttaaggttaacggtttcccggggtacccccggttggggggtaaccccgtaagggggtaaaccccggttgggttacccgtaacccgggttccttaccccgtacggacccgtaccccgttacccgaaaccccggg

SEQ ID NO: 137023 - DNA, 689 bp, Homo sapiens
  misc_feature: GYAE6OF02GB34K.16.39.D06.1.454.CMB.1.raw
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccagccgggggggtccctgagactctcctgtgcagcctcgtgggttcagcgtcagtaacaaccacgtgatgtgggtccgccagcctccgaggggaaggggcgtggaagtgggtctcgtagttatagaaaatgagtggtgacacaatcgtacgccgactccgtaggaacgggccgtattccgaacccacttccctaccgagaacgaaccaaatttcccgaaaaggtaaaccgacggtaggtaaacttaccgttacaaatcgaaaacacggacctagaacggaaaccgtaggaacccaccggggaccttaagttactttaagttcgttaaagttaggttagttaggggttagttaaacgtttccggggaccccgttagggggtcccgaacgggggtacccgttcgggtaccgtaacccggttccgtacccgtacgtacggtcccccgttaccgaacccggtaacccggg

SEQ ID NO: 137024 - DNA, 667 bp, Homo sapiens
  misc_feature: GYAE6OF02HPT5L.16.39.D06.1.454.CMB.1.raw
  modified_base (446)..(446): a, c, t, g, unknown or other
  misc_feature (446)..(446): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccaggccgggggggtccctggagactctcctgtgcagcctctgggttcagcgtcagtaacaaccacgtgatgtgggtccgccagccctccgaggggaacggggctgggaagtgggtctcagtttattagaaaatgatggtagacacaatctacgccgactccggtggacgggccgattccaccactcctcccgagacgactaattaccaaagaaccgacggtanaaacttcttacaaagtagaaacgagcctaggaacgaaccggaacggacgaaccgggtaccttaagtatttaagttagttaacttaggtttaagtagggttaggttaacgtttcccggggaccccgttaggggggacccgtaacgggggtaacccgttcgggtacccgtacccggttaccgttcccgtccgaccggtcccctacccgaacccggtaaccggg

SEQ ID NO: 137025 - DNA, 594 bp, Homo sapiens
  misc_feature: GYAE6OF02JBE3C.16.39.D06.1.454.CMB.1.raw
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccaggccgggggggtccctgagactctcctgtgcagcctctggttcagcgtcagtaacaaccacgtgatgtgggtccgccagcctcccgagggaaggggctgggaagtcgggtctcgagttattgaaaatggatggtgaacacaatctacgccgactcgtagacgggccgattccgaccatctaccagacacaattccaaagaaccaggtagacttactacaaactgaaacagtcctagagaaccgaaggacacggaccgtatacgttatagtagttagttagtggtagttacttcgggcccgtggggccgacgggtaaccgtggtaccgaccggttccgtccgtcgacgtcccgtccgaccgtaacccggg

SEQ ID NO: 137026 - DNA, 534 bp, Homo sapiens
  misc_feature: GYAE6OF02I3MT6.16.39.D06.1.454.CMB.1.raw
  modified_base (397)..(397): a, c, t, g, unknown or other
  misc_feature (397)..(397): n is a, c, g, or t
  modified_base (416)..(416): a, c, t, g, unknown or other
  misc_feature (416)..(416): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccagccgggggggtcctgagactctcctgtgcagcctctgggttcagcgtcagtaacaaccacgtgatgtgggtccgccagcctccgaggggaaggggctggaagtggggtctcgagttatgaaaatgatggtgacacaatctacgccgactcgtgaggccatcacatctcaganacaatccaaagacacggtnatcttacaaatgaacagcctagaacgaccgaggacacggcctatattatgtattaggtatggtgttatcggccctgggccagggacgtggcaccgtctctcagccctacaccgtacgg

SEQ ID NO: 137027 - DNA, 775 bp, Homo sapiens
  misc_feature: GYAE6OF02GKPIF.16.39.D06.1.454.CMB.1.raw
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggtttccttgctgctatttaaaaggtgtccagtgtgaggtgtacttggtggagtctggaggaggcttgacccaggccggggggtccctggagactctcctgtgcagcctcgtgggtcagcgtacagtaacaaccacgtgagtgtgggtccgcagcctccgaggggaacgggcgtggaagtgggtctcgtagttattagaaaagtgaagtggagtaacacaatccgtaacggccggtaactccggtaggaaacgggccgtaacttccgaaccctagtacccgtacccaaggtaacgaacctaaacgttaccgaaaacggtaaaccgtaaccgggtaacggaaactttaccttaacgaaaaacgttcgaaaacctacggtaccgttaaggaaacggtaaaacccgggagggtaacccgaaccgggtaccgttaaacgtttaacgttttaacgttaaggttaaacgtttaaagggttttaacgttacggggttaacgggtttaacgttccccgggggtaccccgtcggggggtaaccgtaacgggggtaacccggttcgggttaacccgtaccccggttccgtacccgtaccggtacccgttacccgtacccgtaaccccggg

SEQ ID NO: 137028 - DNA, 541 bp, Homo sapiens
  misc_feature: GYAE6OF02GB38A.16.39.D06.1.454.CMB.1.raw
  modified_base (307)..(307): a, c, t, g, unknown or other
  misc_feature (307)..(307): n is a, c, g, or t
  modified_base (364)..(364): a, c, t, g, unknown or other
  misc_feature (364)..(364): n is a, c, g, or t
  modified_base (397)..(397): a, c, t, g, unknown or other
  misc_feature (397)..(397): n is a, c, g, or t
  modified_base (527)..(527): a, c, t, g, unknown or other
  misc_feature (527)..(527): n is a, c, g, or t
  modified_base (535)..(535): a, c, t, g, unknown or other
  misc_feature (535)..(535): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccaggccgggggggtccctgagactctcctgtgcagcctcgtgggttcagcgtcagtaacaaccacgtgatgtgggtccnccagcctccgagggagggctggaatgggtctcagttatagaaaatgagtggtgacanaatctacgccgactcgtgaaggccatcacatcncagagacaattaccaagaacacggtagaactctacaaattcgaacacgcctagacgaaccgaggacgacggcctaatattatgtatggttatgtgtagtcggccgtgggccgaggacgtggcacgtctcncacgtccnccaccg

SEQ ID NO: 137029 - DNA, 580 bp, Homo sapiens
  misc_feature: GYAE6OF02HWCDP.16.39.D06.1.454.CMB.1.raw
tcagtgtactactccacgaccggtgctcgatttagtgacatctcgcagttctttgggggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccaggccgggggggtccctgagactctcctgtgcagcctcgtgggttcagcgtcagtaacaaccacgtgatggtgggtccgccagcctcccgaggggaaggggctgggaagtgggtctcagttattagaaaatgatggtgacacaatctacgccgactccgtgaacgggcattccacatctccagagactaattccaaagaacacggtataaactcttaacaaatgaaacagacctagaacgaaccgagacgacggactatattattgtaataggttatggtagtacgttcgggcccgtgggccgacgggaccgtcggtaccgaccgtctccgtccgacgccctccgaccgaaccgg

SEQ ID NO: 137030 - DNA, 555 bp, Homo sapiens
  misc_feature: GYAE6OF02FGYIR.16.39.D06.1.454.CMB.1.raw
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccagccgggggggtccctgagactctcctgtgcagcctctgggttcagcgtcagtaacaacacgtgatgtgggtccgccagccctccaggggaaggggctggaatgggtctcagttattgaaaatgatggtgacacaatctacgccgactccgtgaagggccgattcaccatctccagagacaattccaagaacacggtgaatcttacaaatgaacagcctagacgaaccgaggacacggccgtatattattgtataggttatggtagtattcgggcccgtggggccagggaaccgtggtaccaccgtctcctcacgccctccaccgaacggg

SEQ ID NO: 137031 - DNA, 565 bp, Homo sapiens
  misc_feature: GYAE6OF02HP995.16.39.D06.1.454.CMB.1.raw
  modified_base (370)..(370): a, c, t, g, unknown or other
  misc_feature (370)..(370): n is a, c, g, or t
  modified_base (374)..(374): a, c, t, g, unknown or other
  misc_feature (374)..(374): n is a, c, g, or t
  modified_base (437)..(437): a, c, t, g, unknown or other
  misc_feature (437)..(437): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaggtgtccagtgtgaggtgtacttggtggagtctggaggaggcttgacccaggccgggggggtccctgagactctcctgtgcagcctctgggttcagcgtcagtaacaaccacgtgatggtgggtccgccagccctccgaggggaaggggcgtgggaagtgggtctcgtagttattagaaaatgagtggtanacanaatctacgccactcgagacgggccattcaccatctccagacgacaattccaagaacacggtanaactcttacaaatgaacagacctagacgaaccgaggacacggcgtatattattgtatagtatggtagtattccgggcccgtgggccagggtaaccgtggtcgtaccgtctcctacacgcctccaaccg

SEQ ID NO: 137032 - DNA, 585 bp, Homo sapiens
  misc_feature: GYAE6OF02HXDKY.16.39.D06.1.454.CMB.1.raw
  modified_base (368)..(368): a, c, t, g, unknown or other
  misc_feature (368)..(368): n is a, c, g, or t
  modified_base (372)..(372): a, c, t, g, unknown or other
  misc_feature (372)..(372): n is a, c, g, or t
  modified_base (386)..(386): a, c, t, g, unknown or other
  misc_feature (386)..(386): n is a, c, g, or t
  modified_base (403)..(403): a, c, t, g, unknown or other
  misc_feature (403)..(403): n is a, c, g, or t
  modified_base (408)..(408): a, c, t, g, unknown or other
  misc_feature (408)..(408): n is a, c, g, or t
  modified_base (424)..(424): a, c, t, g, unknown or other
  misc_feature (424)..(424): n is a, c, g, or t
  modified_base (428)..(428): a, c, t, g, unknown or other
  misc_feature (428)..(428): n is a, c, g, or t
tcagtgtactactccacgaccggtgctcgatttagtgacatctcgcagttctttggggggagaggagcccagcactgggattccgaagtgtttccattcggtgatcagcactgaacacagaggactcaccatggagttttggctgagttgggttttccttgctgctattttaaaaggtgtccagtgtgaggtgtacttggtggagtctggaggaggcttgacccgaggccgggggggtcctgagactctcctgtgcacgcctcgtgggttcaggcgtcaagtaaccaaccacgtgatggtgggtccgccagcccgtaccgaaggggaggggctagggagtgggtctcgagttatagaaatgagtggtnacanatcacgcgactcgngaacggctatcacatcncaganacaatccaagacagtnaatntacaaatgaacagctagaacgaccgaggacacggactatattatgtattaggtatggtagttaacgtccgggcccgtacggggaccgtaacggggtaccgtcgggtacccaccgttccgttacccgtagaccggtcccctaccgacccgtaaccggg

SEQ ID NO: 137033 - DNA, 657 bp, Homo sapiens
  misc_feature: GYAE6OF02F0WF1.16.39.D06.1.454.CMB.1.raw
  modified_base (306)..(306): a, c, t, g, unknown or other
  misc_feature (306)..(306): n is a, c, g, or t
  modified_base (365)..(365): a, c, t, g, unknown or other
  misc_feature (365)..(365): n is a, c, g, or t
  modified_base (369)..(369): a, c, t, g, unknown or other
  misc_feature (369)..(369): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctattttaaaaggtgtccagtgtgaggttgtacttggtggagtctgggaggaggcttgacccaggcccgggggggtccctgagactctcctgtgcagccctcgtgggtcagcgtcagtaacaaccacgtgatggtgggtccnccagccctccgaggggaacggggctaggaagtgggtctcagttatagaaatgagtggtnacanaatcctacgccactccggtggaacgggtccattccaaccctatcctacgagacgaactaacgttccaaaggaccacggtagtaacttccgttaacaaattcggaaacagtccctaggaacgaaaccggaggaaccgaccggtaccgttattaacgtttagttacgttaagttaggttaggtagggttaacggttagttcccggggccccgttggggaacccgttaacggggacccgttggacccgtccgtcgtccctacgaccggtcccttaccgacccggtaacggg

SEQ ID NO: 137034 - DNA, 610 bp, Homo sapiens
  misc_feature: GYAE6OF02HI4NC.16.39.D06.1.454.CMB.1.raw
  modified_base (433)..(433): a, c, t, g, unknown or other
  misc_feature (433)..(433): n is a, c, g, or t
  modified_base (448)..(448): a, c, t, g, unknown or other
  misc_feature (448)..(448): n is a, c, g, or t
  modified_base (453)..(453): a, c, t, g, unknown or other
  misc_feature (453)..(453): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgaccaggccggggggtccctgagactctcctgtgcagcctcgtgggtcagcgtcagtaacaaccacgtgatgtcggtccgccagccctcgagggagggctggaagtgggtctcgagttattagaaaatgagtggtgaacacgtaatctacgccgtaccgtcgtagaacgggccagttccaccatctccagacgacaattaccaagaacacgtanaacttctacaagtanaacgngactagaagaaaccggacggaacgacggacctatattattagtagtaggttatgggttagtaacgttccgggaccgtcggggaaccgacggggtaaccggtcgggtacctacccggtccttcccgacgtaccgtaccctacccgaaccggaaccggg

SEQ ID NO: 137035 - DNA, 649 bp, Homo sapiens
  misc_feature: GYAE6OF02GJFWJ.16.39.D06.1.454.CMB.1.raw
  modified_base (364)..(364): a, c, t, g, unknown or other
  misc_feature (364)..(364): n is a, c, g, or t
  modified_base (408)..(408): a, c, t, g, unknown or other
  misc_feature (408)..(408): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccaggccgggggggtccctgagactctcctgtgcagcctctgggttcagcgtcagtaacaaccacgtgatgtgggtccgccagcctccgaggggaagggcgtggaagtgggtctcgagttattagaaaatgagtggngacacatctacgccgtactcgtagaagggccattccactactcncagacgacaattccaagaacgacggtagaacttctacaaagtcgaacaggaccctagaacgaacccggaagggaccaaccgggtaccgttaattaacgttagtttaacgttaagttaacgggtttaagttaggggttaggttacgtttcccggggcccgttagggggacccgtaacgggggaacccgttcgggtaccaacccggttccgttacccgtccgacgtccccgtaccgaacccgg

SEQ ID NO: 137036 - DNA, 597 bp, Homo sapiens
  misc_feature: GYAE6OF02I4Q0W.16.39.D06.1.454.CMB.1.raw
  modified_base (433)..(433): a, c, t, g, unknown or other
  misc_feature (433)..(433): n is a, c, g, or t
  modified_base (458)..(458): a, c, t, g, unknown or other
  misc_feature (458)..(458): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgaccaggccggggggtccctgagactctcctgtgcagcctcgtgggttcagcgtcagtaacaaccacgtgatggtgggtccgccagcctccgaggggagggctaggaagtgggtctgtagttattagaaaatgagtggtgacacaatctacgccgactcgtagaacggcgattcacctatctaccagagaacaattaccgaaagaacacggtanaactcttacaaagtcgaacagaccngaacgaaccgaggaccgacggtcgtaatattagttagtagttaggttattaggttacgtaagttccggtccgtacggggtccaagggtaccggtcgtaccgaccgttcgtacctcgaccgtccgtcccgacgtaaccgg

SEQ ID NO: 137037 - DNA, 638 bp, Homo sapiens
  misc_feature: GYAE6OF02G058U.16.39.D06.1.454.CMB.1.raw
  modified_base (282)..(282): a, c, t, g, unknown or other
  misc_feature (282)..(282): n is a, c, g, or t
  modified_base (368)..(368): a, c, t, g, unknown or other
  misc_feature (368)..(368): n is a, c, g, or t
  modified_base (372)..(372): a, c, t, g, unknown or other
  misc_feature (372)..(372): n is a, c, g, or t
  modified_base (390)..(390): a, c, t, g, unknown or other
  misc_feature (390)..(390): n is a, c, g, or t
  modified_base (488)..(488): a, c, t, g, unknown or other
  misc_feature (488)..(488): n is a, c, g, or t
tcagtgtactactccacgaccggtgctcgatttagtgacatctcgctaggttcgtttggggggagaggagcccgagcactgggattccgaggtgtttccattcggtgatcagcactgaacacagaggactcaccatggagttttggctgagttgggttttccttgctgctattttaaaaggtgtccagtgtgaggtgtacttggtggagtctgggaggaggcttgacccaggcccgggggggtccctggagactctcctgtgcagcctctgggttcagcgtnagtaacaaccacgtgatgtgggtccgccagcctccgaggggaaggggctggaagtgggtctcgagttattagaaaatgaatcggtnacanaatctacgccgactccgngaacgggccgaattcaccatctccgagagaacattaccaaagacaacggtgaacttctaacaaatgaaacgagtccctagaacgtaaccgaggtaacnccgggtaactagtaatttattagtacgttaggttatacggggtaggttaacgtttccggggccccgtttagggggcccctaagggggtaaccgttcgggacgtaccccggttactcccgttacacggtccccttacgacccggtaacggg

SEQ ID NO: 137038 - DNA, 687 bp, Homo sapiens
  misc_feature: GYAE6OF02ILR0E.16.39.D06.1.454.CMB.1.raw
  modified_base (309)..(309): a, c, t, g, unknown or other
  misc_feature (309)..(309): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccgaggccgggggggtccctggagactctcctgtgcagcctcgtgggttcagcgtcaagtaaccaaccacgtgatggtcgggtcccnccagccctccgagggggagggtcgtggaagtgggtctcgagtttagtagaaaatgagttggtagacaacaactcgtaccggcccgtaccgtccggtaggaaacgggtcccgtaacgtttaccaaccctactccgtacccgaaggacgtaactaaacttacccgaaaacgaaaccgtacgtacttagttaacttttacgaactaaagtacgtaaactaggtaccgtagaacggtaggtacggacgaacgaccggacctaatattacgttacgtggtacgacgggtaacgggcgggttaagttggggacgggtacggtcgtaacgttgtacgttagttacggaccgttacgggcggggtacccggtaaccgggtacccgg

SEQ ID NO: 137039 - DNA, 592 bp, Homo sapiens
  misc_feature: GYAE6OF02HX2Y3.16.39.D06.1.454.CMB.1.raw
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccgaggcccgggggggtccctggagactctcctgtgcagcctcgtgggttcagcgtcagtaacaccacgtgatggtggtccgccagcctccgagggaggggcgtaggaagtgggtctctagttattagaaatgatggtgacacatctacgccgactcgtagaacggcctattcaccatcctaccgagacgaactaacttaccgaaagaacgacggtagaacttcttacaaatcgaaacacgacctagaacgaaccgaggacaccggactatattatgtaagttagttagtggtagtagtccgggccgtggggcctagggaccggtgtaccgaccgttcgtccgtacgacgtccctaccgaaccgaaccgg

SEQ ID NO: 137040 - DNA, 578 bp, Homo sapiens
  misc_feature: GYAE6OF02GX4MH.16.39.D06.1.454.CMB.1.raw
  modified_base (311)..(311): a, c, t, g, unknown or other
  misc_feature (311)..(311): n is a, c, g, or t
  modified_base (370)..(370): a, c, t, g, unknown or other
  misc_feature (370)..(370): n is a, c, g, or t
  modified_base (375)..(375): a, c, t, g, unknown or other
  misc_feature (375)..(375): n is a, c, g, or t
  modified_base (467)..(467): a, c, t, g, unknown or other
  misc_feature (467)..(467): n is a, c, g, or t
tcagtgtactactccacgaccggtgctcgatttagtgacatctcgcagttctttgggttttgggggagaggagcccagcactgggattccgaggtgtttccattcggtgatcagcactgaacacagaggactcaccatggagttttggctgagttgggttttccttgctgctattttaaaaggtgtccagtgtgaggtgtacttgggtggagtctggaggaggcttgacccagggccgggggggtccctgagactctcctgtgcagcctcgtgggttcagcgtcaagtaacaaccagtgatggtgggtccnccagccctccgaggggagggctgggaagtggggtctacgagtttattagaaatgatggngacanatctacgccgactcggtagaacggggcctattccacctatccaccagacgactaataccgaagtaacgacggtagaattctacaaatgaacngcctagacgaacgagacacggctatattatgtataggttatgggtgttatccgggcccgtggggaccagggtacgtggtccgacgtctactcgactccctacccgaaccgg

SEQ ID NO: 137041 - DNA, 708 bp, Homo sapiens
  misc_feature: GYAE6OF02GX99D.16.39.D06.1.454.CMB.1.raw
tcagtgtactactccacgaccggtgctcgatttagtgacatctcgcagttctttgggttttggggagaggagcccagcactgggattccgaggtgtttccattcggtgatcagcactgaacacagaggactcaccatggagtttggctgagttgggttttccttgctgctattttaaaaggtgtcagtgtgaggtgtacttggtggagtcgtgggaggaggcttgacccgagggcccgggggggtccctgacgactcctcctgtgcagcctcgtggtcagccgtcaagtaacaaccacgtgatggtcgggtcccgccacgccctccggaggggaacggggcgtaggaagtcgggtctacgtagttagttagaaatgagtggtagaacactaatcgtaccgccgacgtccggtaggaacgggaccgtacttaccgacctacttccgtaccgaacgaacaacctaaacttacccgaaaacgtaaccgacgggtagtaaacttaccttaacaaaagttcgaaacacgtacccgtagaaccggaaacccggaaggaccgaaccgggttacctaattaagtttaacgttagttaaagttaggtttaagtgggttacggttacggttcccggggtaccccggtgggggacccgtaacggggtaacccgttcggtaccgtacccgttctaccgtcgacgtcccctacgaacccgg

SEQ ID NO: 137042 - DNA, 553 bp, Homo sapiens
  misc_feature: GYAE6OF02I962A.16.39.D06.1.454.CMB.1.raw
  modified_base (535)..(535): a, c, t, g, unknown or other
  misc_feature (535)..(535): n is a, c, g, or t
  modified_base (543)..(544): a, c, t, g, unknown or other
  misc_feature (543)..(544): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccagccaggggggtccctgagactctcctgtgcagcctctgggttcagcgtcagtaaccaaccacgtgatgtgggtccgccagccctccgaggggaaggggctgggaagtgggtctcgagttattagaaaatggatggtgacacgaatcgtacgccgactccgtagaacgggccattcaccatcctccagacgacaacttaccaaagaacacggtagaactcttacaaatgaaacagcctagacgaacgaggacacggctatattatgtatagtatggtagtagtcggcccgtgggccaggacgtgcncgtctccnncgcctaccg

SEQ ID NO: 137043 - DNA, 613 bp, Homo sapiens
  misc_feature: GYAE6OF02FGGDD.16.39.D06.1.454.CMB.1.raw
  modified_base (439)..(439): a, c, t, g, unknown or other
  misc_feature (439)..(439): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttcctgctgctattttaaaaggtgtccagtgtgaggtgtacttggtggagtctggaggaggcttgacccaggccgggggggtccctgagactctcctgtgcagcctctgggttcagcgtcagtaacaaccacgtgatggtgggtccgccagccctccgagggaaggggctggaagtgggtctcagtttattagaaaatgatggtgacacaatctacgccgactccgtgaacgggcctattccaccatcctccaagacgactaacttccaaagaccaggtnaaactctacaatcgaacagcctagacgaaccgaggaccacggccgtatagttattgaattaggttatgggttaggttacgtccgggtaccccgtgggggaccctaacgggggtaacccgttggtacccgtaacccggttcctccccgtacaccggtccccttaccaaccccggg

SEQ ID NO: 137044 - DNA, 939 bp, Homo sapiens
  misc_feature: GYAE6OF02GETPG.16.39.D06.1.454.CMB.1.raw
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctatttaaaggtgtccagtgtgaggtgtacttggtggagtctggaggaggcttgacccaggccggggggtccctgacgactctccgtgtgcacgcctcgtgggttcagcgtacacgtaaacaaccgtacgtgtagtcggtacgggtcccgtaccgacggcccttacccggaagggggaaacgggggtccttagggaaacgttcgggggttcctacggttaaacggtttaagttaacgggtaaaaaagttcggaaacggtttcgggtacggaacctaaacgtaaaccgtttaccgtaaccggtaccccggtaaccgttacccgggtaggtaaaaccggggtcccggtaactttacccgaacccgtacttacccgtacccgtaacggaacgtaacccgtaaactttaccccgaaaaggtaaacccggtaacggggttaaacgtaaaccgttacccgttaaccgtaaaaacgttacgtaaacccgtaacgggttaccccgttaaacgggaaaaccggtaaaccccgggtaaacgggtaacccgtaaacccggggttacccgtttaaactttaaacgttttaacgtttaacggtttaacgttaaacgggttttaacgttaggggtttaaccgggtttaacgtttcccgggggtacccccggtttacgggggtaacccggtaaaccgggggtaacccggttacgggttaacccgtacccggtttaccggttacccgtacccggacccggttacccgtacccccggtaaacccggg

SEQ ID NO: 137045 - DNA, 541 bp, Homo sapiens
  misc_feature: GYAE6OF02IPTOU.16.39.D06.1.454.CMB.1.raw
  modified_base (424)..(424): a, c, t, g, unknown or other
  misc_feature (424)..(424): n is a, c, g, or t
  modified_base (435)..(435): a, c, t, g, unknown or other
  misc_feature (435)..(435): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccaggcccgggggggtccctgagactctcctgtgcagcctcgtggttcagcgtcagtaacaaccacgtgatgtgggtccgccagcctccgaggggagggctggatgggtctctagttattagaaaatgatggtgacacatctacgccgactccgtagagggccgattcacatctcagagacataccaagacaggtanatctacaaatnaacagctagacgaacgagacacgctatatatgtatagtatggtagtagttcggcccgtgggaccagggaccgtggtacgacgtcctccgcgtacgcctaccgaccg

SEQ ID NO: 137046 - DNA, 564 bp, Homo sapiens
  misc_feature: GYAE6OF02FMX1F.16.39.D06.1.454.CMB.1.raw
  modified_base (364)..(364): a, c, t, g, unknown or other
  misc_feature (364)..(364): n is a, c, g, or t
  modified_base (405)..(405): a, c, t, g, unknown or other
  misc_feature (405)..(405): n is a, c, g, or t
  modified_base (497)..(497): a, c, t, g, unknown or other
  misc_feature (497)..(497): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccaggccgggggggtccctggagactctcctgtgcagcctctgggttcagcgtcagtaacaaccacgtgatgtgggtccgccagccctccgaggggaaggggcgtggaatgggtctcagttattagaaatgatggtnacacatctacgccgactcgtagagggccattccaccatccncagagactaatccaaagacacggtgaactctacaaatgaacagtactgagaaccggaggacacgggaccgtatattagttgtaataggttangggtagttacgtcgggcccgtggggccaggggtacctggtacaccgtctcctcacgtccctacaccg

SEQ ID NO: 137047 - DNA, 940 bp, Homo sapiens
  misc_feature: GYAE6OF02JGLZC.16.39.D06.1.454.CMB.1.raw
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccaggccgggggggtccctgagactctcctgtgcagcctctgggttcagcgtcagtaaccaaccacgtgatgtgggtccgccagccctccgaggggaacggggcgtggaagtgggtctcgagtttagttagaaaaatggtaatgggtacgactaacaattccgttaaccgcccggtaaccgtcccggtacggaaacgggggcccgtaacgtttacccgaaaccacttccctacccgaacgggtaacggaaaccctaaaacgtttaccccaaaaacgggtaaaacccgtaacccgggggttaagtaaaaccgttaccgtttaaaccgtaaaaaacgttacgggtaaaaccctacggttaaccccgtaagggtaaacccggaaaaccccggggtaacggggaaacccccgtaaacccggggttaaccccggtttaaacgttttaaacgtttttaacgtttttaaggggtttaaaccgtttttaaacgggggttttttaagtaaaccgggggtttacggggttttaaaacccgggttttcccgggggggttacccccccggttaagggggggggtaccccccggggttaaaaccgggggggttaaaccccggggttttaccggggttacccgttaaacccccgggttcccggtttacccccggttacccgtaaccccggtacccccgtttacccccggaaaccccggtaaaccccgggggg

SEQ ID NO: 137048 - DNA, 679 bp, Homo sapiens
  misc_feature: GYAE6OF02HA3HY.16.39.D06.1.454.CMB.1.raw
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccgaggccggggggtccctggagactctcctgtgcagcctcgtgggttcagcgtcagtaacaaccacgtgatggtgggtccgccagccctccgaggggaaggggcgtggaagtgggtctcgtagttagttagaaaagtgagtggtagaacactaatcgtaccgccgtacgtccggtaggaacgggccgtattaccacctactctaccagaacgactaacttaccgaaagtaacgacggtagaaattccttaacaaagttacgaaacgcgtacctaaggaacgaaccggaacggaaccgtaccgggtaccgttaattaacgttttagttagttaagtttaggttagttagggttaggttaacggttccgggtaccccggtggggaccggtaacggggtaccgttcgggtaccgtacccggtctacccgtacgaccgtcccgtaccaacccggg

SEQ ID NO: 137049 - DNA, 604 bp, Homo sapiens
  misc_feature: GYAE6OF02F61ZD.16.39.D06.1.454.CMB.1.raw
  modified_base (360)..(360): a, c, t, g, unknown or other
  misc_feature (360)..(360): n is a, c, g, or t
  modified_base (365)..(365): a, c, t, g, unknown or other
  misc_feature (365)..(365): n is a, c, g, or t
  modified_base (406)..(406): a, c, t, g, unknown or other
  misc_feature (406)..(406): n is a, c, g, or t
  modified_base (425)..(425): a, c, t, g, unknown or other
  misc_feature (425)..(425): n is a, c, g, or t
  modified_base (431)..(431): a, c, t, g, unknown or other
  misc_feature (431)..(431): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccaggccgggggggtccctggagactctcctgtgcagcctctgggttcagcgtcagtaacaaccacgtgatgtgggtccgccagcctccgagggaaggggctggaatgggtctcagttattagaaatgatggngacanatctacgccgactccgtgagggcattcaccgatctcgaganacaatccaagacacggtanatctanaatgaacacgtcctagacgaaccgagacgaccggccgtatacttattgttaagtaggtttagtggttaggttacgttacccggggtccctacgggggaccctaacgggggtaaccgtcgggttcccgacccgttaccgttcccaccggtaccgtacccctaccgtaaccccgg

SEQ ID NO: 137050 - DNA, 989 bp, Homo sapiens
  misc_feature: GYAE6OF02I3C52.16.39.D06.1.454.CMB.1.raw
tcagtgtactactccacgaccggtgctcgatttagtgacatctcgcagttctttgggttttggggagaggagccccagcactgggattccgaggtgtttccattcggtgatcagcactgaacacagaggactcaccatggagtttggctgtagtttgggttttccttgctgcttaattttaaaaggtgtccagtgtgagtgttacttggtggagtcgtggaggaggcttggacccgacgggccgggggggtccctggacgtacttccgtccctgtcgcgacgcccttcgttcggggttcaggtccgttacaacgttaaaacccaaaccccgtacggttcggaagttcgggttcgggtaccccgacccgtaaccggtccccgttacccgggaaggggggtaaacgggggtcgttaacggggtaaacggttggggtaccttacgttaaaggttttaatttaaagggtaaaaagttggtaagttacggggtactaaaccgtaactaaacgttacctaacccggacccgtaaccgttacccgtaaaggttaaccgggaaaacgggggtcccttaaacgtttacccaaacccgttacctttcccgtaacccgaaaggtaacccgtaaacctaaacccgtttaacccgaaaacgttaaaaccggtaacccgggttaagtaaaccgttccgtttaaacaaaacgttacggaaaaccgtaccggtacccgttaacgggaaacccggtaaacccggtaaccgggaaccgtaaaccccgggttacccggtttaaagtttaaccgttttaagttaacgggtttaaacggttaaaggtttacgggtttaagggttacggttttaaccgggttaccccggggtaccccggggttaccgggaaacccggggttaaccgggggtaaaccggtttcccgggttaacccgttacccggttacccgtttaacccccgtaccgtacccgggtacccccgtaaccccgg

SEQ ID NO: 137051 - DNA, 652 bp, Homo sapiens
  misc_feature: GYAE6OF02G3VY0.16.39.D06.1.454.CMB.1.raw
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctgggaggaggcttgacccaggcccgggggggtccctggagactctcctgtgcagcctctgggttcagcgtcagtaacaaccacgtgatgtgggtccgccagccctccgaggggaaggggctggaagtgggtctcgtagttatagaaatgatggtgaacacaatcacgccgactccgtagaacgggctatcaccatctaccagacaactaacttaccgaagaacgacggtagaacttctaacaaattgaacacgccgtagaacgaaccgaaggaccgaccggacgttaattacgttagttagttaacgttagggttaagttggttacgggttacgtttcccggggtaccccggtgggggacccgtaacgggggtaacccggttggtacccgtaacccggtttcctacccgtccgtaaccggtccctaccccgtaacccggg

SEQ ID NO: 137052 - DNA, 681 bp, Homo sapiens
  misc_feature: GYAE6OF02IVLAL.16.39.D06.1.454.CMB.1.raw
  modified_base (382)..(382): a, c, t, g, unknown or other
  misc_feature (382)..(382): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaggtgtccagtgtgaggtgtacttggtggagtcgtggagggaggcttgacccgagggccgggggggtccctggagactctcctgtgcagcctcgtgggtcagcgtcaagtaaccaacctagtgatggtcgggtccgaccagccctcggaggggaagggctaggaagtcgggtctcgtagttatagtaaatgagtggtgaactanaatccgtacgcccgtactcggtagaacgggccattaccacacttccaccgaagacaactaacttaccgaaagtaccgaggtacgaacttcgtaacaaagtcgaaaccgtacgtaccgtagtaaacggaaacccggaggaacccggaacggtacccgtaagtttattaacgttagttaagttaacggtttaagtccgggttaggtaccgtttcccgggacccggtacggggaccgtacgggtaaccggtcggtaccctaccggttcctacccgtcaccggtacccctaccgtaacccggg

SEQ ID NO: 137053 - DNA, 588 bp, Homo sapiens
  misc_feature: GYAE6OF02F9MFF.16.39.D06.1.454.CMB.1.raw
  modified_base (418)..(418): a, c, t, g, unknown or other
  misc_feature (418)..(418): n is a, c, g, or t
  modified_base (445)..(445): a, c, t, g, unknown or other
  misc_feature (445)..(445): n is a, c, g, or t
  modified_base (452)..(452): a, c, t, g, unknown or other
  misc_feature (452)..(452): n is a, c, g, or t
  modified_base (460)..(460): a, c, t, g, unknown or other
  misc_feature (460)..(460): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctaattttaaaaggtgtccagtgtgaggtgtacttggtggagtctggaggagccttgacccgagggcccggggggggttccctggacgacctctcctgtgcagcctcgtgggttcagcgtcaagtaacaaccacgtgtatggtcgggtccgccagccctccggaggggaagggggctagggaagtggggtactcgagtttaattagaaaatgatggtagacacaatcacgccgactcgtagacggctatcaccntctcagacacatacaagaacacggtanaatctanaatgaacngcctgaagaccgaggacaccggctatattattagtattagtagttgtacggttagtccgggtcccgtcgggcgacgggtaccggtggaccgtaccgtcctacgtccacgccctccgacccggtaccgg

SEQ ID NO: 137054 - DNA, 706 bp, Homo sapiens
  misc_feature: GYAE6OF02GTYOM.16.39.D06.1.454.CMB.1.raw
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccaggccggggggtccctgagactctcctgtgcagcctcgtcgggttcagcgtcagtaaccaaccacgtgatgtcgggtccgccacgccctacgaggggaagggctggaagtgggtctcgagttatagaaatgagtggtgacacaatctacgacccgacgtccggtaggaacgggcctagttccacctactccgtaccagaacgaacctaaattacccaaagtaaccgacggttagaaacttccttaacaaattcggaaaccacggtacctaggaaccgtaaccggaacggaccgaaccgggtaccttaagttaaacgttttacgttaggttaacgtttaagggtttacgtttaggggtagtttaacgggttcccggggtacccccggttaggggggacccgtaacggggggtaacccgttgggttaccccgtaccggttccctacccgttaccgaccgtccccgtacccgaacccggg

SEQ ID NO: 137055 - DNA, 709 bp, Homo sapiens
  misc_feature: GYAE6OF02IUP5D.16.39.D06.1.454.CMB.1.raw
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccaggccgggggggtccctggacgactctcctgtcgcagcctcgtggttcagcgtacagtaaccaaccacgtgatggtgggtcccgccgacgcccgtacccggagggggaacgggggcgtagggaagttggggtctacgtaaggttagttaagaaagtgagtggtacgaacaactaatccgtaaccgccgtacctccggtaggaacgggtccgtattacccacactcctaccgaagacgaacaacttaccgaaagaactacggtataacgtactacaaagtacgaacacgaccgtagaacgtaaccgaggaaccgaccggtacgtattacgttagttacgtaagttaaggttacgttaggggttaacggttacgtacccggggttccccggtagggggtaccccaaagggggtaacccgttcgggtacccgtacccggttccgtacccgtacggtacccggcccttaccccgtaaccccggg

SEQ ID NO: 137056 - DNA, 680 bp, Homo sapiens
  misc_feature: GYAE6OF02HMCKB.16.39.D06.1.454.CMB.1.raw
  modified_base (296)..(296): a, c, t, g, unknown or other
  misc_feature (296)..(296): n is a, c, g, or t
  modified_base (384)..(384): a, c, t, g, unknown or other
  misc_feature (384)..(384): n is a, c, g, or t
tcagtgtactactccacgaccggtgctcgatttagtgacatctcgcagttctttgggttttggggagaggagcccagcactgggattccgaggtgtttcccattcggtgatcagcactgaacacagaggactcaccatggagttttggctgagttgggttttccttgctgctattttaaaaggtgtccagtgtgaggtgtacttggtggagtctggaggaggcttgacccaggccgggggggtccctgagactctcctgtgcagcctctgggttcagcgtcagtaacaaccacgtnagtgtcgggtccgccagcccgtaccagggggaacggggctagggaagtggggtcctacgtaggtttaattaggaaaatggtatgggtnaacaactaataccgtacggcccgtaactccggtaggaacgggccgtaattccacctattccctacagtacgaactaaacttaccaaaggtaaaccagggtacgtaacgtctttaaccaaagtagactacgccgtagacgaaaccggacggacacgggtactataattacgttagtagttaggttagttagggtagttacggttccgggtcccgtagggggaccgtaacggggtaaccggttacgggacccgttacggtccgttacccgtacgtacgtccccgtaccctaacccggg

SEQ ID NO: 137057 - DNA, 750 bp, Homo sapiens
  misc_feature: GYAE6OF02JSLI1.16.39.D06.1.454.CMB.1.raw
tcagtgtactactccacgaccggtgctcgatttagtgacatctcgcagttctttgggttttggggagaggagcccagcactgggattccgaggtgtttccattcggtgatcagcactgaacacagaggactcaccatggagtttggctgagttgggttttccttgctgctattttaaaggtgtccagtgtgaggtgtacttggtggagtcgtggaggaggcttgacccaggccggggggtccctggagactcgtcctgtcgcagcctctgggttcagtcgtcagtaactaaccgacgtgactggtcgggtaccgtccgacgccgtccgaggggaacggggcgtacgggaagtcgggtctacgtagttattagtaaaacgtggaagtggtacgaactactaaagtccgtaccgaccggtacgttaccggtaggtaacgggccgtaacttaccgacccgtaattcctacccgaagtaacgtaaccaaacgttaccgaaacgaacgtacggtacgaaacttccgttaaccaaagttacgaactacgtaccgtagaaacgaaccgtaacgggaacccgaaccggtaccgttaatacgtttaacgttacggttaattaacgggttaatcgggttaggtaacgttccgggaccccggtcgggggtaacccaacgggggtaaacccgttccgggtaaccgttacccgggtttacctccccggttaacgtcccggtaccccttcccgtaaaccccggg

SEQ ID NO: 137058 - DNA, 741 bp, Homo sapiens
  misc_feature: GYAE6OF02JOTEQ.16.39.D06.1.454.CMB.1.raw
  modified_base (257)..(257): a, c, t, g, unknown or other
  misc_feature (257)..(257): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagttttggctgagtgggtttcttgctgctatttaaaggtgtccagtgtgaggtgtacttggtggagtctggaggaggcttgacccgagccgggggggtccctgagactctcctgtgcagcctntgggtcagcgtcagtaacaaccacgtgactggtggtccgccagtcctaccgagggaaggggcctaggaatggggtactcgtaacgttattagaaaagtgtagtcggtagacgactaagtcctacggcctacgtacccgtaggaacggtccgtaacgttcgaacctagtacctaccgaagacggtaacacgtttaccgaaacgtaacgaccgtaaggtaacttcctaacctaaagtacgaaaccgtacgaccttaaggacgaaaaccggcggtaaaccgccggtaacccgtagttaacgttaagtttacgttaacgttaaaccggttaggtagggtttaacggttaacgtttacccgggggtacccgttaccggggggtacccgtaaacggggtaacccggggtttaacgtcccggttaaccccgggtaccttcccggttaccgaaccggtacccccgtttacccgaacccggttaacccggggg

SEQ ID NO: 137059 - DNA, 784 bp, Homo sapiens
  misc_feature: GYAE6OF02H0U7B.16.39.D06.1.454.CMB.1.raw
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctgggaggaggcttgacccaggccgggggggtccctggagactctcctgtgcagcctcgtggttcagcgtcagtacaaccacgtgatgtcgggtccgccagccctcgaggggaacggggctaggaatcggtctacgtagtttaagttagaaaatggacgtggtacgaacactaatcgtaccgccgtaaccgtccggtaggaacggggtacctacttaccgacctactaccctaccgaaggtaacgtaacctaacgtttaccgaaacgtaaacctacgggttaacgtaaacttcctttaaacgaaaacgttaacggaaacctaacggtaccccgttaagaaaccggtaaaccccgggaagggaacccgtaccgggtaacccgttaattaaacgtttacgtttaacgttaagtttaaacgggttagtttaacgggttaccgggttaacggtttccccggggtaccccgggtaacggggtacccgggtaaacggggtaacccggttacggtacccggttaacccggttacccgttaccgtacccggtacgttacccccgtaccggaaacccccggg

SEQ ID NO: 137060 - DNA, 583 bp, Homo sapiens
  misc_feature: GYAE6OF02HL5F8.16.39.D06.1.454.CMB.1.raw
  modified_base (361)..(361): a, c, t, g, unknown or other
  misc_feature (361)..(361): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccagccgggggggtccctgagactctcctgtgcagcctctgggttcagcgtcagtaacaaccacgtgatgtgggtccgccagcctccagggggaaggggctgggaagtgggtctcgagttattagaaaatgaagtggtnacacaatctacgccgactccgtgaacgggccattcaccatcctccagacgacaattccaaagaacacggtgaatcttacaaatgaaacagacctgaacgaaccgaggaccacggccgtatattattgtaataggttatgggtagatacgttcgggcccgtggggaccaggggtaaccgtgggtccacccggttctcccgtcgacgtccctacccgaacccgg

SEQ ID NO: 137061 - DNA, 651 bp, Homo sapiens
  misc_feature: GYAE6OF02HJ65K.16.39.D06.1.454.CMB.1.raw
  modified_base (307)..(307): a, c, t, g, unknown or other
  misc_feature (307)..(307): n is a, c, g, or t
  modified_base (367)..(367): a, c, t, g, unknown or other
  misc_feature (367)..(367): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaggtgtccagtgtgaggtgtacttggtggagtctggaggaggcttgacccaggccggggggtccctgagactctcctgtgcagcctcgtggttcagcgtcagtaaccaaccacgtgatggtcgggtccnccgagccctccgaggggaagggctggaagtggtctcagttatagaaatgagtggtgacanatctacgcgactcgtagacggccgattcacctatcctacgagacgactaacttaccgaaagaaccgacggtataaacttcttaacaaagttcgaaacacgtcctaagaacggaaccggacgaaccgaccgggtccgtaattacgttaagttcgttaagttaacggtttacgtagggttaggttaacgttccggggtaccccgttagggggacccgtaacggggtaaccgttcgggtaccgtacccggttcctacccgttaccgacgtcccctaccgaaccccgg

SEQ ID NO: 137062 - DNA, 740 bp, Homo sapiens
  misc_feature: GYAE6OF02IYY83.16.39.D06.1.454.CMB.1.raw
  modified_base (386)..(386): a, c, t, g, unknown or other
  misc_feature (386)..(386): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctgggaggaggcttgacccgaggcccgggggggtccctgagactctcctgtgccagcctctgggttcagcgtcagtaaccaaccacgtgatgtcgggtccgccagtccctccgagggggaacggggcgtagggaacgtggggtcctacgtaagtttattaagaaaaattggaatgggtanaacctaactaatcctaccgcccgtactcccggtaggaacggccgtaattcccaacctactcctacagacgtaacctaagtttaccaaaggaacccgtaacggtgtaaacttcgttaaccaaaattcggaaacacgtaccgtagaacgaaaccggacggaaccaccggtaccgttaaatttagtttaacgtttagtaactttaacgggtttaattagggtttaacgggttaacggtttcccgggggtacccgtaccggggggtaaccgtaacggggaacccggtttacggtacccgttaacccggttcctacccggttccgaaccggtcccgttaccccgaaccggtaacccggg

SEQ ID NO: 137063 - DNA, 583 bp, Homo sapiens
  misc_feature: GYAE6OF02FVTQ1.16.39.D06.1.454.CMB.1.raw
  modified_base (362)..(362): a, c, t, g, unknown or other
  misc_feature (362)..(362): n is a, c, g, or t
  modified_base (398)..(398): a, c, t, g, unknown or other
  misc_feature (398)..(398): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccagccgggggggtccctgagactctcctgtgcagcctctgggttcagcgtcagtaacaaccacgtgatgtgggtccgccagccctaccgaggggaaggggctagggaatggggtctcgagttattagaaaatgatggtnacacaatcacgccactcgtgaggccattcaccatcncagagacaattccaaagacacggtagaacttctacaaatgaaactgccctagaacgtaaccgaggaaccacggaccgtatatttagttagtaattaggttatggtagtacgttcgggcccgtggggaccagggtaccgtggtaccgtaccgtcctccgtcgacgtccctaccgacctaacccggg

SEQ ID NO: 137064 - DNA, 572 bp, Homo sapiens
  misc_feature: GYAE6OF02FYOHQ.16.39.D06.1.454.CMB.1.raw
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccagccgggggggtccctgagactctcctgtgcagcctctgggttcagcgtcagtaacaaccacgtgatgtgggtccgccagcctccaggggaaggggctggaatgggtctcagttattagaaaatgatggtgacacaatctacgccgactccgtagaacgggcctattcaccatcctacagacgacaattccaaagaacacggtagaattctacaaatgaaacagtcctaggaacgtaaccggaggaccacggaccgttatattattgtatagttatggtgtacgttccgggacccgtggggccagggaccgtggtccaccgtctcctcgactccctaccacgtaccgg

SEQ ID NO: 137065 - DNA, 583 bp, Homo sapiens
  misc_feature: GYAE6OF02FQ85K.16.39.D06.1.454.CMB.1.raw
  modified_base (364)..(364): a, c, t, g, unknown or other
  misc_feature (364)..(364): n is a, c, g, or t
  modified_base (406)..(406): a, c, t, g, unknown or other
  misc_feature (406)..(406): n is a, c, g, or t
  modified_base (426)..(426): a, c, t, g, unknown or other
  misc_feature (426)..(426): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctgggaggagggcttgacccaggccgggggggtccctgagactctcctgtgcagcctctgggttcagcgtcagtaacaaccacgtgatgtgggtccgcagcctccgaggggaaggggctggaatgggtctcgagttattagaaaatgatggtnacacatcacgcgactcgtagacgggcattcacatctacaganacaataccaagaacacgtanaactctacaaatgaacagcctagaacgaaccggagaccgacggacccgtataacttagttgtattaaggttataggttaggttagttccgggcccgtcggggccgacggggtaaccggtcgtacgaccgtctccctcgacgtccctaccgaacccgg

SEQ ID NO: 137066 - DNA, 753 bp, Homo sapiens
  misc_feature: GYAE6OF02I71KR.16.39.D06.1.454.CMB.1.raw
tcagtgtactactccacgaccggtgctcgatttagtgacatctcgcagttctttggggggagaggagcccagcactgggattccgaggtgtttccattcggtgatcagcactgaaacacagaggactcaccatggagtttggctgagttggtttccttgctgcttaattttaaaaggtgtccagtgtgaggtgtacttggtggagtctgggaggaggtcttgacccaggcccggggggtcctgacgctctcctgtgcacgcctcgtggtcagcgtcagtaacaacacgtgatggtcggtccgccacgcctaccgaggggaacgggcgtggaagtcgggtactacgaaacgtactacgaactaacgacgtaaggtaagtacgtaccgacgtaagtcggtaaccgacgaacgtaccgttacggtacggtaacgggttcccgtttaccgaaccgtacgtaccgtacccgaaggaaacgtaccttaaacttaacccgaaaagaaccctaccggtacttaggttaactttacgaactaaaacgtacgtaaactaacggttcgtaagtaacggaacgggttacggaaacggtaacccgaacgtacccgtaaattaaacgttaacgttaacgtggtaccggaacgggtaacggtacggggttaaggtttcggggtaccgggtacgggttagaacccgttggaccgtttaacggttaggtaacccggttaacgggtaccgggggacccgtaaacccggggg

SEQ ID NO: 137067 - DNA, 926 bp, Homo sapiens
  misc_feature: GYAE6OF02HLYAQ.16.39.D06.1.454.CMB.1.raw
  modified_base (256)..(256): a, c, t, g, unknown or other
  misc_feature (256)..(256): n is a, c, g, or t
  modified_base (267)..(267): a, c, t, g, unknown or other
  misc_feature (267)..(267): n is a, c, g, or t
  modified_base (299)..(299): a, c, t, g, unknown or other
  misc_feature (299)..(299): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggtttccttgctgctattttaaaaggtgtccagtgtgaggtgtacttggtggagtctggaggaggcttcgacccaggcccggggggtccctgagctctcctgtgcngcctctggtcngcgtcagtaaccaacacgtgagtgtgggtccnccgagcccgtacgaggggaacgggcgtagggaagtcgggtactcgtagttaattagaaaatcggtagtagggtacgaacaacgtaagtaccgtaccggacccggtaaccgtttacccggtagggtaaacccgggggtaccgtaacgtttacccgaaacccgtaaccggttacccttaccccgtaaagggaaaccggtaaacctaaaaccgttttaaaccccggaaaaaccggtaaacccggttaacccggggttaaagtaaaccgtttacccgtttaaacgtaaaaacgttaccgggaaaacctaacgggtaccccttaagggaaaccggtaaaaccccgggaacggggaaacccgtaacccggggtaacccggtttaaaccgtttaagttttaaccgtttaacgggtttaaacgttttaaaggggttttaaacggtttacggggggtttaacgggtttaaacccgggtttacccgggggggttaccccccggttacgggggggtaaccccggtaaccggggggttaaccccgggtttaccgggtaccccggttaaccccgggtttccccgtaccggttaccccgaccggttaccccgttaaccccggaaccccggtaaccccgggg

SEQ ID NO: 137068 - DNA, 627 bp, Homo sapiens
  misc_feature: GYAE6OF02GH6QR.16.39.D06.1.454.CMB.1.raw
  modified_base (279)..(279): a, c, t, g, unknown or other
  misc_feature (279)..(279): n is a, c, g, or t
  modified_base (305)..(305): a, c, t, g, unknown or other
  misc_feature (305)..(305): n is a, c, g, or t
  modified_base (372)..(372): a, c, t, g, unknown or other
  misc_feature (372)..(372): n is a, c, g, or t
  modified_base (407)..(407): a, c, t, g, unknown or other
  misc_feature (407)..(407): n is a, c, g, or t
  modified_base (417)..(417): a, c, t, g, unknown or other
  misc_feature (417)..(417): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggagtttggctgagttgggttttccttgctgctattttaaaggtgtccagtgtgaggtgtacttggtggagtctggaggaggcttgacccaggccgggggggtccctgagactctcctgtgcagcctcgtggttcagccgtnagtaacaaccacgtgatgtgggtccnccgagccctccgaggggaaggggctaggaagtgggtctcgtagttattagaaaatgagtggtgacanaatctacgccgactcgtagaacggccgattccacntctccagaanactaatccaaagaacaggtgaacttctacaaatcgaactacgcctaggaacgaaccggagaccgtaccggccgttaaattacgttaattagttaacgttaaggtttagtagggttacgttacgttccggggtacccggtggggacccgtacggggaacccgttggtacccgtaccgttccgtacctcgaccgtcccgtaccgtaacccgg

SEQ ID NO: 137069 - DNA, 690 bp, Homo sapiens
  misc_feature: GYAE6OF02IHGYJ.16.39.D06.1.454.CMB.1.raw
  modified_base (311)..(311): a, c, t, g, unknown or other
  misc_feature (311)..(311): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccaggccgggggggtccctggagactctcctgtgcagcctcgtgggttcagcgtcacgtaacaaccacgtgatggtcgggtccnccagccctcgaggggaggggtctaggagtgggtctcgagtttatagaaaatgagtggtagacacatctacgccgactcggtaggacggccgtatacaccatccgacagacgaactaattacccaaagaacgtacggtataacttcgttaaccaaatcgaaaccagtccctaggaacgaaaccgggtacggacgtacggtacccgttaattacgttaagtttacgtaaggtttaaggttcgtttaggggttacgttaacgggttcccggggaccccggtggggggtaacccgtacggggggtaaccccggttagggtaccctaccccgggttaccctcccgttacccggtaaccgtccccccgttaaccaacccccgggg

SEQ ID NO: 137070 - DNA, 829 bp, Homo sapiens
  misc_feature: GYAE6OF02GYE5T.16.39.D06.1.454.CMB.1.raw
tcagtgtactactccacgaccggtgctcgatttagtgacatctcgcagttctttgggttttggggagaggagcccagcactgggattccgaggtgtttccattcggtgatcagcactgaacacagaggactcaccatggagtttggctgagttgggtttcttgctgctattttaaaggtgtccagtgtgaggtgtacttggtggagtctgggaggaggcttgaccaggccggggggtccctgacgactctcctgtcgcagcctcgtgggttcacgtcgtcaagtaaccaaccacggtcgagtggtcgggtacccgccaaggtcccgtaccggacgggggtaacggggctagggtaaagtcggggtactcggttaagttagttaagtaaaacgtgtagtggtacgaacaactaatccgtaccgaccggtaccgttccggacggaacggggtacccgtagttaccaaccgtactccgtaccgaagacgaactaaacgtttaccaaaacggtaaccgtaacgggtacgtaaacttaccttaacgaaacgttaacgaaaccgacgtaccgttaagggaaccggtaaacccgggaacgggtaacccgtaaccgggtacccgttaaagtttaacgttttaaggtttaagttttaacggttaaaggttttaaggttacggggtttaacgggtttaccggtttcccgggggtaccccggttacgggggggtaccccgtaaacgggggggttaaccccggttacgggttaccccgttaaccgggttcccgttaccccgttaacggtaccccggtacccgtaaccccgtaaaccccggg

SEQ ID NO: 137071 - DNA, 596 bp, Homo sapiens
  misc_feature: GYAE6OF02GBQGC.16.39.D06.1.454.CMB.1.raw
  modified_base (280)..(280): a, c, t, g, unknown or other
  misc_feature (280)..(280): n is a, c, g, or t
  modified_base (306)..(306): a, c, t, g, unknown or other
  misc_feature (306)..(306): n is a, c, g, or t
  modified_base (360)..(360): a, c, t, g, unknown or other
  misc_feature (360)..(360): n is a, c, g, or t
  modified_base (434)..(434): a, c, t, g, unknown or other
  misc_feature (434)..(434): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccagccgggggggtccctgagactctcctgtgcagcctcgtgggttcagcgtnagtaacaaccacgtgatgtgggtccnccagccctccgagggagggctggaatgggtctcagttattgaaaatgatggtanacacaatctacgccgactccgtagaagggccgattcacactctccagacgactaattccaaagaaccacggtanaatctacaaatgaacagacctagaagaaccgaggacacggtacctattagttattgtaattaggttagtaggtaggtagttcgggtccccgtaggggcccgaaggggttaacccgtggtacccgtaccgtccgtccgtaccacggtccctacccgaacccgg

SEQ ID NO: 137072 - DNA, 647 bp, Homo sapiens
  misc_feature: GYAE6OF02GKRQM.16.39.D06.1.454.CMB.1.raw
  modified_base (387)..(387): a, c, t, g, unknown or other
  misc_feature (387)..(387): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccaggccgggggggtccctggagacctctcctgtgcagcctcgtgggttcagcgtcagtaacaaccacgtgatgtgggtccgccagcctccgaggggaaggggctagggaagtgggtctcgtagttatagaaaatgatggtagacacaatctacgccgactccgngaacgggccattccaccatcctaccagacgtaacaacttaccaaagaaccgacgggtataacttacttaaccaaatagaaacacgccgtagaacgaaccgacggaaccgacggaccgttatagtttagtagttaacgttagttagttggttaggttaacgttccggggtaccccgtacggggccgtaacggggtacccggtcggtaccgtaccggtccttcccgtaccgaccggtcccgtacccgacccggtaacccggg

SEQ ID NO: 137073 - DNA, 594 bp, Homo sapiens
  misc_feature: GYAE6OF02G4B81.16.39.D06.1.454.CMB.1.raw
  modified_base (366)..(366): a, c, t, g, unknown or other
  misc_feature (366)..(366): n is a, c, g, or t
  modified_base (370)..(370): a, c, t, g, unknown or other
  misc_feature (370)..(370): n is a, c, g, or t
  modified_base (400)..(400): a, c, t, g, unknown or other
  misc_feature (400)..(400): n is a, c, g, or t
  modified_base (429)..(429): a, c, t, g, unknown or other
  misc_feature (429)..(429): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttggggttttccttgctgctattttaaaaggtgtccagtgtgaggtgtacttggtggagtctggaggaggcttgacccaggccgggggggtccctgagactctcctgtgcagcctcgtgggttcagcgtcagtaacaaccacgtgatgtgggtccgccagccctccgaggggaggggctagggaatggggtctcgagttatagaaatgatggtnacanaatctacgccactcgagagggcctatcacntctcagagacaattaccaagaacaggtanaatcttacaatgaacagcctagacgaaccgagaccgacggaccgtatattattagtaataggttagtggttaggtacgttccgggaccccgttggggaccgacggggtaaccgtcgggtaccgtaccggttcctccgttaccgacgtcccctaccgtaaccccgg

SEQ ID NO: 137074 - DNA, 744 bp, Homo sapiens
  misc_feature: GYAE6OF02JHHY6.16.39.D06.1.454.CMB.1.raw
  modified_base (364)..(364): a, c, t, g, unknown or other
  misc_feature (364)..(364): n is a, c, g, or t
  modified_base (390)..(390): a, c, t, g, unknown or other
  misc_feature (390)..(390): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtcgtggaggaggtcttgacccgaggccgggggggtccctgagactctcctgtgcagcctctggacttcacctttagtggccctagtcgccatgagcgtcgggtccgccgaggcctccggaaggggaacggggctaggaacgttggggtctacgaagttntcacgaagccaagtagtagtacccgnactgggtacgcaggacgtcccggtggaaacgggtcccgtttacaaccgtagtccctaccaacggaacctaacgtaaactttacccgaaaggaaaccgtaccggtactacgtttaactttacggaactaaaacgttgaaaaccgttacgtaccgttaggaagtaacggttaccgggaacgggaaaccgtaccgggaccctaagtttaaacggttaatttacccgggttagttaccgggaacgggtaaacggtccgggggtaaaggtttttgggggaaccgggttaccgggttaacgtaccggtttacggtaaccgtttaggtttaccgggaaccgtttccgggtaacccgggggg

SEQ ID NO: 137075 - DNA, 523 bp, Homo sapiens
  misc_feature: GYAE6OF02FK2R6.16.39.D06.1.454.CMB.1.raw
  modified_base (394)..(394): a, c, t, g, unknown or other
  misc_feature (394)..(394): n is a, c, g, or t
  modified_base (414)..(414): a, c, t, g, unknown or other
  misc_feature (414)..(414): n is a, c, g, or t
  modified_base (502)..(502): a, c, t, g, unknown or other
  misc_feature (502)..(502): n is a, c, g, or t
  modified_base (511)..(511): a, c, t, g, unknown or other
  misc_feature (511)..(511): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccaggccgggggggtcctgagactctcctgtgcagcctctgggttcagcgtcagtaacaaccacgtgatgtgggtccgccagcctccgaggggaaggggctggaatggggtctcagttattagaaaatgagtggtgacacaatctacgccactcgtgaacggcatcacatcncagagacatacaagacaggnaatctacaaatgaacacgctgacgaacgaggacacggctatattatgtatagttagtgtagtagtcggccgtgggcgaggacgtgtcncgtctcctncgctccacacgg

SEQ ID NO: 137076 - DNA, 628 bp, Homo sapiens
  misc_feature: GYAE6OF02HJR5N.16.39.D06.1.454.CMB.1.raw
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccaggccgggggggtccctgagactctcctgtgcagcctcgtgggttcagcgtcagtaacaaccacgtgatgtgggtccgccagccctccgaggggaaggggctgggaagtggggtctcgagttattagaaaatgatggtgacacaatctacgccgactcgtggaacggccagttcaccatcctcagacgactaacttaccaaagaaccacggtagaacttcttaacaaatacgaaacagcctagaacgaaaccggaggaccgacggactatattaagttgtaattaggttatagggttaggttacgttccggggaccccgttgggggacccgtaagggggtaacccgttacgggtcctacccggttccgtcccgtacgaccgtcccgtacccgaacccgg

SEQ ID NO: 137077 - DNA, 606 bp, Homo sapiens
  misc_feature: GYAE6OF02IN3SG.16.39.D06.1.454.CMB.1.raw
  modified_base (340)..(340): a, c, t, g, unknown or other
  misc_feature (340)..(340): n is a, c, g, or t
  modified_base (362)..(362): a, c, t, g, unknown or other
  misc_feature (362)..(362): n is a, c, g, or t
  modified_base (454)..(454): a, c, t, g, unknown or other
  misc_feature (454)..(454): n is a, c, g, or t
tcagtgtactactccacgaccggtgctcgatttagtgacatctcgcagttctttgggttttggggagaggagccccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccaggccggggggtccctgagactctcctgtgcagcctctggtcagcgtcagtaacaaccacgtgatgtgggtccgccacgcctccgagggaaggggctgggaatgggtctntagttattagaaatgatggtanacacaatctacgcacgtcgtagaacgggtccgtcaccgttcaccgagacgactactaccaagaaccacgctactaactctacgactaagttnaccctagcctgacgcgaccggacgaccgacgcccagttcgttaacttactagttaaacctaagtccggcgggtacggcccggcgggtacccggtacctacggtacgtttgggttttagacgtttcggacgggtaccgaagggaccgtaacgg

SEQ ID NO: 137078 - DNA, 705 bp, Homo sapiens
  misc_feature: GYAE6OF02G03ZE.16.39.D06.1.454.CMB.1.raw
  modified_base (456)..(456): a, c, t, g, unknown or other
  misc_feature (456)..(456): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccgaggccggggggtccctgagactctcctgtgcagcctcgtgggttcagcgtcagtaacaaccacgtgatggtgggtccgccagcctccgaggggaaggggctagggaatgggtctcgagttattagaaaatgatggtgacacaatctacgccgactccggtaggaacgggccgattccacctactcctaccgagaacgtaacctaacttaccgaaagaacctaacgggttanaaacgttccttaagaaacttacggaaacacgtacctaggaaacgaaacccggaggaaccgaccgggtaacccgttaattaagtttaactttggtaagtttacgggttaattacggggttaagggtttaacgttcccgggggtaccccgttcgggggggaaccccgtaagggggtaaccccgttgggtacccgtacccggttcccttaccgtcgaacccgtcccgttaccccgaaccggtaaccccgggg

SEQ ID NO: 137079 - DNA, 695 bp, Homo sapiens
  misc_feature: GYAE6OF02HBHLX.16.39.D06.1.454.CMB.1.raw
  modified_base (465)..(465): a, c, t, g, unknown or other
  misc_feature (465)..(465): n is a, c, g, or t
  modified_base (493)..(493): a, c, t, g, unknown or other
  misc_feature (493)..(493): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggtttccttgctgctatttaaaaggtgtccagtgtgaggtgtacttggtggagtctggaggaggcttgacccaggccggggggtcctgagactctcctgtgcagcctctcgggttcaggcgtcaagtaaccaacctacgtgatggtgggtccgccacgtccctccgaggggaacggggctgggaagtgggtctacgagtttatagaaaatgatggtgaacacaatctacgccgactccgtaggaacgggcctattccaaccatcctacagagacaacttaccgaaagaaccgtacggtagaaacttctaacaaancgaaaacgcgacctaggaacgaaaccgnggaacgtaaccgggaccttaataagtttacgttaggttaacgtttaaggggttattagggggttaacgttaaaccggttccggggtacccccgggttacgggggaacccgaacggggggttaacccttcgggtacccctaacccggtttcctaaccccgttgaacccggtccccgttaccccggaccgttaaaccccggggg

SEQ ID NO: 137080 - DNA, 926 bp, Homo sapiens
  misc_feature: GYAE6OF02JV4MO.16.39.D06.1.454.CMB.1.raw
  modified_base (378)..(378): a, c, t, g, unknown or other
  misc_feature (378)..(378): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaggtgtcagtgtgaggtgtactggtggagtcgtggaggaggtcttcggacccgacgggtcccggggggggttcccctaggacgtaccgttccgttcccgtaggttcggccgacgtcccgtttcggttcgggtttcgacgtccgttacgaacggttaaaccaacccgtaacggtaggtacgttcgggtcggggttaccccnccgtagtccccgttaccgggaagggggaacggggtccgtaaggggtaacgttcggggtcctaacgttaaggtttagttaacggtaaaagttcggtaagttcgggtacgaaacccgtaacgtaaaccgttaccgtaccggtaccggtaaccgttacccgggtacgggtaaccggggaccttaaaccgttcccaaaccttacgtacccgttaccgtaaggaaccgtaaacctaaacgtttacccggaaaacggttaaccggtaacggttaactaaaccgttactttaaaccgaaacgttaacggaacgtaccgtaaccggtacgaaaccggaaaccggaacgggtaacccgtaaccgggtacccgtttaaactaagttttacgttaacgttaacggtttaacgggttaagtacggggtttaacgttaaccgggttccccgggtacccgggttacggggaacccggttaaggggtaaccccggtttcggaaccgtttaccccggttactccccggttaacggtaccgtccccggtacccgtaaaccccggg

SEQ ID NO: 137081 - DNA, 609 bp, Homo sapiens
  misc_feature: GYAE6OF02HJVG5.16.39.D06.1.454.CMB.1.raw
  modified_base (473)..(473): a, c, t, g, unknown or other
  misc_feature (473)..(473): n is a, c, g, or t
  modified_base (587)..(587): a, c, t, g, unknown or other
  misc_feature (587)..(587): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccaggccgggggggtccctgagactctcctgtgcagcctcgtgggttcagcgtcagtaacaaccacgtgatgtgggtccgccagccctccgaaggggacgggctggaatcggggtactcgagttattagaaaagtgaagtggtagaacacaatctaccgccgacgtccgtagaacgggcccgtattccgacactctccagagacaacttaccaagaacacggtagaacttctacaaattcgaaacngactagacgaaccgaggacacggaccgtattagttattgtataggttgtaggtaggtacgttccggcccgtggggtacccaggggtaaccgtcggtaccacccggtctccccgngaccgtccctacccgaacccgg

SEQ ID NO: 137082 - DNA, 643 bp, Homo sapiens
  misc_feature: GYAE6OF02I8PAV.16.39.D06.1.454.CMB.1.raw
  modified_base (242)..(242): a, c, t, g, unknown or other
  misc_feature (242)..(242): n is a, c, g, or t
  modified_base (273)..(273): a, c, t, g, unknown or other
  misc_feature (273)..(273): n is a, c, g, or t
  modified_base (303)..(303): a, c, t, g, unknown or other
  misc_feature (303)..(303): n is a, c, g, or t
  modified_base (372)..(372): a, c, t, g, unknown or other
  misc_feature (372)..(372): n is a, c, g, or t
  modified_base (466)..(466): a, c, t, g, unknown or other
  misc_feature (466)..(466): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagtttggctgagttggttttccttgctgctattttaaaaggtgtccagtgtgaggtgtacttggtggagtctgggaggaggcttgacccgaggccggggggtccctgngactctcctgtgcagcctcgtggtcagcgtnacgtaaccaaccacgtgatggtcgggtccnccagtcccgtccgaaggggacggggtctaggaagtcgggtctcgagtttatagaaaatgagtgtacganacatcctaacgcgactccggtaggaacggtccattcaccgtatcctcgaggacactaactaccaaagtacacgtataatcttacaaatgaaacncgaccgtagaacggtaacgaggacaccggcttaagtattaattggttaataggtttagtacggttagttacgttccgggtcccggtaggggtacccggtaagggtaacccggttggtaccccgtaccgttacccgttaccgtaccgtaccggccccttaaccgacccggttaaccgg

SEQ ID NO: 137083 - DNA, 743 bp, Homo sapiens
  misc_feature: GYAE6OF02F17Q6.16.39.D06.1.454.CMB.1.raw
  modified_base (293)..(293): a, c, t, g, unknown or other
  misc_feature (293)..(293): n is a, c, g, or t
  modified_base (304)..(304): a, c, t, g, unknown or other
  misc_feature (304)..(304): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccgaggcccgggggggtccctggagactctcctgtgcagcctctgggttcagcgtcagtaacaaccacgtnatgtgggtccnccagcctcgaggggaaggggctggaagtgggtctacgagtttatagaaaagtgagtggtagacacaatctacgcccgactccggtaggaacgggtccgtattaccacctatcctacccgaagacgaactaacttacccgaaagaaaccgtacgggtagtaaacttaccgttaacaaaacgttagaaaccacggtacccgtagggaaccggaaacccgggacgggaacccgaaccggggtacccgttaagtttaacgtttaagtttacggttaagtttaaacgggtttaggttaggggtttaacgggttaaaccggtttcccgggggacccccggttggggggaacccggtaagggggttaaaccccggttcgggttacccgtaccccggttctaccccggttccgaaccgtccccgttacccgaacccggtaacccggg

SEQ ID NO: 137084 - DNA, 562 bp, Homo sapiens
  misc_feature: GYAE6OF02FZ0AE.16.39.D06.1.454.CMB.1.raw
  modified_base (408)..(408): a, c, t, g, unknown or other
  misc_feature (408)..(408): n is a, c, g, or t
  modified_base (427)..(427): a, c, t, g, unknown or other
  misc_feature (427)..(427): n is a, c, g, or t
  modified_base (432)..(432): a, c, t, g, unknown or other
  misc_feature (432)..(432): n is a, c, g, or t
  modified_base (448)..(448): a, c, t, g, unknown or other
  misc_feature (448)..(448): n is a, c, g, or t
  modified_base (455)..(455): a, c, t, g, unknown or other
  misc_feature (455)..(455): n is a, c, g, or t
  modified_base (458)..(459): a, c, t, g, unknown or other
  misc_feature (458)..(459): n is a, c, g, or t
  modified_base (464)..(464): a, c, t, g, unknown or other
  misc_feature (464)..(464): n is a, c, g, or t
  modified_base (490)..(490): a, c, t, g, unknown or other
  misc_feature (490)..(490): n is a, c, g, or t
  modified_base (503)..(503): a, c, t, g, unknown or other
  misc_feature (503)..(503): n is a, c, g, or t
  modified_base (512)..(512): a, c, t, g, unknown or other
  misc_feature (512)..(512): n is a, c, g, or t
  modified_base (541)..(541): a, c, t, g, unknown or other
  misc_feature (541)..(541): n is a, c, g, or t
  modified_base (549)..(549): a, c, t, g, unknown or other
  misc_feature (549)..(549): n is a, c, g, or t
  modified_base (556)..(556): a, c, t, g, unknown or other
  misc_feature (556)..(556): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccaggccgggggggtccctggagactctcctgtgcacgcctcgtggggttcagccgtacagtaaacaaaccacgtgagtggttcgggtcccgccagccctccggaggggaaggggctaggaagtggggtctcgagtttaattagaaaatggatggtgacaacaatctaaccgccgactcgngaacgggccattcacatcncaganacaatccaagacagtnaatccanaannaacancagacgacgagacacggactatattntagtataggttanggtagttancgggcccgtgggccaagggacctggaccncgtctccncacgccnccaccg

SEQ ID NO: 137085 - DNA, 733 bp, Homo sapiens
  misc_feature: GYAE6OF02GAQ1M.16.39.D06.1.454.CMB.1.raw
  modified_base (213)..(213): a, c, t, g, unknown or other
  misc_feature (213)..(213): n is a, c, g, or t
tcagtgtactactccacgaccggtgctcgatttagtgacatctcgcagttctttgggggagaggagcccagcactgggattccgaggtgtttccattcgtgatcagcactgaacacagaggactcaccatggagttttggctgagttggtttccttgctgctagttttaaaaggtgtccagtgtgaggttgtacttggtggagtcgtggaggnggtcttgaccctggccggggggtccctggacgacttcgtcctgtgcacgccgtctgggttcacgcgtacagtaaccaccacgtgacgtggtacggtccgaccgacgtcccgtaccggaaggggtacggggtcctagggtaacgttcggggtcctcgtagtttagttagtaaaagtcgtaacgtggtagtacctaacgtaactccgtaacgccgtaccgtaccgtaggaaccggtacccgtagttccgaaccgtccgtccgtaccgtaacggacgtactaaacctaccgaacgaaaccgtcggttagacttaccgtaacgaagtacgtaacgacgttaccgtacggaacgtaccggacggtacgaccggtaacgttacgttaagttccgttaaggttaccgttaaggtttaccggagggtttacgttaacggttccggacccggttacgggaccgtaacgggtaccgtcggttacgtaacgtccgttaccgaccgtaccgtacctcccggtaatacccggg

SEQ ID NO: 137086 - DNA, 761 bp, Homo sapiens
  misc_feature: GYAE6OF02F0B4R.16.39.D06.1.454.CMB.1.raw
tcagtgtactactccacgaccggtgctcgatttagtgacatctcgcagttctttggggggtagaggagcccagcactgggattccgaggtgtttccattcggtgatcagcactgaacacagaggactcaccatggagtttggctgagttgggttttccttgctgctattttaaaaggtgtccagtgtgaggtgtacttggtggagtcgtggaggaggcttgacccgaggccgggggggtccctggacgactctcctgtgcagcctgtgggttcagtcgtcaagtaacaaccacgtgactggtcgggtccgtcacgtcctaccgaggggaacgggtcgtagggtaagtcggggtcttaccgtagtttaagttaaggtaaaagtggtaagtggttacgaactaacgtaaattccgtaaccgccggtaaaccgtttcccgggtaagggtaaacgggtccggtaacttacccgaaccgtactcccgtacgaacgacgtaaacgaaactttaccgaaagtaaccgtaacgggttaacgaaactttcctaaagaaaccttaaggaaacccacgtacctaacggaactaaaccggacgggtaacccaacggtaaccgtttaatttaacgttagttacgtaacgtttagttaggttcgggtaagtttaaccggttccggggaccccgtggggtaacccggaaggttaaccgggtcgttaccggaaccgtttcctacccgtagccgtacccgtacccgacgtaacccggg

SEQ ID NO: 137087 - DNA, 745 bp, Homo sapiens
  misc_feature: GYAE6OF02I7SLE.16.39.D06.1.454.CMB.1.raw
  modified_base (310)..(310): a, c, t, g, unknown or other
  misc_feature (310)..(310): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaagtgtccagtgtgaggtgtacgttggtggagttcgtggaggaggcttgacccgaggccggggggtccctggagactctcctgtgcagcctcgtggtcagcgtcagtaacaccacgtgagtgtggtccgccgngccgtccgagggaaggggctagggagtgggtctcgtagttattagaaatggagttggtacgaactaacgaactccgtaacggccgtaccgtcggtaacggaacgggcccgtacttaccaccgtactccctaccgagtaacgaacctaacgttaaccgaaacgtaaccgtaacggtacgtaaacttaccttacgtaaaactaggaaacctacgtaacccgtagaaaccgaaccgggtaacggaaccaaccgggtaccgtaaacgttagtttaagttacggttaagttaagggtttaacggttagggttaccgggttaccggttacccggggttacccggaacgggggttaccggtaacggggtaacccggttacggttaacccgtacccggttcccgtacccgttccgaacccgtccccgtaccgtaaaccccggg

SEQ ID NO: 137088 - DNA, 794 bp, Homo sapiens
  misc_feature: GYAE6OF02HZ89R.16.39.D06.1.454.CMB.1.raw
  modified_base (502)..(502): a, c, t, g, unknown or other
  misc_feature (502)..(502): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaaggtgtccagtgtgaggtgtacttggtgagtctggaggaggcttgacccaggccgggggtaccgtgagactctcctgtgcgagcctcgtggttcagcgtcagtaacaaccacgtgatgtgggtccgccgacgcccgtaccgaggggaacggggcgtggaagtgggtcctcgtagtttattagtaaacgtggtagttaggtagaacactaactacgtaccgccgacttcccggtaggaacgggccgtacgttaccaccactctccaagaacgaactaacgtttacccaaaagtaacgtaacgggtagtaaactttccgtttaanaaagttacgaaaccacggtcccgtaagacggaaaacccggtggggaaacccacccggggtaactttacgtttaacgttttaacgtttacgggtttaaagttaagggtttaacgttagggggttttaacgtttaacccgggtttcccggggttacccccccgggttaggggggggtaaccccgtaaacgggggggtttaacccccgttttacggggaccccgttaccccccgggttaccttccccggttaaccgtaccgggttaccccccctacccggtaaaaccccccgggg

SEQ ID NO: 137089 - DNA, 709 bp, Homo sapiens
  misc_feature: GYAE6OF02F7DJR.16.39.D06.1.454.CMB.1.raw
  modified_base (290)..(290): a, c, t, g, unknown or other
  misc_feature (290)..(290): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctgggaggaggcttgacccgaggcccgggggggtccctggagacctctcctgtgcagcctcgtggttcagcgtcagtaacaacncgtgatggtcggtccgccagccctcgaggggacgggcgtaggaatggggtctcgtagttattagaaaatgtagtggtagacacatcgtacgccgactcggagaacgggctacttcacctatccgtaccagaacgtacctaaattacccgaaagaaccgtacggtaacgtaacgttacctaacgaaagtacgaaacgacgtacctaggaaacgaccgaacggaacgaccggtaacgttagtaacgtttaacgttagttaacgttaaaggtttacggtacggggtttaacggttaaccggttcccggggttaccccggtcgggggtaacccgtaaccgggggttacccgggttcggtacccgtacccggtttcctacccgttacggacccgttccccgtaacccgacccggtaaacccggg

SEQ ID NO: 137090 - DNA, 808 bp, Homo sapiens
  misc_feature: GYAE6OF02JKZOS.16.39.D06.1.454.CMB.1.raw
tcagtgtactactccacgaccggtgctcgatttagtgacatctcgcagttctttgggttttggggtagaggagcccagcactgggattccgaggtgtttccattcggtgatcagcactgaacacagaggactcaccatggtagttttggctgagttgggttttccttgctgctattttaaaggtgtccagtgtgaggtgtattggtggagtcgtggaggaggcttgacccgaggccgggggggtccctggagtactctcctgtcgcagcctcgtggtcagcgtcagtaacaccacgtgagtgtcggtccgcacgcctccggagggaacgggtcgtaggtaagtgggtctcgtagtttagtaagtaaagtggagtaggtacgaactaacaacttacgaccgaccgtacgtccggtaaggaacgggtaccctacgttaccaaccgtatcccgttaaccgacggaacgtaactaacttaacccgaaaacgtaaaccgtacgggtacgtaactaccgtttaaacaaaagttacgaacgtacgtaccgtaacgggaaaccggtaaccggaacggtaaaccggtaccggtacccgtttaaagtttaacgtttaacgttaagtttaaacggttaggtttaaacggttacgggttaacgggttaaccggtttaccccgggggcccccgggtttaagggggtaaaccccggtaaaccggggggttaaccccgttaggggtttacccccgtaccccgtttaacccggttccccgaacggttaccccggtaccccgttaacccccggtaaaccccgggg

SEQ ID NO: 137091 - DNA, 605 bp, Homo sapiens
  misc_feature: GYAE6OF02F43TC.16.39.D06.1.454.CMB.1.raw
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccaggccgggggggtccctgagactctcctgtgcagcctctgggttcagcgtcagtaacaaccacgtgatgtgggtccgccagcctccgaggggagggcgtggaagtgggtctcagttattagaaatgatggtgacacatctacgccgactcgtgacgggcagttccacactctccagacgactaattaccgaaagtaacacggtagaattctaacaaagtacgaacacgacctagacgaaccgaggaaccacggtctaattagttatttgtaataggttatgggtagttacgttccgggaccccgtggggacccgtaggggtaccggttggtaccgtaccggttcctcccgtagtaccgtcccgtacccgaacccgg

SEQ ID NO: 137092 - DNA, 728 bp, Homo sapiens
  misc_feature: GYAE6OF02IVNJZ.16.39.D06.1.454.CMB.1.raw
  modified_base (177)..(177): a, c, t, g, unknown or other
  misc_feature (177)..(177): n is a, c, g, or t
tcagtgtactactccacgaccggtgctcgatttagtgacatctcgcagttctttgggggggagaggagcccagcactgggattccgaggtgtttccattcggtgatcagcactgaacacagaggactcaccatggagttttggctgagttgggttttcctgctgctattttaaaggngtccagtgtgaggttgtacttgggtggagtcgtagggaggaggtcgttgaacccgagggcccgggggggtccctgacgactctccgtgtcgcagcctcgtggttacagtcgtcaggtaaccaacgacgtgagtggtcggtccgccacggcctaccggaaggggacgggtcgtagggaacgttcgggtctacgtagtttaagtagaaaatggagttaggagaactacgtaatcctacggcccgtaacgtcgtacggaacgggcctaattcccaccactccgacaagtacaacctaactacccgaaagaacgcggtagtaacgttactaacgtaaactacgaacagtacctagaaccgtaaccggacgaaccgacggtaccgttaagttacgtttaagttagtaagtttaaggttaacgttacggttaggtttaaaccggttccgggtaccccggtacggggtaacccggaaacgggttaaccgggttccggtaccgttaacccggttcctaccggtcccaacggtaccccgttacgaccccggttaaccggg

SEQ ID NO: 137093 - DNA, 676 bp, Homo sapiens
  misc_feature: GYAE6OF02IHA8N.16.39.D06.1.454.CMB.1.raw
  modified_base (260)..(260): a, c, t, g, unknown or other
  misc_feature (260)..(260): n is a, c, g, or t
  modified_base (305)..(305): a, c, t, g, unknown or other
  misc_feature (305)..(305): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaaggtgtccagtgtgaggtgtacttggtgtagtctggaggaggcttgaccaggccggggggtccctgagactctcctgtgcngcctcgtgggttcagtcgtcagtaaccaccacgtgatgtggtccnccagcctccgaggggacgggctggatgggtctcgtagtttagtggtgttacgtggttatacccatactagtaccgcagaccttcggaggtacggggtcccgttacgacctactcctcccgaagacgaactaaacttacccaaagaaaccgactaaatacgtatacgttacgacttaaaagtacgtaaacaggacccgttaaggacgaaccgtaccgggaggaacccgacgggtccccgttaaagttaactttacgtacgttacggaccggtaaaggaccccgtaagggtaacgtacggacgttaggcggtacgttacggtaacccggaacggttccgggaccgtaaaccggggaccccgttaggtaccccg

SEQ ID NO: 137094 - DNA, 776 bp, Homo sapiens
  misc_feature: GYAE6OF02I05LA.16.39.D06.1.454.CMB.1.raw
  modified_base (266)..(266): a, c, t, g, unknown or other
  misc_feature (266)..(266): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgtctattttaaaaggtgtccagtgtgaggtgtacttggtggagtctggaggaggcttgacccgaggccgggggggtccctggagactctcctgtcgcngccttcgtgggttcagcgtcacgtaacaaccacgtgatggtcgggtcccgccacgccctccggacggggaaggggcgtggaagtgggtcctacgtagttagttagaaaagtgtaagtcggtacgacaactaacgtaccgtaccgaccgtaacgtccggtaggtaaaccgggccgtaacgttacccgaaaccctagtacccttaccgaaggaaccgtaacctaaagtttaacccgaaaacgtaaaccgtaacgggttacgtaaacgttacttaaccgtaaagtacgaaaacctacgtacccgtaacggaacggaaaccgggaacggtaaccgtaacggtacccgttaaattaacgtttaacgtttagttaacgtttaaggtttaacgttagggttacggttaacggtttacccgggtccccggtcggggtaacccgaacgggggtaaccgttacgggtaccgtaccccgttcgttacccgtaccgaccggttacccgacccgtaaccccgg

SEQ ID NO: 137095 - DNA, 578 bp, Homo sapiens
  misc_feature: GYAE6OF02GPRWY.16.39.D06.1.454.CMB.1.raw
  modified_base (368)..(368): a, c, t, g, unknown or other
  misc_feature (368)..(368): n is a, c, g, or t
  modified_base (389)..(389): a, c, t, g, unknown or other
  misc_feature (389)..(389): n is a, c, g, or t
  modified_base (459)..(459): a, c, t, g, unknown or other
  misc_feature (459)..(459): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccgaggcccgggggggtccctgagctctcctgtgcagcctcgtgggttcagcgtcagtaacaaccacgtgatggtggtcccgccagccctccgaggggaagggcgtaggaagtgggtctcgagttatagaaatgagtggtnacacaatctacgcgtactcgngaacggctattcaccactccacagacactaactacgaaacgacgacgtatacttcaactaagacgaaccngtaccgagacgaacggagacgacgtactattattagttagtagtagttagtgtagtacgccggtccggtaggaccggacggtcgtacgccgtctccgtcgacgtacgcctacgaaccgg

SEQ ID NO: 137096 - DNA, 1057 bp, Homo sapiens
  misc_feature: GYAE6OF02FU6PA.16.39.D06.1.454.CMB.1.raw
tcagtgtactactccacgaccggtgctcgatttagtgacatctcgcagttctttggggggagaggagcccagcactgggattccgaggtgtttccattcggtgatcagcactgaacacagaggactcaccatggagtttttggctgagtttggggtttcctttcgtctgtcgtattttaaaaggtttaggtccgtacgtaggtggtagggtggttacgtttaggttgggtaggtcgttggagggagggcgttcgtacccgaccggccgggggggtcccgggtcgagaccgtcctcctcgtgcgacgtccgtcgtcgggttcgagcggtcacgtaaaccgaaaccaccgttagagttggttacggggttcccggaccccacggccccgttacccggaacggggggaaacggggggtccggtagggtaacgggttacggggttccggttacgttaacggttttaagttttaaggttaaaaaacgttaggttaaggtttaggggttacggtaaccgtaaaccgtaaacttacccgttaacccggtaccccggtaacccggtttacccgggttaacgggtaaacgggggaccccgggtaactttacccgtaaccccgtaaaccgttacccgttaccccgtaacgaaacggtaaaccctaaacgttttaaccccgaaaaacgggtaaaccggtaaaccgggtacgtaaacgtttaccctttaacgaaaaacgttacggaaaccgtaaccgcccgttaacggggaaaaccggaaaccccgggtacgggaaacccgttaaccggggtacccgtttaaagtttttaaacttttaaaggttttacggggtttaaacgttttaaagggtttttacgggtttacggggttaacgggggtttttaacccgttttacccgggggggcccccccgggttaacgggggggaacccgtaaaccggggggttaaaccccggggtttcccggttaccggtacccccgtttaccgtttccccctaaccggttaacccgggtcccccttacccccggtaaacccggtaacccggggg

SEQ ID NO: 137097 - DNA, 658 bp, Homo sapiens
  misc_feature: GYAE6OF02GOHG6.16.39.D06.1.454.CMB.1.raw
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtcgtggaggaggcttgacccaggccggggggtcccgagacctctcctgtgcagcctcgtggtcagcgtcagtaacaacacgtgatgtgggtccgccagccctcgagggagggctggaatgggtctgagttatagaaaatcgatggtgacacaatctacgccgtactccgagacgggaccgattcaaccactcctccgagaacgaacaaacttaccaaagaaaccgtacggtacgaacttcctttaacaaagttagaaccacgtacctagaacgaaccgaaggaaccgacggaaccgttacgtaatttacttgtaacgttagttaggttcgggtaacgttacggtttaccgggccccgttacgggggaccctaaccgggggtaccgtcgggttaacccgtccgtccgttacccgtacggaccgtccctacccggacccgtaaacccggg

SEQ ID NO: 137098 - DNA, 664 bp, Homo sapiens
  misc_feature: GYAE6OF02FZYUI.16.39.D06.1.454.CMB.1.raw
  modified_base (471)..(471): a, c, t, g, unknown or other
  misc_feature (471)..(471): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccagcccggggggggtccctgagacgtctcctgtcgcagcctcgtgggtcagcgtacagtaacaaccacgtgatgtggtccgccagctccgaggggagggctggaagtgggtctctagttacgttagaaaagtgagtggtacgacacctaataccgtacgaccgacctccggtaggaacgggccgacttacgacctagtcctacgagacgaacaattaccgaaagtaacgacggtagaactccgttaanaattgaactagcctagacgaacgacgggaaccacggtactacgttaacttagttacgtaagttaacggttaggtgggtacggttaacgttcccggggaacccgtcggggtaccgtaaccggggtacccgttacgggtaccgtaccgttccgtcccgttacgacccgtcccgttacccgaaccggtaacccggg

SEQ ID NO: 137099 - DNA, 550 bp, Homo sapiens
  misc_feature: GYAE6OF02HNCJ9.16.39.D06.1.454.CMB.1.raw
  modified_base (389)..(389): a, c, t, g, unknown or other
  misc_feature (389)..(389): n is a, c, g, or t
  modified_base (433)..(433): a, c, t, g, unknown or other
  misc_feature (433)..(433): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccaggccgggggggtccctgagactctcctgtgcagcctctgggttcagcgtcagtaacaaccacgtgatgtgggtccgccagcctccgagggaagggctgggaatgggtctcagttatagaaaatgatggtgacacaatcacgccgactccgtgaggccatcaccntctccagacactaactcaaagacaggtgaatctacaaatgaacngctgagaaccgaggacacggctatatatagtataggttatggtagtatcgggcccgtgggaccgagggtaccgtggtacccaccgttctcctacgacggccctaccgaccgtacggg

SEQ ID NO: 137100 - DNA, 547 bp, Homo sapiens
  misc_feature: GYAE6OF02I1CI8.16.39.D06.1.454.CMB.1.raw
  modified_base (336)..(336): a, c, t, g, unknown or other
  misc_feature (336)..(336): n is a, c, g, or t
  modified_base (349)..(349): a, c, t, g, unknown or other
  misc_feature (349)..(349): n is a, c, g, or t
  modified_base (403)..(403): a, c, t, g, unknown or other
  misc_feature (403)..(403): n is a, c, g, or t
  modified_base (418)..(418): a, c, t, g, unknown or other
  misc_feature (418)..(418): n is a, c, g, or t
  modified_base (423)..(423): a, c, t, g, unknown or other
  misc_feature (423)..(423): n is a, c, g, or t
  modified_base (427)..(427): a, c, t, g, unknown or other
  misc_feature (427)..(427): n is a, c, g, or t
  modified_base (434)..(434): a, c, t, g, unknown or other
  misc_feature (434)..(434): n is a, c, g, or t
  modified_base (439)..(439): a, c, t, g, unknown or other
  misc_feature (439)..(439): n is a, c, g, or t
  modified_base (470)..(470): a, c, t, g, unknown or other
  misc_feature (470)..(470): n is a, c, g, or t
  modified_base (475)..(475): a, c, t, g, unknown or other
  misc_feature (475)..(475): n is a, c, g, or t
  modified_base (482)..(482): a, c, t, g, unknown or other
  misc_feature (482)..(482): n is a, c, g, or t
tcagtgtactactccacgaccggtgctcgatttagtgacatctcgcagttctttggggttttgggggagaggagcccagcactgggattccgaggtgtttccattcggtgatcagcactgaacacagaggactcaccatggagttttggctgagttgggttttccttgctgctattttaaaaggtgtcagtgtgaggtgtacttggtggagtctggaggaggcttgacccaggccgggggggtcctgagactctcctgtgcacgcctcgtgggttcagcgtcagtaaccaaccgacgtgatgtcgggtcccgccagccctccgaggggaacggggntggaatgggtctnagttatagaaatgagtgagacacaatcacgccactcgtgaacggcatcacatcncagacacaatccaanaacgngtanaatctanaaatnaacagcagacaacgagacacggctatattangttanagttagngtagtacgtccggaccgtgggaccaagggaccgtgtaccacgtcctcgctacgcctaccgaaccg

SEQ ID NO: 137101 - DNA, 681 bp, Homo sapiens
  misc_feature: GYAE6OF02G8FJB.16.39.D06.1.454.CMB.1.raw
  modified_base (391)..(391): a, c, t, g, unknown or other
  misc_feature (391)..(391): n is a, c, g, or t
  modified_base (488)..(488): a, c, t, g, unknown or other
  misc_feature (488)..(488): n is a, c, g, or t
  modified_base (501)..(501): a, c, t, g, unknown or other
  misc_feature (501)..(501): n is a, c, g, or t
  modified_base (515)..(515): a, c, t, g, unknown or other
  misc_feature (515)..(515): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggagtttggctgagttgggttttccttgctgcttaattttaaaaggtgtccagtgtgaggtgtacttggtggagtctggaggaggcttgacccgaggccggggggtcctgagactctccgtgtgcagcctcgtgggttcaggtcgtacaagtaaaccaaccgacgtgagtcgtacgggtcccgccgagccctaccgaaggggaacgggctaggaagtcgggtctacgtagttacttaagaaacgtgagtggtanaacactaagtctaccgaccgtacgtcggtagaacgggcctagttaccacctactccacgaagacaactaaacttccgaaaagtaacgtacgggtaanaacttaccgtaanaaaagttcgaaacncgtacctagaacgaaccgacggaccgtaaccggtccgtaattacgttaagttagtaagttacggttaagtcgggtaagttaacgttcccgggacccgtgggaacccgtaggggtaacccgtgtacccaccgttctacccgtacgacgtcccgtaaccgtaacccgg

SEQ ID NO: 137102 - DNA, 851 bp, Homo sapiens
  misc_feature: GYAE6OF02IPMAF.16.39.D06.1.454.CMB.1.raw
  modified_base (253)..(253): a, c, t, g, unknown or other
  misc_feature (253)..(253): n is a, c, g, or t
  modified_base (269)..(269): a, c, t, g, unknown or other
  misc_feature (269)..(269): n is a, c, g, or t
tcagtgtactactccacgaccggtgctcgatttagtgacatctcgcagttctttggggggtagaggagcccagcactgggattccgaggtgtttccattcggtgatcagcactgaacacagaggactcaccatggagttttggctgagttggtttccttgctgctatttaaagtgtctagtgtgaggtgtacttggtgagtctggaggaggcgttgacccaggccggggggtccctgagactctcctgtgacncgcctcgtagggttcngcgtcacgtaacaaccacgtcgagtggtacgggtccgccgacggtccctccgaaggggacgggggaccgtagggaaagtcgggtacctcgtaagtttagttaaggaaaaattgggaaattgggtagtaaccaaccgtaaataccgttaacccggaccgtaaccgttccggttacgggaaacggggtacccgtaacgtttacccgtaacccgtaacttacccgttcccgaaaacgtaacggtaaccttaaaaccgtttacccgaaaaagtaaacccgtacgggttaactaaacgttaccttaaaccgaaagttaaccgaaaccgtacgtaacccgtaagtaaaccgggaaaccggaacggaccgaaaccgggcctttaaagttacgttttaacttaaggtttaacgtaggttttaacggtaagggttacggttaaacggtttccccgggacccgggtttacgggggaaccccggttaagggggtaaaccctttcggggttaaccccgtaccccggttaaccggtttccccgtaccggttaacccggtcccccgttaaccccggtacccgggtaaaccccgggg

SEQ ID NO: 137103 - DNA, 851 bp, Homo sapiens
  misc_feature: GYAE6OF02JU158.16.39.D06.1.454.CMB.1.raw
tcagtgtactactccacgaccggtgctcgatttagtgacatctcgcagttctttgggttttggggagaggagcccagcactgggattccgaggtgtttccattcggtgatcagcactgaacacagaggactcaccatggtagttttggctggtaggtttgggtttttccttgctgtacttaagttttaaaaggtgtcctagtgtgtaggtgtacgttggtggagtcgtggaggaggtcgttcggacccgtagggcccgggggggttcctaggacgtacccgttccgtccgttggtacggaccgtacggtcccgttcggttcggggttaccgaacggtccgtacgtaacgttaaaccaacccgtacggtacgtaagttcgggtcgggtcccgaccgtaccgaccccggtacggaagggggtacggggtacgtagggtaagttcgggttacgtacgttaaggtttaagtaacgtaaaggttggtaggttcgggtacgaacctaacgtaaacgttaccgtaacccggccgtaccgttacggtaacgggtaaaccggtccgttaacgttacccgaacgtaccgtacccgtacgaacgtaactaaaccgtaaccgttaaccgaaaacggtaaccgtacgggtaacgtaaacttcctaaaacgtaatacgaacgacgtccgtaaagaaccgaaccggaagaaccgtccggttaataattagttacttagtaagttacggttaggttacgggtaagttaccggtccgggtacccggtaaggggacccgttaacgggtacgttaccggtacgttaccccgttgtaaccccgtctaaccggtaccctacccggtaaccgg

SEQ ID NO: 137104 - DNA, 699 bp, Homo sapiens
  misc_feature: GYAE6OF02HF4YT.16.39.D06.1.454.CMB.1.raw
  modified_base (175)..(175): a, c, t, g, unknown or other
  misc_feature (175)..(175): n is a, c, g, or t
  modified_base (357)..(357): a, c, t, g, unknown or other
  misc_feature (357)..(357): n is a, c, g, or t
  modified_base (362)..(362): a, c, t, g, unknown or other
  misc_feature (362)..(362): n is a, c, g, or t
  modified_base (364)..(364): a, c, t, g, unknown or other
  misc_feature (364)..(364): n is a, c, g, or t
  modified_base (470)..(470): a, c, t, g, unknown or other
  misc_feature (470)..(470): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttggtttccttgctgctatttaaaggtntccagtgtgaggtgtacttggtggagtcgtggaggaggtcttgacccgaggccggggggtccgtgaggactctcctgtgcacgctcgtggttcacgcggtcaagtaaccaccacgtgagtggtcggtccgcacgccgtccgagggaggggctaggattggtctcgtaagttatagaaagtgngtggnanaacatctacgcgtactccgtaggaacggacgtacttacaacactactccgaagaacgtaactaaactacctaaacggaacgtaacggtagtaaacttaccgttaanaaacgtacgaaacgtacgtacccgtaggaaaccgaaaccggtaacggaccggtaaccggtaccttaagtttaattacgtttaacgttaagttaacgggtttagtaacgggttacggttaaccggtcccggggtacccgtcgggggtaacgtaaccggggtaacgttacgggtaccctaccgggttccctaccgtaccgtacccggaccttccccgaaacggtacccggg

SEQ ID NO: 137105 - DNA, 777 bp, Homo sapiens
  misc_feature: GYAE6OF02HQ9EJ.16.39.D06.1.454.CMB.1.raw
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctaattttaaaggtgtccagtgtgaggtgtacgttggtggagtcgtgggagggaggtccttggaaccccgagggcccgggggggtccctggacgacctctccgtgtgcagtcctcgtgggtcagcgtacaagtaaccaaccgcgtagagtggtcgggtccaccgacgtccctcggaaggggacgggtcgtaggagtcggggtctacgttaagtttacgtaagtaaaagttggtaaggttcgggtacgaacctaacgtaacttccgtacggcccgtacgtccggtaggaacgggtccgtaacttaccaccgtactccgtacggaagacgtaaacctaaacgttaccgaaaggtaaaccgtacgggtaactaacttaccgttaacaaaacggttacgaaacgtacgtaccgtaagggaaaccgaaccgggaggaaaccgtaccgggtaacctaattaacggtttaagttacgtaaaggtttaggttagtttacggggttaacggttaccgggttcccgggtaccccgggtacgggggaacccgtaacggggtaaccgttgggtaccctaccggtccttacccgcgtaaccgtccccgtacccgtaaccgg

SEQ ID NO: 137106 - DNA, 613 bp, Homo sapiens
  misc_feature: GYAE6OF02HWFHB.16.39.D06.1.454.CMB.1.raw
  modified_base (367)..(367): a, c, t, g, unknown or other
  misc_feature (367)..(367): n is a, c, g, or t
  modified_base (464)..(464): a, c, t, g, unknown or other
  misc_feature (464)..(464): n is a, c, g, or t
tcagtgtactactccacgaccggtgctcgatttagtgacatctcgcagttctttgggttttgggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccgaggccgggggggtccctgagactctcctgtgcagcctcgtggttcagcgtcagtaacaaccacgtgatggtgggtccgccagcctccgagggaaggggctggaagtgggtctcgtagttattagaaatgtatggtnacacatctacgccgactccgtgaggccgatcaccatcctcagacgaactaacttaccaacgaaccgtaacggtagaacttacttaacaaatacgaanacgtaccctagaacgaaccggaggaaccgaccggaccgtatattattagttagtagttagtggtggttagttccgggacccgtggggacccgagggtacccgtggtaccgtaccggtctcccgttcgaccgtcccgtaccgtaacccgg

SEQ ID NO: 137107 - DNA, 539 bp, Homo sapiens
  misc_feature: GYAE6OF02GHUTM.16.39.D06.1.454.CMB.1.raw
  modified_base (363)..(363): a, c, t, g, unknown or other
  misc_feature (363)..(363): n is a, c, g, or t
  modified_base (403)..(403): a, c, t, g, unknown or other
  misc_feature (403)..(403): n is a, c, g, or t
  modified_base (423)..(423): a, c, t, g, unknown or other
  misc_feature (423)..(423): n is a, c, g, or t
  modified_base (426)..(426): a, c, t, g, unknown or other
  misc_feature (426)..(426): n is a, c, g, or t
  modified_base (432)..(432): a, c, t, g, unknown or other
  misc_feature (432)..(432): n is a, c, g, or t
  modified_base (440)..(441): a, c, t, g, unknown or other
  misc_feature (440)..(441): n is a, c, g, or t
  modified_base (464)..(464): a, c, t, g, unknown or other
  misc_feature (464)..(464): n is a, c, g, or t
  modified_base (525)..(525): a, c, t, g, unknown or other
  misc_feature (525)..(525): n is a, c, g, or t
  modified_base (531)..(531): a, c, t, g, unknown or other
  misc_feature (531)..(531): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccgaggccgggggggtccctggagactctcctgtgcagcctcgtggtcagcgtcagtaacaaccacgtgatgtgggtccgccagccctccgaggggaggggctgggagtgggtctcgtagttatagaaatgatggngacacaatctacgccgactcgtgaacggcatcactactcncagacgacaatccaaagacnganatctanaatgaacnnctagacgacgagacacggctatnttatgtaatgttatggtagtatccggccgtgggaccgagggtaccgtgtccacgtctccgncgtccnccgaacgg

SEQ ID NO: 137108 - DNA, 776 bp, Homo sapiens
  misc_feature: GYAE6OF02J0GAT.16.39.D06.1.454.CMB.1.raw
  modified_base (530)..(530): a, c, t, g, unknown or other
  misc_feature (530)..(530): n is a, c, g, or t
tcagtgtactactccacgaccggtgctcgatttagtgacatctcgcagttctttggggggagaggagcccagcactgggattccgaggttgtttccattcggtgatcagcactgaacacagaggactcaccatggtagtttgctgagttgggttttccttgctgtcttaatttaaaggtgtcctagtgtgaggtgtacgttggtggagtcgtgggaggaggtcgttcgacccgacgggcccgggggggttcctcggacgtacttcgtccgtggtgccgacgtccgtcggttacgggttcacggtccgtacgaacgttaaaccaaccgtacgtaggagttggttccgggaccgtccgacgtcccggtaccggaagggggtaacgggcgtaggaagttcgggtactacgtaaggtttaacgtaagtaaaacgttggtaagttcgggaacgaacctaacgactttaccggaccgtacccgtaacgttccccggtagggaaaccggtccgtaacttccgaacctctacccgtanacgaagtacctaaacgttaccgaaacgtaaacgaccggttaaataaaccttctaaactaagaacgtaaccgacgtaccccggtaagacccggtaaaacggacggaaaccggtcgtaaccgttacggttaattacgttacgttaagtacggttagtagggtacgttaacgtcccgggtcgtacggggaaccgtaccggtacgtacgtaccgtacctcgtccaccgccgtccctaccgcgtaacccgg

SEQ ID NO: 137109 - DNA, 665 bp, Homo sapiens
  misc_feature: GYAE6OF02IKCCV.16.39.D06.1.454.CMB.1.raw
  modified_base (308)..(308): a, c, t, g, unknown or other
  misc_feature (308)..(308): n is a, c, g, or t
  modified_base (499)..(499): a, c, t, g, unknown or other
  misc_feature (499)..(499): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctatttaaaaggtgtccagtgtgaggtgtactggtggagtcgtggaggaggtcttggacccaggccgggggggtccctaggagacctcgtctgtcgcacgtcctcgtggtcgagcgtcagtaacaccacgtgatggtcggtccnccgagccctccgagggacgggcgtaggaagtggtccgtacgtagtttataagtaaacgtagagtggtagactacgaaatcgtacgtccgtacgtccgtaggaacggtcgtacttaccacgtactcgtaccgacgaaggtaccaaacttaccgaaacgtacaacggtagacttacttacaaaactagaaacncgtactaacggaacgtaaccgaaccgggacaaccggtaacctataattagttacgtaagtggttagacggttgttaaccgtccgggtacccgtggggccgtaacgggtaccgtcggttacgacccgttcgtccgtcgaccgtccccggtacaacccggtaacccgg

SEQ ID NO: 137110 - DNA, 338 bp, Homo sapiens
  misc_feature: GYAE6OF02HIG6M.16.39.D06.1.454.CMB.1.raw
  modified_base (291)..(291): a, c, t, g, unknown or other
  misc_feature (291)..(291): n is a, c, g, or t
  modified_base (295)..(295): a, c, t, g, unknown or other
  misc_feature (295)..(295): n is a, c, g, or t
  modified_base (302)..(302): a, c, t, g, unknown or other
  misc_feature (302)..(302): n is a, c, g, or t
  modified_base (322)..(338): a, c, t, g, unknown or other
  misc_feature (322)..(338): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccgaggccgggggggtccctggagactctcctgtgcagcctctggttcagcgtcagtaacaaccacgtnatgngggtccncagcctccgagggaacgggnnnnnnnnnnnnnnnnn

SEQ ID NO: 137111 - DNA, 689 bp, Homo sapiens
  misc_feature: GYAE6OF02IX0UC.16.39.D06.1.454.CMB.1.raw
tcagtgtactactccacgaccggtgctcgatttagtgacatctcgcagttctttgggggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccgaggcccggggggggtccctgagactcctcctgtgcagcctcgtggttcagcgtcagtaacaaccacgtgatggtggtccgccagccctacggaggggaagggctaggaagtgggtctcgtagtttatagaaaatgatggtagacaacaatcgtaaccgccgtactacggtacgaacggccgtattccactacgtactacaagacgaactaactaccgaaagaacgtacggtacaaattctaactaaatacgaactacggtacctaggaacgaaaccggacggaacgaaccggtaccgttaattaagttacgttagtaacgtttaaggttacggttgggtaagttaacgttcccgggtcccggttacgggggaaccggtaacggggttaacccggtccggttaccgtacccggttacctccggttacccgacgtaccccgttacccgaacccggtaaacccggg

SEQ ID NO: 137112 - DNA, 603 bp, Homo sapiens
  misc_feature: GYAE6OF02GDA57.16.39.D06.1.454.CMB.1.raw
  modified_base (300)..(300): a, c, t, g, unknown or other
  misc_feature (300)..(300): n is a, c, g, or t
  modified_base (440)..(440): a, c, t, g, unknown or other
  misc_feature (440)..(440): n is a, c, g, or t
  modified_base (463)..(463): a, c, t, g, unknown or other
  misc_feature (463)..(463): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccaggccgggggggtccctgagactctcctgtgcagcctctgggttcagcgtcagtaacaacacgtgatgtgggtccnccagcctccgaggggaagggctggaatgggtctgagttattgaaaatgatggtgacacaatctacgccgtactccgtagaacgggccgtaattccacctatcctccagacgaccaatttaccgaaagtaaccgacggtanaacttcttaccaaagtcgaaacngcctagacgaaccgaggacacggtacgtatagttattgtattagtagtggtagttaacgttcggacccgtgggcccgacgggtaaccgtggttaccgacccgttctcccgtacgacgtccccgtacccgacgtaacccgg

SEQ ID NO: 137113 - DNA, 852 bp, Homo sapiens
  misc_feature: GYAE6OF02I8GVT.16.39.D06.1.454.CMB.1.raw
tcagtgtactactccacgaccggtgctcgatttagtgacatctcgcagttctttggggggaggaggagcccagcactgggattccgaggtgtttccattcggtgatcagcactgaacacagaggactcaccatggagttttggctgagttgggttttccttgctgctattttaaaaggtgtcagtgtgaggtgtacttggtggagtctggaggaggtcttgacccaggccgggggggtccctggacgtactcctcctgtgcgagtcctcgtgggttcagcgttcgaacgtaacctaaaccgacgtaggacttggtcggggttcccgccgacgcccgtaccggaagggggaaggggcgtggtaaggtcgggtacctcgtaagtttacgttaaggaaaacgttgacgttgggtacgtaacctaacaaacgtctaaaccgacccgtaccggttaccggtagggtaaaccgggacccggtaacttaccgaacccgtactaccgtacccgtaagtaaccggaactaaacgttaccaaagaaaccgtaacggtacgtaaacgttaccttaaccgaaacttaacggaacctacggtaccctaacggtaaccggaaaacccggtaaggggtaaccctaacccggggaacggtttaacgtttaaacgttaaggttttacgttaaacgtttaaacgggttttaaggttaacgggtttacggggtttaaacgtttcccgggggtacccccgtaggggggtaaccccggtaacggggtaacccggttaccgggttaccggttaacccgtttcccggtaacccgtttccgacggtaccccccttaccgaaccccggtaacccggg

SEQ ID NO: 137114 - DNA, 553 bp, Homo sapiens
  misc_feature: GYAE6OF02G35OU.16.39.D06.1.454.CMB.1.raw
  modified_base (306)..(306): a, c, t, g, unknown or other
  misc_feature (306)..(306): n is a, c, g, or t
  modified_base (370)..(370): a, c, t, g, unknown or other
  misc_feature (370)..(370): n is a, c, g, or t
  modified_base (388)..(388): a, c, t, g, unknown or other
  misc_feature (388)..(388): n is a, c, g, or t
  modified_base (411)..(411): a, c, t, g, unknown or other
  misc_feature (411)..(411): n is a, c, g, or t
  modified_base (431)..(431): a, c, t, g, unknown or other
  misc_feature (431)..(431): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccaggccgggggggtccctgagactctcctgtgcagcctctgggttcagcgtcagtaacaaccacgtgatgtgggtccnccagcctcgaggggaagggctgggaatgggtctcgtagtttatagaaaatgaagtggtagacanaatctacgccgactccgngaaggccgatcacatctccaganactaattccaaagacacggnaactctacaaatgaacagctagacgaacgagaccacggcgtatattattgaatagttagtgtagtatccgggccgtgggccagggtacctggtacaccgtctccgtcacgtcctacaaccgg

SEQ ID NO: 137115 - DNA, 911 bp, Homo sapiens
  misc_feature: GYAE6OF02H3QF8.16.39.D06.1.454.CMB.1.raw
  modified_base (276)..(276): a, c, t, g, unknown or other
  misc_feature (276)..(276): n is a, c, g, or t
  modified_base (469)..(469): a, c, t, g, unknown or other
  misc_feature (469)..(469): n is a, c, g, or t
tcagtgtactactccacgaccggtgctcgattttagtgacatctcgcagttctttgggttttggggagaggagcccagcactgggattccgaggtgtttccattcggtgatcagcactgaacacagagactcacatggtagttttggctgagtttgggtttccttgctgctatttaaagtgtcagtgtgacgtgtacttggtgagtctggaggaggtcttgacccaggccggggggtcctgagactctcctgtgacagcctgtgggttacagcgtnagtaacaaccagtacgatggtacggtccgacaagcccgtaccgaggggaaacggggtccgtagggtaaagttcggggtcgtacctaagggtttaacttagaaaaaacgttggtacgtgggttacggaaccaaactaattacgtaaccgccggtaacctccggttaaggaacggggtccgtaattccaaacgtntttacctaccgtaaagaccggtaaactaaaacgttacccgaaaaggaacccgtaaacggggtaacgttaaaccgttccctttaaaaccctaaaaggtaaccgaaaacgttaacccggtaaccgttacgggtaaaacggaaaaacccccggtaaggggtaaacccgtaaacccgggttacccgggttaaagttaaaaccgtttaaacgtttttacgggttttaaaaagtttaaacgggttttaacgggttcggggtttaaacgggtttaaacggggtttaccccgggtaacccccggggttaaccggggggtaaaccggtaacccggggggttaaaacccggggtttccggttaaaccccgggttacccccggtttaacggtttacccccccgtttacgggtaaaccccggaccccccgtttaacccgggaaaaccccccggg

SEQ ID NO: 137116 - DNA, 750 bp, Homo sapiens
  misc_feature: GYAE6OF02HA3BB.16.39.D06.1.454.CMB.1.raw
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctattttaaaggtgtccagtgtgaggtgtacttggtggagtctggaggaggcttgacccaggccggggggtccctgacgactctcctgtgcagcctctgggttcagcgtcagtaacaaccgacgtgatggtggtccgccagcctacgagggaaggggctggaagtgggtctcgagtttacttagaaaatgactggtgacactaatcctaacgccgaactccggaggaacgggccgattccaacctactcctacccgaagacgtacctaaagtttaccgaaacggtaaccgaccggttagtaaacgttcctttaacgaaaacgttacggaaacctagaccccgttaaggaacccgaaacccggtacgggaaacccacccggggtaaccgttaagttaacgttttaacgtttacgttaaagtttaagggtttattagggggttaacggtttaacgttccccgggggtaccccgttagggggggtcccgaacgggggttaaacccgtttcgggtaacccgttacccggtttacccttaccggttacccgtaaccggtacccccgttaccgaaccccggtaaacccgggg

SEQ ID NO: 137117 - DNA, 651 bp, Homo sapiens
  misc_feature: GYAE6OF02I6OJ4.16.39.D06.1.454.CMB.1.raw
  modified_base (284)..(284): a, c, t, g, unknown or other
  misc_feature (284)..(284): n is a, c, g, or t
  modified_base (449)..(449): a, c, t, g, unknown or other
  misc_feature (449)..(449): n is a, c, g, or t
  modified_base (484)..(484): a, c, t, g, unknown or other
  misc_feature (484)..(484): n is a, c, g, or t
  modified_base (495)..(495): a, c, t, g, unknown or other
  misc_feature (495)..(495): n is a, c, g, or t
  modified_base (633)..(633): a, c, t, g, unknown or other
  misc_feature (633)..(633): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgcttattttaaaaggtgtccagtgtgaggtgtacttggtggagtctggaggaggcttcgacccaggccgggggggtccctgagactctcctgtgcacgcctcgtgggttcagcgtnacgtaaccaccacgtgatggtcgggtccgccgacgccgtacccggtaggggacggggcgtaggggaacgtggggtctcgtagtttacgttaggaaaagttgtagtgggtagaacgtacaagtccgtacgccgtacgtcggtaggaacgggccgtactacgacctntactacgagacgactataccgaagacgtacggtanactccgttaanaagtagactacgcgttacgacgtaaccggaggtaccacggtaccgtattacgttagtacgtgtaaggtgtggttacgacgttccggaccggtcgggtacctacggggaacgttcggtaccgccgttccgtaccgccgngtccccgtacgaacccgg

SEQ ID NO: 137118 - DNA, 713 bp, Homo sapiens
  misc_feature: GYAE6OF02HZGCW.16.39.D06.1.454.CMB.1.raw
  modified_base (313)..(313): a, c, t, g, unknown or other
  misc_feature (313)..(313): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgtagttggttttcctgctgctatttaaagtgtccagtgtgaggtgtacgtggtgagtcgtggaggaggtcttgacccgaggccgggggtccctgagtactcgtccgtgtcgcgagtccgtcgtggttcagcgtcagtaacaaccgtacgtgatggtcgggtccncctagcccctacgaggggaacgggctaggaagtcggtctcgtagttacgtagtaaaagtgtaggtggtagaaccacgtaaacgtcgtaccgaccgtacgtccggtaaggaacgggtcccgtatacccgacgtactaccgacccgtaagacgtaacctaaagttaccccgaaaggtaaccggtacggtagtaaacgttccgtaaacaaagttacgtaaacgacgtaccgtaacggaacgaaccggtaaggaacccgtacggtacctaagttagtttaagttagttaacgtaggttagtgggttagttaccggttccggtaccccggtgggtaccgaacggggtaaccgttcggtaccgtcccggtcgttacccgtaccgctacccgtacccgtaacccggg

SEQ ID NO: 137119 - DNA, 729 bp, Homo sapiens
  misc_feature: GYAE6OF02IMFCB.16.39.D06.1.454.CMB.1.raw
  modified_base (256)..(256): a, c, t, g, unknown or other
  misc_feature (256)..(256): n is a, c, g, or t
  modified_base (267)..(267): a, c, t, g, unknown or other
  misc_feature (267)..(267): n is a, c, g, or t
  modified_base (272)..(272): a, c, t, g, unknown or other
  misc_feature (272)..(272): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctattttaaaaggtgtcagtgtgaggtgtacttggtggagtctggaggaggcttgacccaggcccggggggtccctgagactctcctgtgcngcctgtggtcngcgtnagtaacaacctacgtgtagtggtcgggtccgccgacgtcccgtacggaacgggggaagggggtcctagggtaaggttcggggttcctacgtaaggtttaattaagtaaaagttggtaagtagggtacgaacaactaaactaccgtaccgcccgtactaccggtaggaacgggtcccgtaattaccaacctacttcctaccgacgaacgtaacctaaacttacccgaaaagaaaccgtacggtaagtaacttacttaaactaaagtacgaaaccaacgccgtagaaaccgtaacccgaagggaccgaaccggtacttaagttatttagttacgttaagttaaggttagtaggttacggttacgttccgggacccggttaggggacccggtaacgggtaccgttcggtacccgtacccgttccgtacctccgaccgtccctacccgaaccgtacccggg

SEQ ID NO: 137120 - DNA, 589 bp, Homo sapiens
  misc_feature: GYAE6OF02FQU2C.16.39.D06.1.454.CMB.1.raw
  modified_base (390)..(390): a, c, t, g, unknown or other
  misc_feature (390)..(390): n is a, c, g, or t
  modified_base (413)..(413): a, c, t, g, unknown or other
  misc_feature (413)..(413): n is a, c, g, or t
  modified_base (425)..(425): a, c, t, g, unknown or other
  misc_feature (425)..(425): n is a, c, g, or t
  modified_base (429)..(429): a, c, t, g, unknown or other
  misc_feature (429)..(429): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctattttaaaggtgtccagtgtgaggtgtacttggtggagtctggaggaggcttgacccaggcccgggggggtccctgagactctcctgtgcagcctcgtgggtcagcgtcagtaacaaccacgtgatgtggtccgccagcctcgagggaggggctggatgggtctaagttatagaaatgatggtgacacaatctacgcgactccgtgacgggccgattcacatcnccagagacaatccaagacacgtnaactctacaatnaacngacctagacgaacgagacgacgccgtatacgttattagtagttagttagtggtaggttaacgttccgggtacccgtggggtacccgtaaggggtaacccgttgggtaccgacccggttctcccgttacgaccgtcccgtacccgaccgacgggtaccccg

SEQ ID NO: 137121 - DNA, 685 bp, Homo sapiens
  misc_feature: GYAE6OF02IJM5H.16.39.D06.1.454.CMB.1.raw
  modified_base (224)..(224): a, c, t, g, unknown or other
  misc_feature (224)..(224): n is a, c, g, or t
  modified_base (309)..(309): a, c, t, g, unknown or other
  misc_feature (309)..(309): n is a, c, g, or t
  modified_base (639)..(639): a, c, t, g, unknown or other
  misc_feature (639)..(639): n is a, c, g, or t
  modified_base (662)..(662): a, c, t, g, unknown or other
  misc_feature (662)..(662): n is a, c, g, or t
tcagtgtactactccacgaccggtgctcgatttagtgacatctcgcagttctttgggttttggggaggaggagcccagcactgggattccgaggtgtttccattcggtgatcagcactgaacacagaggactcaccatggtagttttggctgaggttgggttttccttgctgcttagttttaaaggtgtctagtgtgaggtgtacttggtggagtcgtggaggnggtcttgacccgaggccggggggtcctggagactcgtcctgtgctacgtcctcgtggtcacgcgttacgaagtaacaaccgcgtnagtggtcggccgtacgcgtcctcggaaggggaagggtctaggaactcggtcacttagtatagaaatgtagtggtagacaacgtataccgtacgcctaaccgtcggtacgaaacgggtctacctacgcctacgcctaccgtagaacggtaaccttaaggttaaccccgtaaaggaaaccgttaacggtaacgtaacttaccggtaaactaacgttaaacgaaccaacggttaccgtacgaaaggtaccgaacgtacgacgggtacctaaagttacgttaattacggaattcggtaattaggacggttacgtacggtcccgtagggtaccgnggtaacctcgggctaccgtccgngttaccacgcccgtctaaccggg

SEQ ID NO: 137122 - DNA, 546 bp, Homo sapiens
  misc_feature: GYAE6OF02FU1FM.16.39.D06.1.454.CMB.1.raw
  modified_base (305)..(305): a, c, t, g, unknown or other
  misc_feature (305)..(305): n is a, c, g, or t
  modified_base (358)..(358): a, c, t, g, unknown or other
  misc_feature (358)..(358): n is a, c, g, or t
  modified_base (427)..(427): a, c, t, g, unknown or other
  misc_feature (427)..(427): n is a, c, g, or t
  modified_base (443)..(443): a, c, t, g, unknown or other
  misc_feature (443)..(443): n is a, c, g, or t
  modified_base (527)..(527): a, c, t, g, unknown or other
  misc_feature (527)..(527): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccagccgggggggtccctgagactctcctgtgcagcctctgggttcagcgtcagtaacaaccacgtgatgtgggtccnccagcctccagggaagggctggaatgggtctcgagttattgaaaatgatggtnacacaatctacgccgactccgtgaacgggccattcaccatcctccgagagacaattccaagacacggtnaactctacaatgaacngacctgagaaccgaggacacggactatatatgtaatggttatggtgtagtccggccctgggccagggtacctggtccaccgtcncctcacgtccctccaaccg

SEQ ID NO: 137123 - DNA, 711 bp, Homo sapiens
  misc_feature: GYAE6OF02JFY28.16.39.D06.1.454.CMB.1.raw
  modified_base (288)..(288): a, c, t, g, unknown or other
  misc_feature (288)..(288): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccagccggggggtccctgagactctcctgtgcagcctcgtggttcagcgtcagtaacaaccacgtnatggtggtccgcagcctccgagggacgggctggaatgggtctcgtagttattagaaaagtgagtggagacacatactacgccgactcgtaggaacggtccgaattccgaacctactccgtcccaagtacgaacctaaacgttaccaaacgtaaacgacggtagtaaagttaccttactaaaacgtagaaacaacgtaccctacggaacgaaacccggtacggaaccgtaccgggtaaccgtaagtttaagttacgtttagttacgtttaaggtttaacgtaggttaagggttaaccgttacccgggggttacccggtccgggggtaaccggtaacccggggtaacggttaccggtcccgttaaccccgttccgttaccccgttacacccgggtcccgtaccccgtaacccggtaaccccgggg

SEQ ID NO: 137124 - DNA, 631 bp, Homo sapiens
  misc_feature: GYAE6OF02F182D.16.39.D06.1.454.CMB.1.raw
  modified_base (427)..(427): a, c, t, g, unknown or other
  misc_feature (427)..(427): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctgggaggaggcttgacccgaggccgggggggtccctgagactctcctgtgcagcctcgtgggttcagcgtcagtaaccaaccgacgtgatggtcgggtcccgccacgccctaccggaggggaacgggcgtaggaagtgggtctacgtagttaagttagaaaatgagtggtagacacatcgtacgccgactcgaggaacgggctacttcaccatcncagagactaataccaagactacggtataactctaacaaatacgaacacgccgtagacgtaaccgaggaccgacggtacctatagtttagttgtaacttaggttatgggttagttacggtcccggcccggttaggggacccgtacgggggtaccgttcggtacccgtccggttcctaccgtacgaccggtccctaccgaacccgg

SEQ ID NO: 137125 - DNA, 681 bp, Homo sapiens
  misc_feature: GYAE6OF02HF4BT.16.39.D06.1.454.CMB.1.raw
  modified_base (438)..(438): a, c, t, g, unknown or other
  misc_feature (438)..(438): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgcttattttaaaggtgtccagtgtgaggtgcagctgttggagtcgtgggggaggtcgttggtacagccgtcggggggtccctggagactctcctgtgcgtacctcgtggtacttccgtactttagcagtctatcgcctagtggacgtcgtcggggtcccgccgacggtccgtacccggaggggaacggggtccgtggggacggttcgggtacctacgtaacttagttaggtggttaggtgggtacggtaaccaactacgtacgtttccgnttcgaccgttccggagggtaccgggttccggtttctacccattcctccaggacacctacctaccgaaacgaaccgtacgggttattactcgtcgacgtaagtcgaccacgacggccgtaggacggaccgaccggtacggaccgaccggtacctaattacgtagttaccgtggtaacggaagaacgtactaccgtacccttacccccgtacgtacggtcgtaactggtaaccttaacgttaacc

SEQ ID NO: 137126 - DNA, 863 bp, Homo sapiens
  misc_feature: GYAE6OF02IBQM3.16.39.D06.1.454.CMB.1.raw
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttcctgctgctatttaaaagtgtccagtgtgaggtgtacttggtggtagtcgtggaggaggcgttgacccgaggccgggggggtccctggagtactcgtccttggtcgcacgtcccgttcgtcgggttcgacggtccgttccaagttaaccaaacccgacgtagtacgtggtcgggtaccccgccgtaaccggccccgtccgaaggggaacgggtcgtacggtaattcggggtactcgtaaggttaagttaggtaaaatggtaagtgggtacaacgaactaaacgtaccgtacgcccgtaacgtcccggttaggaaaccggggtacgtacgttaccgaaccctaagttccctaaccgtaacggtacgtaaaacgttaacccgtttaaacccgaaaaggtaaacccggtaaacggtacggtaaactttaacttaccgaaaaattaacggtaaccacggtaaccctagggtaaacccgaacccggaacgggaaccgacccgggtaacctttaaggtaaacttttaacgtttagttaaccggtttaaagggttaaccgttagggtttaaccgggttacgttacccggggtacccccgggggtacgtaaccgggaacccgggttaaaccggggtttccgtaacccggtacccggtcccttaacccggttaccgacccggttaccccccggttaacccaaaccccgggg

SEQ ID NO: 137127 - DNA, 960 bp, Homo sapiens
  misc_feature: GYAE6OF02GF19P.16.39.D06.1.454.CMB.1.raw
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgcttattttaaaaggtgtcctagtgtgaggtgtacttggtggtagtctgggaggaggcttcgacccgacgggtccccggggggggttccctaggacgaccgttccgtccgtggtcgccacggtcccgttcgttgggttccacgtccgtaccgaagttaaacccaaacccgaacggttacggtaagttcggttcggggttccccggacccctaacggtcccccgttacccggaacgggggaaacgggggtcctagggtaaacggtcggggtactaccggtaagtttaacgttaaggtaaaaagttggtaagttagggttacgaaaccgtaactaacgttaccgtaaccggacccgtaacccgttccggtaacgggtaaacgggtcccgttaacgttaccgtaacccgaatttacccgtacccgaacggtaacggtaaacctaaaccgtttaaaccgaaaacggtaaaccggtaaaccggttacggtaaaacttaccgtttaaaccgtaaaaacgtacgtaaaaccgtaccggtaaccgttaacggaaacggtaaacccggaacgggtaaacccgaaccgggtaacccgtttaaagtttacggttttaaacgttacgtttaaagtttaaaggtttaagttaacggggtttaacggggttaaaccggtttcccggggtccccggtaccgggggtaaccggtaacccggggtaaaccgggttcccggtaacccgttacccgttacccgttccggttaccgtaccggtacccccggttaccgaacccggttaaaccccgggg

SEQ ID NO: 137128 - DNA, 744 bp, Homo sapiens
  misc_feature: GYAE6OF02FKQ0Y.16.39.D06.1.454.CMB.1.raw
tcagtgtactactccacgaccggtgctcgatttagtgacatctcgcagttctttgggttttggggagaggagcccagcactgggattccgaggtgtttccattcggtgatcagcactgaacacagaggactcaccatggagtttggctgagttgggttttccttgctgctaatttaaaggtgtccagtgtgaggtgtacgttggtggagtctggaggaggcttggacccgagggccgggggggtccctgagactctctgtcgcagcctcgtggttcagcgtacacgtaaccaaccgacgtgagtggtcgggtcccgccgagcccgtccggaaggggacggggcgtaggaacgtgggtctacgtagttagttagtaaagtgagtggtagaacactaacgtcctacggtacccgtacgttccggtaggaaccgggtcctaacttcccgacctactcctacgagaacgtaactaacgtaccgaaaagtaaccgtaggtaacgtaaacttcctaaacgtaaacgtacgtaaactcggaccgtaagaaaccggtaaccgggaacgaaccggtaaccgggtacgttaagttaagtttaacgttagttaagtttaacgggtttagttagggttacggtttacgggtcccggggacccggttacggggacccgggttaaacgggtacccggttaccggtacccgtaccggttcccgtccgtaccggtcccgtacccgtacccgaaccccggg

SEQ ID NO: 137129 - DNA, 824 bp, Homo sapiens
  misc_feature: GYAE6OF02H5086.16.39.D06.1.454.CMB.1.raw
tcagtgtactactccacgaccggtgctcgatttagtgacatctcgcagttcttttgggttttgggggtagaggagcccagcactgggattccgaggtgtttccattcggtgatcagcactgaacacagaggactcaccatggtagttttggctgtaggttgggtttttccttgtctgtcttaattttaaaaggtgtcctagtgtgtaggtgtacgttggtggtagttcgtggaggacggcttgacccgagggcccggggggtccctggacgtactctcctgtcgcagtccgtcgttcggttcaggtcgtctaacggtaaacctaaccgacgtgagtcggtccggggtcccgccacggtccccgtaccggtaggggggaacggggtctacggggtaagttcggggttcctaacgttaggtttaactttaaggtaaaaagttggtaacggtggtacgaactacgtaaattacccgtaccgccggtaacccgttccgggtagggaaccgggtactaacgttcaacccgtaattccgtaccgtaaggaccgtaactaaaccgttaaccgaaaacggtaaccgaacgggtataaccgttactaaacgaagttaacgtaaccgagtaccgtacggaacgaacgggtacgaaccgtaccggtaccgtattaacgttagttacggttattaaggttacgttagggtaaggttaccgggttacccgggcccggtaacgggggtaccctaaccggggggtaacggttcccgggtaccttacccgggttcccgttaaccctccggttaacccggcccttaccccggaaacccggg

SEQ ID NO: 137130 - DNA, 594 bp, Homo sapiens
  misc_feature: GYAE6OF02F0UBP.16.39.D06.1.454.CMB.1.raw
  modified_base (365)..(365): a, c, t, g, unknown or other
  misc_feature (365)..(365): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccaggcccgggggggtccctgagactctcctgtgcagcctctggttcagcgtcagtaacaaccacgtgatggtgggtccgccagccctccaggggaaggggctagggaagtgggtctcgtatttaagttgaaaatgtatggtnacacaatctacgccgactccggtagaacgggcgtaacttcaacctacgtacctccaggaacgacaactttaccaaagaaccaacggtagaacttcttaacaaactagaaacacgctaggaacgaccgagacgacgaccgtatattattgtaataggttatgtagtacgtccggcccgtggggccaagggtaccgtggtcctacgtctctcacgtcctccacgtaaccgg

SEQ ID NO: 137131 - DNA, 734 bp, Homo sapiens
  misc_feature: GYAE6OF02GM6MS.16.39.D06.1.454.CMB.1.raw
tcagtgtactactccacgaccggtgctcgatttagtgacatctcgcaggtttcgtttgggttttggggagaggagcccagcactgggattccgaggtgtttccattcggtgatcagcactgaacacagaggactcaccatggagttttggctgagttgggttttccttgctgctaattttaaaaggtgtccagtgtggaggttgtacgttggtggagtctggaggagcttgacccaggccggggggtcctgagactctccgtgtgcagcctcgtgggttacagccgtacaagtaaccaaccgacgtgagttcggtcgggtcccgccagtccctaccggaaggggaacgggctaggaagtcggggtactcgtagtttaactaggaaaagtgtaagtggtagaacaacgtaagttcgtaaccggaccgtacgttaccggtaaggaaaccgggtcctaacttccgaacctacttaccgtaccgagaacgaacctaaacgttaccaaaggtaaaccgacggtaagtaacttaccttaacgaaagttacgaaactaacgtaccgtaaggaacgaaaccggacggaaccgaaccggtaccgttaattacgtttacgttagtaacgttaggttaagttgggttaacgttaacggttcccggggacccgtaggggaccgtaacggggtacccgtaggtacccgaccgttcctaccgtacgaccgttaccacccgtaacccgg

SEQ ID NO: 137132 - DNA, 892 bp, Homo sapiens
  misc_feature: GYAE6OF02GERX5.16.39.D06.1.454.CMB.1.raw
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctatttaaaggtgtccagtgtgaggtgtacttgggtggagtctggaggaggcttgacccgagggccggggggtccctggagactctccgtgtcgcacgtcctcgttcggggttcaggccgttcaaggtaaaccaaaccgacggtgtagtggtcggggtcccgccagcccgtccggagggggaacgggctgggaagtcgggtctacgtaggtttagttaagaaaagttggtaacgtgggttacgaaccgtaacgtaagttccgtaaccggtacccgtaacgttcccggtaagggaaaccggggtcccgttaacgtttacccgaacccgtactttaccgtaacccgaaggtaaacgtaaacccgtaaaagttttacccccgaaaaagggtaaaacctaaccggggttaacgtaaaacttttaaccccgtttaacgaaaaaagttaccgaaaccgtaaccgtcccgtaaggggaaaccggaaaacccggaacgggtaaacccggaacccgggtacccgttttaaagttaattttaggttttaacgttaaacggtttaaagggtttaacgtaggggttttaacggggttaaccggtttccccgggggtacccccggttaagggggggaccccttaaacggggggttaaaccccggttggggttaacccccaccgggtttcccgttaccgtaacccggttccgggaccccttaccccgaaaacccggg

SEQ ID NO: 137133 - DNA, 763 bp, Homo sapiens
  misc_feature: GYAE6OF02HDSWU.16.39.D06.1.454.CMB.1.raw
  modified_base (320)..(320): a, c, t, g, unknown or other
  misc_feature (320)..(320): n is a, c, g, or t
  modified_base (401)..(401): a, c, t, g, unknown or other
  misc_feature (401)..(401): n is a, c, g, or t
tcagtgtactactccacgaccggtgctcgatttagtgacatctcgcagttctttgggtttttggggagaggagcccagcactgggattccgaggtgtttccattcggtgatcagcactgaacacagaggactcaccatggagttttggctgagtttgggttttccttgctgcttattttaaaggtgtccagtgtgaggtgtacttggtggagttcgtggaggaggcgtttcggaccccgagggcccggggggggttccctggacgtacgtcctccgtgtgcagcctcgttggttcagcgtcaacgtaaccaaccgacgtnagtggtcgggtccgaccgagcccgtacggaggggaacgggcgtaggagtgggtctacgtagttataggaaatgagtggtanacaacgtactcgtaccgccgacgtccggtaggacgggcctacgttaccaaccgtactaccgtcgaagtacgaacctaaacgttaccgaaaacggtaaaccgtaaacgggtaactaacgttaccttaaagtaaaacgttacggtaaaccacggtaccgtacggaaaaccgtaaaccgggaacggaaccggtacccggtacttaaacgttattttaagttagggttaacgtttaagggttaagttaggggtttaaccggtaccgtttacccggggtacccggttggggacccgtaacgggggttacccgttcggttacccgtaccgttaccgtccgtaccgacggttcccacccggtaacccgg

SEQ ID NO: 137134 - DNA, 653 bp, Homo sapiens
  misc_feature: GYAE6OF02FRJJJ.16.39.D06.1.454.CMB.1.raw
  modified_base (297)..(297): a, c, t, g, unknown or other
  misc_feature (297)..(297): n is a, c, g, or t
tcagtgtactactccacgaccggtgctcgatttagtgacatctcgcagttctttgggggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccaggcccgggggggtcctggagactctcctgtgcagcctcgtgggttcagcgtcagtaacaaccacgtgatgngggtccgccagcctccgaggggagggctaggaatgggtctcagttattggaaaatgatggtgacacaatcctacgccgacgtcccgtggaacggtcccgaattccaacctatcccgtaccagtacgaacaatttacccgaaagtaaacaccggtagaacttactactaaaagtcgaaacacgtcctagaacgaacccgtagggaaccacgggtactaatattaattgtaattaggttaagttgggtacgttaacggttccgggaccccgttggggaccgtaacgggggtaccgtcgggttaccaacccggtccgttacccgtacgaccgtacccctaccgacccggtaaacccggg

SEQ ID NO: 137135 - DNA, 813 bp, Homo sapiens
  misc_feature: GYAE6OF02GL0E3.16.39.D06.1.454.CMB.1.raw
tcagtgtactactccacgaccggtgctcgatttagtgacatctcgcagttctttgggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccgaggcccgggggggtccctgagacgtcctcctggtgcgagcccgttcgtgggttcagcgtcaagttaacaaccacggtgatggttcgggtccgccgaagccctaccgaggggaacgggctaggaagtgggtactcgtagttattagaaaatgagtggtgacgataaatcgtaccgccgactcgtaggacggtcgtaacttccaccgatcctaccgagaacgtaacaaacctttaccgaagaaccgacggttaccgtaaatccgttaacgaaattacgaaaccgagtacctacgggtaacggaaacccggtaagggtaaacccgaccggggttacccgttaaacgtttaaagtttttaacggtttaacggtttaaggttttaaacgggttttaaggttagggggtttaaccggtttaaaggtttcccccggggtaaccccgggtttaacggggggtaccccgggtaaacgggggttaaccccgggttttaacggggttcccgtaaaccccgggtttccccgtttaccccgggtttaccgttacccccgggtaccccctttaaccccgggaaccccgttaaacccccggggg

SEQ ID NO: 137136 - DNA, 686 bp, Homo sapiens
  misc_feature: GYAE6OF02HKZO3.16.39.D06.1.454.CMB.1.raw
  modified_base (402)..(402): a, c, t, g, unknown or other
  misc_feature (402)..(402): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctattttaaaaggtgtccagtgtgaggtgtacgttggtggagtctgggaggaggcttgacccgaggccgggggggtccctgacgactctcctgtgcagcctcgtgggttcagcgtcagtaaccaaccacgtgatgtcgggtccgcagccctcgaggggaacgggcgtggaagttgggtctcgtagttattagaaaagtgaatgggtagactacaacgtcgtaccgccgacttcccggnggaacgggctattcgaccatccgtccaagacaactaacgtccaaagtacgaacggtgtaatacgttaacaaagactaaacaggacctaggaaccgaaccgacggaccgaaccggtaccttagtaatttacgtagtaagttacgggttattagggttacgggttaacgttcccggggtacccgttcgggggccggtaacggggtaacccggttcgggtacccgtaacccggttccttacccggtacccgtaccggtaccccgtacccgtaaacccggtacccggg

SEQ ID NO: 137137 - DNA, 958 bp, Homo sapiens
  misc_feature: GYAE6OF02JYGCH.16.39.D06.1.454.CMB.1.raw
  modified_base (216)..(216): a, c, t, g, unknown or other
  misc_feature (216)..(216): n is a, c, g, or t
  modified_base (350)..(350): a, c, t, g, unknown or other
  misc_feature (350)..(350): n is a, c, g, or t
  modified_base (658)..(658): a, c, t, g, unknown or other
  misc_feature (658)..(658): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctattttaaaggtgtccagtgtgagtgtacttggtggagtcgtggaggaggnttcgaccgacgggccgggggggggttcccctaggacgtaccttcctccgttacggtgacgacgtccgttcgttcggggtttcacggtcgtcaagttaaaccaaccgtacggtagacgttgggttcgggtacccnccgacgtaccccgaccgggaagggggaacgggtcggtaggtaagttcggggttacctacgtaagtttaagtttaaggaaaaagtcggttaagtcgggttacaaaccgtaactaagttaacccgttaaccggcccggttaaccgtttacccgggaaggtaaccgggtacccgtattaaccccgtaaccctacgtaccgtacccgaagggtaaccgtaaaccggttaaacttaacccgtaaaacggaaaccgttaacgggtaacggtttaaactttaacccggttaactaaaaacgttaacgaaaccggnggttaaccccaaggaaacccgggaaaaccggaaaccgggaacccggttaaaccggtaaacccggtttaactttaaagggttttacgtttaaaggttaccggttttaaagggtttacggtttaacgggggtttacgttaaaaccccgggtttccggggaaccccgggttaccgggggtaacccggtaaaccgggggttaccggttaaccccgggttacccgttaaccccggttcccgtttaacccggttaaccccgacgggttaaccccgttaaccccggaacccgggttaacccccgggg

SEQ ID NO: 137138 - DNA, 700 bp, Homo sapiens
  misc_feature: GYAE6OF02GTX64.16.39.D06.1.454.CMB.1.raw
  modified_base (394)..(394): a, c, t, g, unknown or other
  misc_feature (394)..(394): n is a, c, g, or t
  modified_base (401)..(401): a, c, t, g, unknown or other
  misc_feature (401)..(401): n is a, c, g, or t
  modified_base (462)..(462): a, c, t, g, unknown or other
  misc_feature (462)..(462): n is a, c, g, or t
  modified_base (650)..(650): a, c, t, g, unknown or other
  misc_feature (650)..(650): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctgggaggaggcgttcgacccgagggccggggggtccctggacgactctcctgtgcacgcctcgtcggttcagtcgtcaacggtaacaaacccgtacgtgagttggtcggggtccgccacgccctccggaggggaggggccgtaggaagtcgggtctcgagtttataagtaaagtgatggtagacaanatcgacnccgactcggaggacggctactcaccagtcaccagacgaactactacgaaagacgacggtanaacttactaacaaagtacgaaacgcgacctaggaacaacggacggaccgtacggaccgttaattagtttagtagtttaagtagggtttagttagggttacgggttaaaccgtttccccggggtacccgtacggggggacccggttaaacggggtaaccccggttagggttaccccgaccgtttacccncccggtttaaccgaccgtccccgttaccccgaacccgggtaaaccccggg

SEQ ID NO: 137139 - DNA, 646 bp, Homo sapiens
  misc_feature: GYAE6OF02H6ZAA.16.39.D06.1.454.CMB.1.raw
  modified_base (306)..(306): a, c, t, g, unknown or other
  misc_feature (306)..(306): n is a, c, g, or t
  modified_base (389)..(389): a, c, t, g, unknown or other
  misc_feature (389)..(389): n is a, c, g, or t
  modified_base (610)..(610): a, c, t, g, unknown or other
  misc_feature (610)..(610): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctatttaaaaggtgtccagtgtgaggtgtacgttggtggagtctggaggaggcttgacccaggccgggggggtccctggagactctcctgtgcagcctcgtgggttcagcgtcaagtaacaaccacgtgattggtgggtccnccagcctaccgagggaaggggctggaagtgggtctcgtagtttatagaaaatgagtggtagacaacactctacgccgactcgnggaacggcgatcacctatcctccaagacaacaattaccaaaggaacaggtagaattacgttacaaagtacgaacacgacgtagaacggtaaccgaaggacgaaccggtaccgtaatagttaagttgtaagttggttaagttgggtacgtaagtttccggggaccccgttaggggaccctaacggggtaccggtacggttacccgtaacccggttcttaccncccgttacgccccgttaccccgacgtaaccccgggg

SEQ ID NO: 137140 - DNA, 1008 bp, Homo sapiens
  misc_feature: GYAE6OF02G7C5B.16.39.D06.1.454.CMB.1.raw
  modified_base (182)..(182): a, c, t, g, unknown or other
  misc_feature (182)..(182): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggagtttggctgagttgggttttccttgctgcttatttaaaggtntccagtgtgaggtgtacgttggtgagtctgggaggaggtcttggaccccgagggcccggggggtccctggacgacctctccgtgtacgcgacgtcccgttcggtcggggtttaccacggtccgttaccgaaacggttaaacccaaacccgtacggttagagttcggtccggggtcccaccgacgcccgtaccggaagggggtaacgggtcgtagggtaacgtcggggtctacgttaaggttaattaaggtaaaagttggtaagttacgggtacgttaaaccgaacttaaacgttacccgtaaccggtaccccggttaaccgttacccgggtaacggggaaacccgggggttacccttaacggtttaccccaaacccggtaccgttttaccccgtacccgggaaacgggtaaccgtaaaacccgttaaaaccgtttaaccccggaaaaacggttaaacccggttaaaccggggttaacgttaaaaccttttaacccggttaaaccttaaaaacgggttaaccgtaaaacccgtaaccggaccccgtttaaagggaaaacccgggaaacccgggtaacggaaaccccggtaccgggttaaacccggtttaaactttaacggtttttaacgtttaccggtttaaaggtttaacgggttttacgggttaagggggtttaacccggtttaacggggtttccccccggggttaccccgggtaaggggggtttaaccccggaaacgggggtttccccggttacggggttaaccccttaacccgggttcccttacccgtacccgggaaccttccccgtaacccggaaccccggg

SEQ ID NO: 137141 - DNA, 605 bp, Homo sapiens
  misc_feature: GYAE6OF02F1SYI.16.39.D06.1.454.CMB.1.raw
  modified_base (416)..(416): a, c, t, g, unknown or other
  misc_feature (416)..(416): n is a, c, g, or t
  modified_base (465)..(465): a, c, t, g, unknown or other
  misc_feature (465)..(465): n is a, c, g, or t
tcagtgtactactccacgaccggtgctcgatttagtgacatctcgcagttctttgggggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctgggaggaggcttgacccaggcccgggggggtcctgagactctcctgtgcagtcctcgtgggttcagcgtcagtaacaaccacgtgatgtcgggtccgccagccctccgaggggaaggggctggaagtgggtctctagttattagaaaatgagtggtgacacaatcctacgccgtactccggtaggaacgggccaattcacctactcnccagacgaacaattaccaagaacaggtcaatcttaaccaaagtcgaacngcctagaacgacgaggacacggactatacttattgtattaggtatgggtagttagttccgggcccgtggggtaccgacgggtaaccgtcggtacctacccgtcgtcccctcgccgtaccctacccgaccggtaacccggg

SEQ ID NO: 137142 - DNA, 624 bp, Homo sapiens
  misc_feature: GYAE6OF02FTZ07.16.39.D06.1.454.CMB.1.raw
  modified_base (369)..(369): a, c, t, g, unknown or other
  misc_feature (369)..(369): n is a, c, g, or t
  modified_base (416)..(416): a, c, t, g, unknown or other
  misc_feature (416)..(416): n is a, c, g, or t
  modified_base (448)..(448): a, c, t, g, unknown or other
  misc_feature (448)..(448): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaggtgtccagtgtgaggtgtacttggtggagtctggaggaggcttgaccccgaggccgggggggtccctggaggactctcctgtgcagcctcgtgggttcagcgtcagtaacaaccacgtgatggtgggtccgccagccctccgaggggagggcgtaggagtgggtctacgagttattagaaatgagtggngacacaactctacgccgactcggtagaacgggcctattccacactcnccagacgactaactaccgaagtaaccacggtntaactctacaaagtcgaacagacctagacgaacgtacggacgaccgggaccgtaattagttagttagtaagtaggttagtagggttagttacggttcccgggtcccggtcggggaccgtaacggggtaccgttcggtccgtaccgtcctcccgtacgacgtccctaccgaacccgg

SEQ ID NO: 137143 - DNA, 859 bp, Homo sapiens
  misc_feature: GYAE6OF02JD5HX.16.39.D06.1.454.CMB.1.raw
tcagtgtactactccacgaccggtgctcgatttagtgacatctcgcagttctttgggttttggggagaggagcccagcactgggattccgaggtgtttccattcggtgatcagcactgaacacagaggactcaccatggtagtttggctgagttgggttttccttgctgctatttaaaggtgtccagttgtgaggtgtacttggtggagtctgggagaggtcttcgacccaggcccgggggggtccctggacgtacctctccgtgtcgcacgccgtcgtggggttcagtcgtagacgtaaccaccacgtgagttcggtcgggtcccgaccgcggccccgttaccggaaggggtaacgggggtcctaggggtaaacgtcgggggttccttaccgttaaagggtttaattaacggaaaattagggtaagttgggggttaacaaccgtaaacgttaaacgttaccgttaacccggacccggtaaccgttacccggggtaacggtaaaccggggcccgttaaacttcccgtaaaccctacgtttacccgtaccgaaaggtaccgtaaacccgtaagttaaccccgggaaaataaacccgggttacggttacgttaaacgtttccgtttaaaacaaaggttaccgaaccgaacgtcccgtaaggaaacccgaaccgggttacgaaccgttaaccggtcgttaaattggttttaacctaggtttaaacgttggtttaacgtggtttaaacccgggtcgtttcccgggggaccccggtggggtaacccggtaacgggtaacccggttcggtaacccgtacccgttaccgtcccgaccgttaacggcccccgttaccgaaccccggg

SEQ ID NO: 137144 - DNA, 546 bp, Homo sapiens
  misc_feature: GYAE6OF02HTZB9.16.39.D06.1.454.CMB.1.raw
  modified_base (401)..(401): a, c, t, g, unknown or other
  misc_feature (401)..(401): n is a, c, g, or t
  modified_base (406)..(406): a, c, t, g, unknown or other
  misc_feature (406)..(406): n is a, c, g, or t
  modified_base (421)..(421): a, c, t, g, unknown or other
  misc_feature (421)..(421): n is a, c, g, or t
  modified_base (427)..(427): a, c, t, g, unknown or other
  misc_feature (427)..(427): n is a, c, g, or t
  modified_base (434)..(434): a, c, t, g, unknown or other
  misc_feature (434)..(434): n is a, c, g, or t
  modified_base (437)..(437): a, c, t, g, unknown or other
  misc_feature (437)..(437): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaggtgtccagtgtgaggtgtacttggtggagtctggaggaggcttgacccaggccgggggggtccctgagactctcctgtgcagcctcgtgggttcagcgtcagtaacaaccacgtgatgtgggtccgccagccctccgaggggaaggggctagggaatgggtctcgagttatagaaatgatggtgacacatctacgccactcgtaggacggccatcacatcncaganacatcaagacacgtnatctanaatgaangcngagaccgagacacgctatatattagtataggtatggtgtagttccgggacccgtggggaccaggggtaccgtggtaccaccggttctcctcgacgtccctaccaaccgg

SEQ ID NO: 137145 - DNA, 740 bp, Homo sapiens
  misc_feature: GYAE6OF02I7ZOH.16.39.D06.1.454.CMB.1.raw
  modified_base (371)..(371): a, c, t, g, unknown or other
  misc_feature (371)..(371): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctattttaaaggtgtccagtgtgaggtgtacttggtggagtctgggaggaggcttgacccaggccgggggggtccctgagactctcctgtgcagcctgtgggttcagcgtcagtaaccaaccacgtagagtggtgggtcccgccagccctcgagggggaaggggctggaagtgggtctactaggttattagaaaatggtatgggtanaacacaagtcctacggacccgtacgtccggtacggaacgggtccgtaattccacctagtcctaccagtacgaacctaactttaccaaaggtaaaccgaacgggttactaaattaccgttaacaaaagttacgggaaaacctcggacccttaacgggaacgtaaacccgggacggaaccgaccgggtaccgttaactttaagttacgttagttaacgtttaaggtttaacgtggggtttaacggttaacgtttcccgggggaccccgttacggggggtaacccgtaacgggggttacccggtcgggttaacccgtaccgggtttcccttacccgtacgacccggcccgttacccgaaccgtaccccgggg

SEQ ID NO: 137146 - DNA, 576 bp, Homo sapiens
  misc_feature: GYAE6OF02FZ7DW.16.39.D06.1.454.CMB.1.raw
  modified_base (300)..(300): a, c, t, g, unknown or other
  misc_feature (300)..(300): n is a, c, g, or t
  modified_base (377)..(377): a, c, t, g, unknown or other
  misc_feature (377)..(377): n is a, c, g, or t
  modified_base (399)..(399): a, c, t, g, unknown or other
  misc_feature (399)..(399): n is a, c, g, or t
  modified_base (419)..(419): a, c, t, g, unknown or other
  misc_feature (419)..(419): n is a, c, g, or t
  modified_base (423)..(423): a, c, t, g, unknown or other
  misc_feature (423)..(423): n is a, c, g, or t
  modified_base (439)..(439): a, c, t, g, unknown or other
  misc_feature (439)..(439): n is a, c, g, or t
  modified_base (446)..(446): a, c, t, g, unknown or other
  misc_feature (446)..(446): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccaggccgggggggtcctggagactctcctgtgcagcctctgggttcagcgtcagtaacaaccacgtgatgtggtccnccagcctcgaggggaaggctgggaatgggtctctagttattagaaaatgatggtgacacaatctacgccgactccgnggaacggcctattccaccatcncagacacattaccaagaacngtanactctacaaatgaacngcctganaccgagacgacggactattactagtacgtatacgttatggtagtacgttccgggcccgttagggccgtaaggggtacccgtcggtacacccgttccgtcccactaccgtcccacccgaccgtaacccggg

SEQ ID NO: 137147 - DNA, 773 bp, Homo sapiens
  misc_feature: GYAE6OF02HFVIR.16.39.D06.1.454.CMB.1.raw
  modified_base (306)..(306): a, c, t, g, unknown or other
  misc_feature (306)..(306): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaaggtgtccagtgtgagtgtacttggtggagtctggaggaggcttgacccaggccgggggggtcctgagactctcctgtgcagcctcgtggggttcagcgtcagtaacaaccacgtgatgtgggtccnccagcctccgaaggggaagggctaggaatcgggtctcgtagttattagaaaatgaagtggtgaacgacaattctaacgccgaacgttccgtaggaagggtcccgtaattacccaaccgacttcccgtaccgaaggtacgtaaacctaaactttacccgaaaacggtaaacgaaccgggttagaaactttaccttaacgaaaattaacgggaaaccacggtaaccctagaaaccggaaaccgggaacggaaccgaacccgggtacctaaagtttaaacgtttaacgtttacgggtttaaagttaaagggttaacgttaggggtttaagggttaacccgtttacccgggggcccccgtttaaggggggaccccgtaaagggggtaaccccggttagggttaccccggttacccggttacccgtaccccgttaccggaaccggttcccccttaaccccggaaaccccggg

SEQ ID NO: 137148 - DNA, 799 bp, Homo sapiens
  misc_feature: GYAE6OF02J2DMK.16.39.D06.1.454.CMB.1.raw
  modified_base (586)..(586): a, c, t, g, unknown or other
  misc_feature (586)..(586): n is a, c, g, or t
tcagtgtactactccacgaccggtgctcgatttagtgacatctcgcagttcttttgggttttggggagaggagcccagcactgggattccgaggtgtttccattcggtgatcagcactgaacacagaggactcaccatgggtagttttggctgagtttgggtttttccttgctgtacttaattttaaaaggttcgtcctagtgtggagtgttacgttggtggagtcgtgggaggaggtcttgacccgacgggccggggggggtccctggacgtaccttccgttccgtggtgccgtacggtccttcggttacggggttccgaacggtccgtccgtaagttaaaccgaaaccgtcggttacggtagttccgggtacgggggtcccgtccgaacggtcccctaccgggaaggggttaaacgggggcgtacggtaaggttcgggtactacgtaagtttaacgtaagtaaacgtgtagtgggtacaacgtactaatccgaccggtccgacgtcgtaggaaggacgtaccgtacgttacaactacgttcaccgaagagtaacctaacttaccaaaggaaccgtaacggttanaaccttacgtaactaaacgttaacgaactcgactacggtaaacggaccgaaagggacctaaccggtacgttaacttaagtttacgtaaggtttaacgttaagtttacgtagggtttacgtaaccggttccgggtaacccggtaggtaaccggaacggtttaaccgggacgttcgtaaccgttccttacccgacgttacccgaccgtaacccgg

SEQ ID NO: 137149 - DNA, 659 bp, Homo sapiens
  misc_feature: GYAE6OF02FL0ZT.16.39.D06.1.454.CMB.1.raw
  modified_base (390)..(390): a, c, t, g, unknown or other
  misc_feature (390)..(390): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagtttgggttttccttgctgcttatttaaaaggtgtccagtgtgaggtgtacttggtggagtctgggaggaggcttgacccgagggcccgggggggtccctgacgactcctcctgtgcacgcctcgtgggttcaggcgtcaagtaaccaaccagtgagtcggtcgggtcccgccgacgcccgtccggaggggaacggggctaggagtgggtctacgtaagttattagaaaatgtatggtnacacaactcgtacgccgtactcggaggaacggccgtaacttccacctaactccaccgaagacaacctaattacccaaagaaccgacggtataactcgttaacaaagtcgaacacgtcctaagacgaaccgaggaacgacggtaccgtaattagttagttagtaagtaggttagtagggtagtttacgtcccgggcccggtgggaccgtaacggggaccgttacggccgtacccgtccgtaccgtccgtacgtacccgtcccgtaaccgg

SEQ ID NO: 137150 - DNA, 784 bp, Homo sapiens
  misc_feature: GYAE6OF02J1UM0.16.39.D06.1.454.CMB.1.raw
  modified_base (643)..(643): a, c, t, g, unknown or other
  misc_feature (643)..(643): n is a, c, g, or t
tcagtgtactactccacgaccggtgctcgatttagtgacatctcgcaggttctttgggttttggggagaggagcccagcactgggattccgaggtgtttccattcggtgatcagcactgaacacagaggactcaccagtggtagtttggactgtaggtttcgggttttccttgctgtctaattttaaaaggtgtcctagtgtgaggtgttacgttgggtagtagtcgtgggacggtaggtcttcggacccgacggggtccggggggggtaccctaggacggtaccttcctaccgtggttacgccgtacggtcctcggttcgggttacacggtccgtacaacggttaaaccaacccgtaacggtgtaacgtcggtccgggtacccgtaccgaccggtacccgaccggaggggtacgggtactaagggtacggttaccgggtcctaccgggttagtttaacgtaaggtaaaacttggtaggtaggttaaccgaacttaacgtaagtcccggtacgtacccgtacgtaccgggtacgggtaaccggtaccgtaccgttacccgaaccgtacttacccgtacggaacgttaacaaaccgttaactaaccgtaaaccggacgttaacggttcgaactttaccgtaaanaacgtaacacgtactaccgaacgaacgaacggagtaacccggactacgtactagttacgttagttagtagtagtagttcgacggttcgaccgggtgaccggagaccgttcgacctacgtcgacctcgctcccgactaccgg

SEQ ID NO: 137151 - DNA, 808 bp, Homo sapiens
  misc_feature: GYAE6OF02HAD2X.16.39.D06.1.454.CMB.1.raw
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttggttttcctgctgctattttaaaaggtgtccagtgtgaggtgtacttggtggagtctggaggaggcttgacccaggccggggggtcctgagactctcctgtcgcagtcctcgtcggttcacgtcgtccaacggtaaccaaccgtacgtgaagtcggtcgggtccgcctaacgtccctaccggaggggacggggctaggaagtcgggtctacgtagttagttacgtaaaagtggtacgttaggtagacctaactaacttccgtaccggacccgtaaccgttcccggtaggaacggggtacctaaccgtttccaacccgtatacccgtacccgaagtaacgaccttaaaccgttaacccgaaacggtaaccggtaaaccggtagtaaacctttaccgttaaccgaaaacgttaccggaaacgtaaccgggtacccgtaacggaaacgggtaaacccggaacgggtaaccggaacccggtaccgttaaatttacgttaagttttaacgggtaacgtttaaagggtttagttacgggttacggttaaccggtttcccggggcccggttacgggggaccggttaacggggtaccccgggttggtaccccgttccggtaccttccccggactacccggtaccccgtaccgaacccggtacccggg

SEQ ID NO: 137152 - DNA, 728 bp, Homo sapiens
  misc_feature: GYAE6OF02JUNF7.16.39.D06.1.454.CMB.1.raw
  modified_base (259)..(259): a, c, t, g, unknown or other
  misc_feature (259)..(259): n is a, c, g, or t
  modified_base (271)..(271): a, c, t, g, unknown or other
  misc_feature (271)..(271): n is a, c, g, or t
  modified_base (381)..(381): a, c, t, g, unknown or other
  misc_feature (381)..(381): n is a, c, g, or t
tcagtgtactactccacgaccggtgctcgatttagtgacatctcgcagttcgtttggggggagaggagcccagcactgggattccgaggtgtttccattcggtgatcagcactgaacacagaggactcaccatggtagtttggctgagtttgggttttccttgctgcttaattttaaagtgtccagtgtgaggtgtacgttggtggagtcgtggaggaggcttgacccgaggccgggggtcctgagactctctgtgacngctcgtggttcngtcgtacacgtaacaacgacgtgagtggtcggtcccgacgtcgccgtacggagggaacggtgtacggaagtcgggtctacgtagttagtagtaaagtcgtaagtcggtanaacgtaacgagttaccgtacgaccgtaaccgtcggtacggacggtaccgtacgttaccgaacctagccgttacacggaacgtaacctaacgtaaccgtaaacgaaacgtacggtaacgtaacttaacgtactaaaagtaccgtaacgacgtaccgtaacggaacgtaaccgaccggaaacgtacccgggtactaacgttaaagtttagttaacgttaagttaggttaaaccgttgggtaacgttaacgggtcccggttacgggaccgggtacccggtaacgggtaaccggttccgaaccgtaccggttccgtaccggtccgtaccgcccgtaccgacccgtaccggg

SEQ ID NO: 137153 - DNA, 804 bp, Homo sapiens
  misc_feature: GYAE6OF02FTVOE.16.39.D06.1.454.CMB.1.raw
tcagtgtactactccacgaccggtgctcgatttagtgacatctcgcagttctttggggggagaggagcccagcactgggattccgaggtgtttccattcggtgatcagcactgaacacagaggactcaccatggagttttggctgtagttgggttttccttgctgctattttaaaggtgtccagtgtgaggtgtacttggtggagtcgtggaggaggcttgacccgagggtcccgggggggttccctggacgtactccgtccgtgtcgcacgtccctcgtcgggttcaggcgtcagtaaccaacctacgtgactggtcgggtccgccacgcctaccggaggggaacggggtctaggaagtcgggtctcgtagttattaagaaagtcgtagtggtacaacaacaactcgtacgcccgtacgtaccggtacggaacgggccgtacgttaccaaccgtacgttacccgtaaccgagtaaccggtaactaaacgtttaccgaaacggtaaaccgtaccggttaacgtaaacgttacctaaacgtaaaacgtacgaaaccgtacggtacccgttaggaaaccgtaaacccggacgggtaaacccgaaccgggttaaccgttaagtttaagtttaacggtttagttaacggtttaaagggttacggtttagggttaacggtttaaacggttccccggggtaacccggtcgggggtaacccgtacgggggtaaccccgggttcggtaccccgttaccgttcccgttaccgtaccggacccgtacccctacccggtaaccggtaaccccggg

SEQ ID NO: 137154 - DNA, 680 bp, Homo sapiens
  misc_feature: GYAE6OF02FJ3PP.16.39.D06.1.454.CMB.1.raw
  modified_base (281)..(281): a, c, t, g, unknown or other
  misc_feature (281)..(281): n is a, c, g, or t
  modified_base (375)..(375): a, c, t, g, unknown or other
  misc_feature (375)..(375): n is a, c, g, or t
  modified_base (577)..(577): a, c, t, g, unknown or other
  misc_feature (577)..(577): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggagtttggctgagttgggttttccttgctgctattttaaaaggtgtccagtgtgaggtgtacttggtggagtctggaggaggcttgacccaggccgggggggtccctgagactctcctgtgcacgcctcgtgggttcagcgtnagtaacaacctacgtgatggtgggtccgccgacgcctaccgagggacggggctggaagtgggtctcgaagttagttagaaaattggagtggtanaacactaatcgtaccgaccgtacgtccggtaggaacggtccgtaattccacctacgtcctaccgaaggacgtaacctaaacgttccaaaggtaaacctacggggtactaaacttaccgtttacaaaagtacgaaacacgccttagaacggaaaccggagtaccgacgggtacctattactttaagttagtactaaggtttangggtttaggttacgttccgggccccgtagggggacctaacgggggtacccgttacgggtccgtacccgtccgtaccgtacgacggttacccacgtaaccccgg

SEQ ID NO: 137155 - DNA, 795 bp, Homo sapiens
  misc_feature: GYAE6OF02FWU5A.16.39.D06.1.454.CMB.1.raw
tcagtgtactactccacgaccggtgctcgatttagtgacatctcgcagttctttgggttttggggagaggagcccagcactgggattccgaggtgtttccattcggtgatcagcactgaacacagaggactcaccatggagtttggctgagttggttttccttgctgcttattttaaaaggtgtccagtgtgaggtgtacgttggtggagtcgtggaggaggtcttgacccgaggtcccggggggtccctggagtacctccgttaccgtgtgcgtacgtcctcgttcgggttcaggcgtacaacgtaacaaccgtacgtgtagtcggtcgggtccgccgagtcccgtaccggaggggacgggtccgtaggacgtcgggtctacggtagtttaagttagaaagttggtagtcggtacgtactaacgtaactccgtaccgaccgtacgtccggtaacggacgggtccgtacttaccgaaccttacgtcctaccgtaagacgtaaccttaatacccgaaagtaaccgtacggtacgtaactttccgaactaaagtacgacgaccgtacctacggaaacgaccgtacggtaaccgaccgggttaccttaagttaacgttacgtttaggtaagtttacgggttaacgttacgggttaaccggttaccgttaccccgggggttacccgttaccggggggaaccgtttaacccggggggtaaacccttttcggggtacccgttaaccccggttccgtttacccggtaaccgtacggttccccccgtaccccggtaaaccggg

SEQ ID NO: 137156 - DNA, 847 bp, Homo sapiens
  misc_feature: GYAE6OF02GX786.16.39.D06.1.454.CMB.1.raw
  modified_base (152)..(152): a, c, t, g, unknown or other
  misc_feature (152)..(152): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggtagttttggctgngttgggttttccttgctgtcttaattttaaaggtgtccagtgtgaggtgtacttggtggagtctgggaggaggcttgacccgagggtccggggggtccctgacgtactcgtcctgtacgcacgtcctcgtgggttcagcgtacaagtaaaccaaccgtacgtgagtcggtacgggtcccgacccgacggtccccgtaccgggaagggggtaacggggtccttaggggaaacgttcgggggtaccctacgttaaggtttaagtttaaacggaaaacggtggtaaggttacgggtaacgaaccgtaaacgtaacgttaccgtaacccggtaacccgtaccgttacccgggtaagggaaaccggggtacccgtaacgtttaccgtaaccctacttacccgtaccgaaggtaaaccgtaaacccttaaacgttaaaccccggtaaaaggtaaaccgtacggttaaacgtaaccttacgtttaaaccgaaagttaaccgaaacgtacgtaccggtaagaaacggaacccggaagtaccggaaccggttaccgtaagttaacgtttagttaagtacgttaggttaagttgggtaaccggttacgttccccgggaaccgggtggggtaaacccgtaggggtaacccgttcggtacccgtacccggttcaacccgtacgccgttaccccgaccgtaacccggg

SEQ ID NO: 137157 - DNA, 851 bp, Homo sapiens
  misc_feature: GYAE6OF02FL4EB.16.39.D06.1.454.CMB.1.raw
tcagtgtactactccacgaccggtgctcgatttagtgacatctcgcagttctttgggttttggggagaggagcccagcactgggattccgaggtgtttccattcggtgatcagcactgaacacagaggactcaccatggagtttggctgagttgggttttccttgctgctatttaaaggtgtccagtgtgaggtgtacgttggtggagtctggaggaggcttcgaccgaggccgggggggtccctggagactcgtcctgtcgcacgcctcgtgggttcagcgtcagtaacaaccgtacgtgatggtacgggtccccgaccgagcccctcggaacggggaggggcgtcggaagtggggtctctaagttacgttagtaaaaagtggtagtgggtacgactaacgtaagtacctaccggaccgtacgttcccggtagggaacgggacccgtagttaccgaaccctacgtaccgtacccgaacggtaacgtaaccgtaaacttacccgaaaaccggtaacgtaaccgggtaactaaacgttacccttaaacgtaaacggttaccggaaataccggtaaccgtaacgggtaaccggaaacccgggacggaaccggtaacccgggtaaccggtttaaagtttaacgtttaacgtttaaggttaaaggtttaacgggtttaaagtttaggggttaacggggttttacgggtttaccccggggtaccccgggttaccggggggtaacccggttaaacccggggggtaacccgggtttaccggggttaaccggtacccccggttttaccgaccccggtttaccggaccggttacccccggtaaccccgtaaaccccgggg

SEQ ID NO: 137158 - DNA, 1105 bp, Homo sapiens
  misc_feature: GYAE6OF02INDA7.16.39.D06.1.454.CMB.1.raw
tcagtgtactactccacgaccggtgctcgatttagtgacatctcgcagttctttggggggagaggagcccagcactgggattccgaggtgtttccattcggtgatcagcactgaacacagaggactcaccatggtagttttggctgagttgggttttccttgctgacttattttaaaaggtgtcctagtgtgaggttgtacttggtggtagtcgtgggaggaggtcttcggacccgagggtcccgggggggtccctggacgtacctccgtccgttggtcgccacgtccgttcgttcggggttcaggtccgttaccgaagtaaaccaaacccgtaacggtggtaattcggggttacggggttccccgacccgaacggtccccgtacccgggaaggggggtaaacggggggtccgttaggggaaacggtttcgggggttaccttaccggttaaagggttttaacgtttaaaggtaaaaaacgtttcgggaagtttggggttaacgaaccgtaacgtaaaattacccggtaacccggacccggttaaccgtttacccgggtacggggtaaaaccgggggtccccgttaaaccgttacccgtaacccgtacttacccggtaacccgttttaaacgggaaacgtaaacccgttaaaacgtttaacccccgaaaaacgggtaaacccgtaaaccgggggtttaacaaaacggtttcccgtttaaaacgaaaaacgtttaccggaaaaccgttaaccggaaccccgtttaagggaaaacccgggtaaaaccccgggtaaacggggtaaccctaaaccgggggttaaccctttaaacgggttttaaacttttaaccgggttttaaagttaaacggtttaaagggggtttttaacggtttaaacgggggtttaaccgggtttttaaaacccggtttccccggggggtaaccccccgggtttgggggggtaaacccccggttaaacccgggggggtaacccgggtttaccgggttaaccccggtaaccccgggtttttaccccgttaccccggtaaccggttaaccccgggttacccccttaacccccgggaaacccggttaaaccccccggggg

SEQ ID NO: 137159 - DNA, 746 bp, Homo sapiens
  misc_feature: GYAE6OF02I1892.16.39.D06.1.454.CMB.1.raw
  modified_base (736)..(736): a, c, t, g, unknown or other
  misc_feature (736)..(736): n is a, c, g, or t
tcagtgtactactccacgaccggtgctcgatttagtgacatctcgcagttctttgggtttggggagaggagcccagcactgggattccgaggtgtttccattcggtgatcagcactgaacacagaggactcaccatggagtttggctgagttgggtttccttgctgtcttaattttaaaggtgtccagtgtgaggtgtacgttggtggagtcgtggaggaggtcttgacccgagggcccggggggtccctggaacgtctcgtcctcgtcgcacggtccgttcgttcggggttcacggtccggtactaacggtaaacctaaccgtaccggtaggtaagtcgggtacgggtccccgacccgtaacggtcccgttaccggaagggggtaacggggtcctaggtaagttcggggtaccttacgtaaggtttagttaagaaaagttcggaagttggactaacgactaagtccgtacgaccgtaacgtcggtaaggaacgggcctaacgttccaaccttacgtacctaccgagaacgtaactaaccgtaaccgaacgtaaccgtaggtactaactccttaaacgtaaactacgaaccgtcgtaacccgtaggaaaccgtaccgggacgtaaccggacgtaccgtaacttagtacgttgtaagttgtagtcgggtataccggttcggacccggtggacgtacgggacgttcggtacctcccgtacgtcccgatccggaccccngtaaacccgg

SEQ ID NO: 137160 - DNA, 601 bp, Homo sapiens
  misc_feature: GYAE6OF02F0WIM.16.39.D06.1.454.CMB.1.raw
  modified_base (266)..(266): a, c, t, g, unknown or other
  misc_feature (266)..(266): n is a, c, g, or t
  modified_base (369)..(369): a, c, t, g, unknown or other
  misc_feature (369)..(369): n is a, c, g, or t
  modified_base (405)..(405): a, c, t, g, unknown or other
  misc_feature (405)..(405): n is a, c, g, or t
  modified_base (433)..(433): a, c, t, g, unknown or other
  misc_feature (433)..(433): n is a, c, g, or t
  modified_base (450)..(450): a, c, t, g, unknown or other
  misc_feature (450)..(450): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctatttaaaaggtgtccagtgtgaggtgtacttggtggagtctggaggaggcttgacccaggccgggggggtccctgagactctcctgtgcagcctntgggttcagcgtcaagtaacaaccgacgtcgagtggtgggtccgccacgccctccgaggggaggggctggaagtgggtctcaggttatagaaaatgatggtanacaacatcacgcgactcgagacgggcgattcaccanctcagacgacacgtacaagaacgcgtanactctacaaagtgaacngacctgaacgaaccgagaccacggactaagtacttagttagtaatacggttagttgggtaggttacgttccgggtcccggtgggaccgtacggggtaaccgtcgggtcctaccggtccttaccggacctccggtacccctccgtaacccgg

SEQ ID NO: 137161 - DNA, 788 bp, Homo sapiens
  misc_feature: GYAE6OF02J1K4D.16.39.D06.1.454.CMB.1.raw
  modified_base (177)..(177): a, c, t, g, unknown or other
  misc_feature (177)..(177): n is a, c, g, or t
  modified_base (187)..(187): a, c, t, g, unknown or other
  misc_feature (187)..(187): n is a, c, g, or t
  modified_base (601)..(601): a, c, t, g, unknown or other
  misc_feature (601)..(601): n is a, c, g, or t
  modified_base (615)..(615): a, c, t, g, unknown or other
  misc_feature (615)..(615): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagtttggctgtagttggttttccttgctgctaatttaaaggtntccagtgtgngtgtactggtggagtcgtggagaggtcttacggacccgtacgggccggggggtccctaggacgtactctccgtgcgcacgtccgtagtcgggttcacgtcgtacgaacgtaaccaccgtacgtagacgttggtccgggtacccgcccgtacgccccgtaccgggaagggggtaacgggtacgttaggaacggttcgggttccgtaccggttaagtttagttaaaggaaaagttcggtaagttcgggaacgtaaccaaacgtaacgttaccgtaaccggtaccgtaaccgtaccgggtacgggaaaccggtcctaacgtacctacccgtacgtcctaccgaagtaaccgtactaaccgttaccggaaacgtaaacggcggttaacaacttaccgttaaagaaacgttccggaacnggtttaacccgganaaacggggtaacccgggaaaccgacgtaacccggtttacccgtaagtttaaatttaccggttagggttaattaccgggttattacggggacctttacccgggacggttcccgtaggggtaaccgaacggtcgtacgtcgaccctcgttacgacgttcacccgtacgacgtccg

SEQ ID NO: 137162 - DNA, 792 bp, Homo sapiens
  misc_feature: GYAE6OF02H098Z.16.39.D06.1.454.CMB.1.raw
  modified_base (268)..(268): a, c, t, g, unknown or other
  misc_feature (268)..(268): n is a, c, g, or t
  modified_base (320)..(320): a, c, t, g, unknown or other
  misc_feature (320)..(320): n is a, c, g, or t
tcagtgtactactccacgaccggtgctcgatttagtgacatctcgcagttctttggggggagaggagcccagcactgggattccgaggtgtttccattcggtgatcagcactgaacacgagaggactcaccatggtagtttggctgagttggttttccttgctgcttatttaaaggtgtccagtgtgaggtgtacttggtaggagtcgtaggaggaggcgttagacccgaggccgggggtcccgtgacgacttccgtcctggtcgacncgcctgtgggttcagcgtacacgtaaaccaacctacgtgagtggtcggtccnccacgtacccgtacgaggggacgggcgtagggtaagttcgggtacctagtacgttaattaaggaaatagtaggtggtacgaacgactaagtcctaccgtacgacgtcggtaggacgggtcctagttaccaccgtactacctaccgtaagaccgacttaaaccgtaaccgaaaacggtaaccgtacggtaaagtaacctaactttaccgaaaacgttacggtaaaccaccggtacccgtaaacgggaaacccgtaaccggggtaaaacctacggaacccgggttaacccgtttaaatcgtttttaagttaggtttaaacggtttaggtttaacggtttaagggttacggtttaacgggttcccccgggtaaccggggtacgggttacccgggtaagggggttaccccttcgggacctttaacccgggtccttacccggccgtaccgtttaccccgacggtacccgtaaccggg

SEQ ID NO: 137163 - DNA, 616 bp, Homo sapiens
  misc_feature: GYAE6OF02HMI8O.16.39.D06.1.454.CMB.1.raw
  modified_base (339)..(339): a, c, t, g, unknown or other
  misc_feature (339)..(339): n is a, c, g, or t
  modified_base (363)..(363): a, c, t, g, unknown or other
  misc_feature (363)..(363): n is a, c, g, or t
  modified_base (410)..(410): a, c, t, g, unknown or other
  misc_feature (410)..(410): n is a, c, g, or t
  modified_base (418)..(418): a, c, t, g, unknown or other
  misc_feature (418)..(418): n is a, c, g, or t
  modified_base (446)..(446): a, c, t, g, unknown or other
  misc_feature (446)..(446): n is a, c, g, or t
  modified_base (457)..(457): a, c, t, g, unknown or other
  misc_feature (457)..(457): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccaggcccgggggggtccctgacgactctcctgtgcagcctctggttcagcgtcagtaacaacacgtgatcgtgggtccgccagccctccgaagggaggggctaggaacgtggtctnaaggtttatagaaaatggatggtnacaactaactctaacgccgactccggtagaacgggccattcaacctntctcaganacaattccaaagaacacgtagatactanaaatcgaaacncactagaacgaaccgaggacgacggacgtaatattattgtaacgtaggttacgtggttagttaacgtccgggtacccgtggggacccgtaacgggtaaccgtcgggtacccgtaccgtccttacccacgtacccggcccttacccgacgtaaccccggg

SEQ ID NO: 137164 - DNA, 832 bp, Homo sapiens
  misc_feature: GYAE6OF02H8WFF.16.39.D06.1.454.CMB.1.raw
  modified_base (358)..(358): a, c, t, g, unknown or other
  misc_feature (358)..(358): n is a, c, g, or t
  modified_base (403)..(403): a, c, t, g, unknown or other
  misc_feature (403)..(403): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggtagtttggctgagtttgggttttccttgctgcttattttaaaaggtgtccagtgtgtaggtgttacttggtggagtcgtggaggaggcttgacccgagggcccgggggggtccctggagtacctcctccgtgtcgcacgtcctcgttgggttcagtccgtacaacgtaaccaacccgtacgtgtacgtggtcgggtccgccacgcctaccgaggggaacggggngtaggagtcggtctcgtaagtttagtaagaaattggagtaggtanaaccaactaacttacgtaccggacccgtaccgtcccggtaaggaaccggggtcctaacttcccgaacctaccgtcctaccgaaggaccgtaaactaaaccttaacccggaaaaggtaaaccgacggggttaactaaacgttaccctttaaaacgaaacgttaagaaaaccgtcggttaacccgaaaggggtaaccggaaacccggtaaggggtaaaccccacgggggtttacccgtttaaaagtttaccgtttaagtttagggttaaacgtttaaggggtttaacgttccgggggtttaagggttaaccccgttcccggggtaacccccgggttaggggaacccggtaaccgggggtaccttccggggtaacccgtccccgttattccccgtaccgttaaccggccccttaccccggaaggtaccccgg

SEQ ID NO: 137165 - DNA, 718 bp, Homo sapiens
  misc_feature: GYAE6OF02HF9YW.16.39.D06.1.454.CMB.1.raw
  modified_base (348)..(348): a, c, t, g, unknown or other
  misc_feature (348)..(348): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgaggtttgggttttccttgctgcttattttaaagtgtccagtgtggaggtgtacgttggtggtagtcgtggagggaggtcttcggacccgacgggcccggggggggtaccctggacgacctccgttcctggtagcgacgtcctcgttgggttactaggccgtcacgtagaccaaccgtacgtagagtggtcgggtcccnccgacgtccgtaccgtagggggaacgggtcgtagggtaagttcgggtctagtagttattaaggaaattggtagtaggtacgaacataactccgtaccgaccgtacgtccggtacgaaccgggtcctactaccacctatacctcgaagacaacttaacctaccaaaagaccgttacggtagactttaacctagtaaatccggaaactcggtacctaggaaccgaaaccggagtaccggaaccgttagttaattagttacgtttaggtaagttaagggtgttagggttacgtaggttcccgggaccgtaggggccgtaggggtaacccttggacccttccggtaccttcccgaacgtcctccccgtaacccg

SEQ ID NO: 137166 - DNA, 771 bp, Homo sapiens
  misc_feature: GYAE6OF02IU9A1.16.39.D06.1.454.CMB.1.raw
  modified_base (183)..(183): a, c, t, g, unknown or other
  misc_feature (183)..(183): n is a, c, g, or t
  modified_base (246)..(246): a, c, t, g, unknown or other
  misc_feature (246)..(246): n is a, c, g, or t
  modified_base (258)..(258): a, c, t, g, unknown or other
  misc_feature (258)..(258): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaaggngtccagtgtgaggtgtacttggtggagtctggaggagcttgacccaggccggggggtccctgngactctcctgtncagcctcgtggttcagtctcagtaaccaaccacgtgatggtcggtcccgcctacgcccgtaccggaggggtaacgggccgtagggtaacgtggggttcctacgtaagtttaagttaaggtaaaacgttggtaaggtagggtacgaaacgtaacgtaaacgtacccgttaaccggacccggtaccgttaccgggtacgggaaaccgggtacccgtaactttacccgaaccctacgttaccctacccgaaaggtaacgtaaaccttaaaccgttacccgaaaaacggtaaccgttaacggtacgtaaactttacgttaaaccgaaaagtcgtaaacacgtccgtaagaaccggaaaccggtagaaccgtaccgggttactaacgttaatttacgttacgttaaagtagggtttgacgggtttagtaccggttcccggtcccgggtagggtacggtaaccgggtaccgttagggtaccctcgaccttccgacccgtacgtcccccgtagaacccgg

SEQ ID NO: 137167 - DNA, 780 bp, Homo sapiens
  misc_feature: GYAE6OF02HTC7S.16.39.D06.1.454.CMB.1.raw
  modified_base (316)..(316): a, c, t, g, unknown or other
  misc_feature (316)..(316): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttggtttccttgctgctatttaaaggtgtccagtgtgaggtgtacttggtggagtcgtggaggaggtcttgacccgaggcccgggggggtccctggacgacctccgtcctgtcgcacgcctcgtgggttcagtcgtcaagtaaccaaccacgtgtagtcggtgggtccnccgacgccctccgaaggggaacgggtcgtaggaagtcgggtctcgtagttagttaagaaagtgagtggtcgaacactaatacgtacgccgacttccgaggtaacgggccgtagttaccacctactcctaccgaagtacgactaaaccttaccgaaacgtaaccgaacggtacggtaacttaccgttaactaaaagttacggaaacctacggacccgtaacgaacggaaacccggtaacgggaaccgtaaccgggtaccgttaagttaacgttttaacggtttagttaaacggttaacgggtttaagtagggggttttaaccggtaaacggttttccccggggggttaacccccggtagggggtaacccgggtaaccggggttaacccgggttaccggttacccggaccggtttccctaccggttaccggaccgttacccccgtccccgaaccggtaaacccggg

SEQ ID NO: 137168 - DNA, 699 bp, Homo sapiens
  misc_feature: GYAE6OF02FUNKD.16.39.D06.1.454.CMB.1.raw
  modified_base (499)..(499): a, c, t, g, unknown or other
  misc_feature (499)..(499): n is a, c, g, or t
tcagtgtactactccacgaccggtgctcgatttagtgacatctcgcagttctttgggggggagaggagcccagcactgggattccgaggtgtttccattcggtgatcagcactgaacacagaggactcaccatggagttttggctgagttgggttttccttgctgctattttaaaggtgtccagtgtgaggtgtacttggtggagtctggaggaggcttgacccaggccggggggtcctgagactctcctgtcgcacgcctcgtgggttcagcgtacaagtaaccaaccacgtgagtggtcgggtccgccacgcctacggaggggacgggcgtagggagtcgggtctacgtagttatagtaaaagtgtagttggtagaaccactaaactccgtacgacccgtacgtccgtaggaacgggtcccgtaatccaccgtacttccacgagacgaactaaacgttaccgaaacggtaaacgtacgggtactaaacttcctaaanaaacgtacgaaacacgacctaggaacgaaccggaggaaccaccggtacttaatacgtttagtgttaacgtaagttagtgggttacgtacgttcccgggacccggtacggggtaccgtaacggggttaacccgttcgggtacccgtaacccggttccgtaccccgtcgacccgtcccgtaccccggaccggtaaccccggg

SEQ ID NO: 137169 - DNA, 846 bp, Homo sapiens
  misc_feature: GYAE6OF02IODQC.16.39.D06.1.454.CMB.1.raw
  modified_base (264)..(264): a, c, t, g, unknown or other
  misc_feature (264)..(264): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggtttccttgctgctatttaaaggtgtccagtgtgaggtgtacgttggtggagtctgggaggaggcgttcgacccgaggccgggggggtcctggagactctccgtggtcgacgngtccttcgtagggttcacgtcgtacgtaagtaaaccaaccgtacggtagtaggtcggtaccggggtccccggaccctacggtaccccgtacccgggaagggggaacgggggtccgtaacgggtaacggttcgggtaccgttaacggtaacggtttaagttaacggtaaaaagtggtaaggttgggtacgtaacctaagtaaactccgtaaccgaccggtaccgttacccggtaggaaaccggggtcctaactcccgactacttaccgtaccgaagacgaaccttaaacttaacccgaaaggtaaccgtaacggtaacgttaaaccgtacttaaccgaaagtacgaaaacgtacgtaccgtaaaggaacccggaaaccggaaaccggaacccgtaaccgggtacccttaagtttaaacgttacgtttaaggttaacgtttaggttaaacggtttggggttaaaggttaccggtacccggggtacccgtagggggtaacccgtaacgggggtaccgtaccggtaccgtaccggttacctcccggtaccgacccggttaccctaccggtaaccggtaacccgggg

SEQ ID NO: 137170 - DNA, 725 bp, Homo sapiens
  misc_feature: GYAE6OF02IPL8B.16.39.D06.1.454.CMB.1.raw
  modified_base (296)..(296): a, c, t, g, unknown or other
  misc_feature (296)..(296): n is a, c, g, or t
tcagtgtactactccacgaccggtgctcgatttagtgacatctcgcagttctttgggttttgggggagaggagcccagcactgggattccgaggtgtttccattcggtgatcagcactgaacacagaggactcaccatggagttttggctgtaggttgggttttccttgctgtcttaagttttaaaggtgtccagtgtgaggtgtacgttggtggtagtcgtgggaggaggtcttgacccgacgggtccggggggtcctggacgtactctccgtgtgcgacgtccgtcgtggtacngcgtcaagtaaccaaccgagtagtagtggtcgggtccgccgtacgcccgtaccggagggacgggcgtaggaggtcggtctcgtagttagtagtaaagtgtagtggacgaacacgtaactccgacgaccggtacgtccgtaggaaccgggtctacgtaccacgtactccgacgacgataacctaacttaccgaaacgtacgaagggtactaaccgtacgtaacaaagtcggaaactcgacgtacgaccgaaacgtacggaaccgtaccgtacgtaacttacgttacgttagttaagttacggttagtacgggttaacggttacgggttccccggtccgggttacggggaacccggtacggtaacccgggtttaggacccggttaccctcggttaaccccgtccggtaaccggtccccctaccggaaccgg

SEQ ID NO: 137171 - DNA, 1190 bp, Homo sapiens
  misc_feature: GYAE6OF02IDZDV.16.39.D06.1.454.CMB.1.raw
tcagtgtactactccacgaccggtgctcgatttagtgacatctcgcagttctttggggggagaggagcccagcactgggattccgaggtgtttccattcggtgatcagcactgaacacagaggactcacatggagttttggctgagttggtttccttgctgctatttaaagtgtccagtgtgaggtgtacttggtggagtcgtggaggaggcttagacccagggccgggggggtccctggacgtactctcctgtcgcacgcctcgtgggttcacggtccgtctaacggtaaaccaaaccccgtacggtagtaagttcggggttaccggggtccccggtaccccgaccggtccccgtaccccggtaaaacggggggggaaacgggggggttccggttaacggggtaaacgggtttcgggggttttaccgttaccgtttaaagggtttttaaaacgtttaaggtaaaaaaaacggtttaggttaaggttacggggggttaacggaaacccgtaaaaaccgtaaacggtttaacccggttaaaccccgggtaccccggtaaacccggtttaccccggggtttaaaaccgggggaaacccggggggtacccccggtaacgtttacccccgtaaaccctaaccgtttacccccgttaacccggaaacggttaaacgggtaaaccctaaaacccgttttaaacccccgaaaaagggtaaaccccgtaaaacccgggggttaagtaaactttaccccggtttaaacgtaaaaaccgtaacggtaaaacccgtaaacggtcccgttaacgggaaaaccggggttaaaacccggggaaagggtaaaccccgtaaaccgggggtacccgtttaaaacgttttaaaacggttttttacgggtttaaacggttttaaaagggtttttaaggggttttaaaaccgggtttaggggggttttaaaccggggtttaaccggggttttttacccccccgggggggtaaccccccggggggttttaacgggggggacccccggggttaaaaacccgggggggttaaacccccgggggtttaccgggggtttaaccccccggttaaacccccgggttttccccgtttaacccccgtacccccggggtttaaccccgtaccccccgggttaaaaccccccgggacccccgggttaaaacccccgggggg

SEQ ID NO: 137172 - DNA, 771 bp, Homo sapiens
  misc_feature: GYAE6OF02FZSBB.16.39.D06.1.454.CMB.1.raw
  modified_base (242)..(242): a, c, t, g, unknown or other
  misc_feature (242)..(242): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccagggcccgggggggtccngacgacctctcctgtgcacgccgtcgttgggttcaggtccgtaccagtaaaccaacccacggttgacgttggtcggggttccccgccgtacggccctaccggaagggggaaggggtcgtagggaagtcgggtctacgtaagtttagtaagaaaagttggaagttgggacgaacaacgtaaacttccgtaaccggtcccgaccgtcccgtagggaaccgggacccgtattcccgaaccctatcctaccgaagtacaacgtaacttaccgaaacgaacgtacggtaacgtaacttacctaacgaaagtacgaaaccacggtaccgtacggaaccggaaacccggtaacggaacccggtaaccgggtacccgttaaagttactttaagtttacgttaagttaaggttagttacgggtagttaacccggttcggggtaaccccgtgggggtaacccgtaacgggtaccgggtcggtacccgacccggttcctacccggtaccgtacccgccctacccgaacccggtaacccgg

SEQ ID NO: 137173 - DNA, 651 bp, Homo sapiens
  misc_feature: GYAE6OF02GY1BU.16.39.D06.1.454.CMB.1.raw
  modified_base (368)..(368): a, c, t, g, unknown or other
  misc_feature (368)..(368): n is a, c, g, or t
  modified_base (382)..(382): a, c, t, g, unknown or other
  misc_feature (382)..(382): n is a, c, g, or t
  modified_base (388)..(388): a, c, t, g, unknown or other
  misc_feature (388)..(388): n is a, c, g, or t
  modified_base (432)..(432): a, c, t, g, unknown or other
  misc_feature (432)..(432): n is a, c, g, or t
tcagtgtactactccacgaccggtgctcgatttagtgacatctcgcagttctttgggttttgggggagagggagcccagcactgggattccgaggtgtttccattcggtgatcagcactgaacacagaggactcaccatggagttttggctgagtttgggttttccttgctgcttaattttaaaaggtgtccagtgtgaggtgtacttggtggagtcgtgggaggaggcttcggacccgacgggcccggggggggtccctggacgtacctcctccgtggtcgcacgccctcgtggtcagccgtcaacgtaaccactacgtgtagtggtcggccgccacgccgtacgaggggagggcgtggagtggtcntagttatagaagtnagtagnacacatcaccgacacgtcgaggacgaccgtactacaccactacncaagacaactaataaccgaaacgacgtaggtactaactacctacaaactacgaaccgtacgacgtagaaccggaacgacggaaccgacggtacttattaacgtattagtaagtttacggttagtaggttcggttacgttccgggccggtaaccggggacgaacggggtaccgtccggtaccgtaccgtccgtacccgtcgaccgtcccaccgtaaccgg

SEQ ID NO: 137174 - DNA, 922 bp, Homo sapiens
  misc_feature: GYAE6OF02HF36K.16.39.D06.1.454.CMB.1.raw
tcagtgtactactccacgaccggtgctcgatttagtgacatctcgcagttctttgggggggagaggagcccagcactgggattccgaggtgtttccattcggtgatcagcactgaacacagaggactcaccatggagttttggctgagttgggttttccttgctgctattttaaaaggtgtccagtgtggaggtgtacgttggtggagtcgtggagggaggcttcggacccgagggcccgggggggtccctggacgtactcctccgtgtgcacggtcctcgtgggttcaggtcgtcaacgtaaccaaccgacgtgagtcgggtcgggtcccgaccgacgcccgtaccggaacgggggaacggggtcgtagggaaggttcgggtcgtcgtaagtttaacgtaagaaaacgttgtaaggttaggtacgaactaacctaacttcccgtaacccggtcccgtaccgttacccggtaaggggaaccgggtccctaacgtttaccaacccgttacttacccggtaccgtaagaaccgtaactaacctttaaacccggaaaggtaaccgtaacgggttacgttaaaccgttaaccgttaaacgtaaaaccgttaaccggaaaacccgtaccgggttaaaccgggttacggtaaaaacccgggaaccccggggaaacgggaaccccgggtaaccggggttaacctttacggttttaaagtttttaacggttttaaggtttaacgggttttaaaggggtttaaacggttaggggttaaccgggttaaccgggtttcccggggtacccccggttacggggggtacccggtaacgggggttacccggttacccgggttacccggttaccccggttaccggttaccccgttaccggacccggttaccccgtaccccgaacccggtaaccccggg

SEQ ID NO: 137175 - DNA, 660 bp, Homo sapiens
  misc_feature: GYAE6OF02IW7YP.16.39.D06.1.454.CMB.1.raw
  modified_base (213)..(213): a, c, t, g, unknown or other
  misc_feature (213)..(213): n is a, c, g, or t
  modified_base (629)..(629): a, c, t, g, unknown or other
  misc_feature (629)..(629): n is a, c, g, or t
  modified_base (637)..(637): a, c, t, g, unknown or other
  misc_feature (637)..(637): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagtttggctgagttggttttccttgctgcttattttaaaaggtgtcagtgtgaggtgtacttggtggagtcgtggaggnggcgttgacccgaggccggggggtccctgacgactctccgtgtgcagcctcgtcgggttcagtccgtacgacgtaacgaaccacgtagatacggtcgggtcccgaccgacgtacccgtacccggagggggaaggggtctagggtaacgtcggggtacttacgtaagtttaagtttacggaaaatggagtcggtagactacaatcctaccgccgtacgtaccggtaggaacggccgtacttacacgtccatccctacgaagtacgaaactactaccaaagactacggtagtactaccttagaaatcgaaacgagtccctaagggaccgaaaccggagaccgtacggtaccgtaattacgtttatacgggttaataggttagtagtacgttacgtcgaccggtgggccaacgggtccnggttaccnccgtctacgactcgccgaccacg

SEQ ID NO: 137176 - DNA, 830 bp, Homo sapiens
  misc_feature: GYAE6OF02I7K0E.16.39.D06.1.454.CMB.1.raw
  modified_base (491)..(491): a, c, t, g, unknown or other
  misc_feature (491)..(491): n is a, c, g, or t
tcagtgtactactccacgaccggtgctcgatttagtgacatctcgcagttcttggggggagaggagcccagcactgggattccgaggtgtttccattcggtgatcagcactgaacacagaggactccaccagtggtagttttcggctggtagttgggttttccttgtctgtacttaattttaaaaggtcgtacctagtgtggtaaggttgttacgttgggtaggtacgtcgttgggaaggcggtacctacggtacccgagggtcccggggggggttcctaggacgtaacgttcctccgttgtcgaccgtacggtccttacggttcgggtccgaggtcccgttaacgtaaacggttaacccaaaccggcgttagtaacgtggtacgggtcccgacctaacgtcccgtaccggtaaggggaagggtcctagggaaaccggttcgggtccttaccggtgttaagtaacggttaaaagtaggacgttgggtaacncctaaagtaactacggtacccgcccgttacgtacggtacggtacggaccgtcgtaaccacgaccttcctaacaaggtaactaacgtaataccggaacggtaacaaccggtagtaaccgtaattaaccgaacgtaacgaaacgtacgtaaccgtagaaaccgggaacggaccggtaaccgaacgtaacctaagttaacgttagttagtaacgttaggtttataacgggtacgttaccgggtcggtacccgggtacgggtaacggaaccgggtacggtaacggtcccggtaacccgttcgtaccttacccggagttcccccgtactaacccgggtaacccg

SEQ ID NO: 137177 - DNA, 783 bp, Homo sapiens
  misc_feature: GYAE6OF02F7POU.16.39.D06.1.454.CMB.1.raw
  modified_base (682)..(682): a, c, t, g, unknown or other
  misc_feature (682)..(682): n is a, c, g, or t
  modified_base (764)..(764): a, c, t, g, unknown or other
  misc_feature (764)..(764): n is a, c, g, or t
tcagtgtactactccacgaccggtgctcgatttagtgacatctcgcagttctttggggggagaggagcccagcactgggattccgagttgtttccattcggtgatcagcactgaacacagaggactcaccatggtagttttggctgtagtttgggttttccttgctgtacttaattttaaaggtcgtccagtgtgaggttgttacgttggtggagttcgtggaggaggtcttcgacccgaggggccccgggggggttccctaggacggtaccttccgtccgtaggtcgaccgtacggtcccttcggttcggggttacctacggtccggttaccgtaacggtaaaacccgaaacccggttaacggttacggtaacgttcggggttcccggggttaccccgaccgtaacggtccccgttaccgggtaaggggggacggggtaccgtaagggtaacgttcgggttactacgttaaggtttaacgtaagtaaagtcgtaagttcggtagaactaactacgtcgtaccgaccgttacgtccggaggtaacggtaccgtactaccacctatccaacgacgtaacgaacctaacgttaccgaaacggaacgtcgttacgtaacttacctaagaaatccgaataccgcgtaacgaagaccgacgacgtacgtacttacttattacggtanaaggttacttaggtgtacggttaccgtcgggaacccggtgggtactacggggtactccggacttcgttcctaccacggtacncccgtaccgaagtccccgg

SEQ ID NO: 137178 - DNA, 766 bp, Homo sapiens
  misc_feature: GYAE6OF02HEXQ9.16.39.D06.1.454.CMB.1.raw
  modified_base (394)..(394): a, c, t, g, unknown or other
  misc_feature (394)..(394): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttggttttccttgctgctattttaaaggtgtccagtgtgaggtgtacttggtggagtcgtgggaggaggcttgacccaggcccgggggggtccctgagactcctcctgtcgcagcctcgtgggttcaggcgtcaagtaaccaaccacgtgagtggtcgggtcccgccagcccgtccggaaggggacggggctagggaagtcggggtctcgtagtttatagaaaagtggaagtggtagactanaagtcacgccgactacggtggaacggctattaccactactcctaccgagacgaacgtacttaaccgaagtaaccgacgggttaagtaaactttcgtaaactaaagttacgaaaccgtacgtaaccgtagtaaaccgggaaacccggtaagggaacccgtaccgggtaccgtttaacttaaggttttacgtttaagtttaacggttaacggtttaacggttagggtttaacgggtttaaccggtttcccgggggttacccccgggttaagggggtacccgggttaaaccgggggttccggttaaccgggttcccggtaacccgtttcccgtcccgttaccgtacccggttcccgtaccccggtaaccccgggg

SEQ ID NO: 137179 - DNA, 841 bp, Homo sapiens
  misc_feature: GYAE6OF02FIVTX.16.39.D06.1.454.CMB.1.raw
tcagtgtactactccacgaccggtgctcgatttagtgacatctcgcagttctttgggttttggggagaggagcccagcactgggattccgaggtgttccattcggtgatcagcactgaacacagaggactcaccatggtagttttggctgtagttgggttttcctgctgcttaatttaaaggtgtaccagtgtagaggtgtacgttggtggagtctgggaggtaggcttgacccgaggtccgggggggtccctgagactccgtcctgtgcagtccgtcgttcgggttcacggtcgtacgacgtaaaccgaaccgtacgtacggacgtcgggtacgggtacccgcccgaacggtacccgtaccggaagggggtaaacggggtcctaagggaaacggttcggggtccttaccgtaaaggtttaacgttaacgggaaaaagttggtaaacggtagggttaaccaaccgtaaacgtaaacgttacgtaaccggacccggtaccttaccgggtaagggaaacgggtcccgtaacgttaccaacccgtaacgtaccctaaccggaacgtaacgaaacctaacgttaaccgaaacgaaacctacgggtaaacgtaattactaacgtaaatacgtaaaccgagaccgtagaacgtaaccgggtaacgaacgtacggtaccgttagttaagttaacgttacggtaagtttaacggttaagttacgggttaaggtttaccgtaccggggtacccggtaagggggtcccgtaaaccgggggtaaccgttcggggtaacccgtacccgggtaccttcccggaccgtaccggtacccgacccgtaaacccgggg

SEQ ID NO: 137180 - DNA, 831 bp, Homo sapiens
  misc_feature: GYAE6OF02HY3EX.16.39.D06.1.454.CMB.1.raw
  modified_base (191)..(191): a, c, t, g, unknown or other
  misc_feature (191)..(191): n is a, c, g, or t
tcagtgtactactccacgaccggtgctcgatttagtgacatctcgcagttctttgggttttggggagaggagcccagcacgtgggattccgaggtgttccattcggtgatcagcactgaacacagaggactcaccagtggtacgtttggctgtagtttcgggttttccttgctgtcttaagttttaaaggngtccagtgtagtaggtgtacgttggtggagttcgtaggaggtacggtcttacgacccgtacgggccgggggggtcctaggacgtacgtccgtccgtgtgtcacgtcctcggttacggtcacggtctacgaataaccaacgcgtgtagtggtcggccgtacgacgtcccgtacggtagggaacgggtcgtaggtaacgtcggttcgtacgttaagttaacgtaaacggtaactgtagttaggtacgaacctacgtactacgtaccgtaccgttaccgacgtacgggtacgtcctaattccgaactctaccgacgtaagaccgtacgtaaccttaacggaaacgaaaccgtggaacccttaagttacctaaacgaaagttacccggtaaacacggttaccctcggaaaacccgtaacggtaaaccgggtacgttaacccggtaccgtttaagtaacgtttaaccgttagttaaaggttaaacggtttacggttacggggtaaccggtttaacgggttcccccgggttaaccggtaccggggtaaacccggtaacggggtaaaccccgtttccggggacccctttaacgggtacccgttacgtaccccggttaaccggtcccggtttaaaccccgacccgggg

SEQ ID NO: 137181 - DNA, 639 bp, Homo sapiens
  misc_feature: GYAE6OF02HJQZL.16.39.D06.1.454.CMB.1.raw
  modified_base (206)..(206): a, c, t, g, unknown or other
  misc_feature (206)..(206): n is a, c, g, or t
  modified_base (318)..(318): a, c, t, g, unknown or other
  misc_feature (318)..(318): n is a, c, g, or t
  modified_base (388)..(388): a, c, t, g, unknown or other
  misc_feature (388)..(388): n is a, c, g, or t
  modified_base (433)..(433): a, c, t, g, unknown or other
  misc_feature (433)..(433): n is a, c, g, or t
  modified_base (440)..(440): a, c, t, g, unknown or other
  misc_feature (440)..(440): n is a, c, g, or t
  modified_base (475)..(475): a, c, t, g, unknown or other
  misc_feature (475)..(475): n is a, c, g, or t
  modified_base (486)..(486): a, c, t, g, unknown or other
  misc_feature (486)..(486): n is a, c, g, or t
  modified_base (492)..(492): a, c, t, g, unknown or other
  misc_feature (492)..(492): n is a, c, g, or t
  modified_base (496)..(496): a, c, t, g, unknown or other
  misc_feature (496)..(496): n is a, c, g, or t
  modified_base (504)..(504): a, c, t, g, unknown or other
  misc_feature (504)..(504): n is a, c, g, or t
tcagtgtactactccacgaccggtgctcgatttagtgacatctcgcagttcgtttggggggagaggagcccagcactgggattccgaggtgtttccattcggtgatcagcactgaacacagagactcaccatggtagttttggctgtaggtttgggttttccttgctgacttaattttaaaaggtgtccagtgtgagtgtactggngtagtgtaggaggaggcttgaccgagggccgggggtcctgacgactctcctgtgactacgcctcgtcgggttcaggcgtcaaacgtaaccaaccgagtgagtggtcggcccnccgacgcccacggaggggacggcgtaggagtggtactgtagttagtagaaagtgtaagtggtagaactanaacgtcgaccgacgtacctacggtagaccgggtctactcgaaccncgttacnccgaagacgaactaacgtacaaacgacgtacgtanacgttactaanaacganaacncgacgtanaaacgacggaagacccaacggtctaagttattattagtagttagtatggtagtaccgtccgggtccgtagggcccggtagggtaccgtacggtactacccgtctaccgtaccaccgtccaccccggataacccgg

SEQ ID NO: 137182 - DNA, 661 bp, Homo sapiens
  misc_feature: GYAE6OF02HMVC2.16.39.D06.1.454.CMB.1.raw
  modified_base (235)..(235): a, c, t, g, unknown or other
  misc_feature (235)..(235): n is a, c, g, or t
  modified_base (251)..(251): a, c, t, g, unknown or other
  misc_feature (251)..(251): n is a, c, g, or t
  modified_base (270)..(270): a, c, t, g, unknown or other
  misc_feature (270)..(270): n is a, c, g, or t
  modified_base (285)..(285): a, c, t, g, unknown or other
  misc_feature (285)..(285): n is a, c, g, or t
  modified_base (486)..(486): a, c, t, g, unknown or other
  misc_feature (486)..(486): n is a, c, g, or t
  modified_base (525)..(525): a, c, t, g, unknown or other
  misc_feature (525)..(525): n is a, c, g, or t
  modified_base (537)..(537): a, c, t, g, unknown or other
  misc_feature (537)..(537): n is a, c, g, or t
  modified_base (564)..(564): a, c, t, g, unknown or other
  misc_feature (564)..(564): n is a, c, g, or t
  modified_base (584)..(584): a, c, t, g, unknown or other
  misc_feature (584)..(584): n is a, c, g, or t
  modified_base (642)..(642): a, c, t, g, unknown or other
  misc_feature (642)..(642): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggtagttttggctgagtttgggttttccttgctgctaagttttaaaaggtgtccagtgtgaggttgtacttggtggagtctgggaggaggtcttacgacccgngggccggggggtcccngacgacctctcgtgtgcgngcctcgtcgggttcncgtcgtacgaagtaaaccaaccgtcgtagacgtggtcggtcccgaccgacgcccgtaccggaagggggtacgggcgtaggaggttcggtccttacggtagtttaacgtaggaaagtcgaggttgtagaacctacaattaccgtaccggcctaccgtccggtaggaaccggtccgtaactcccaacactccgtacaacgganaacctaataacccaaagacgacggtaagtaacttctaanaaacgtgaaacnccgactagaacgacggagacaccggtntatatttgattagtagttgnggtttacgtcggtccggctacgggacctgggtaaccgtgttacccgcttaccgcctancctcccgaagccacccggg

SEQ ID NO: 137183 - DNA, 1117 bp, Homo sapiens
  misc_feature: GYAE6OF02HJD48.16.39.D06.1.454.CMB.1.raw
  modified_base (219)..(219): a, c, t, g, unknown or other
  misc_feature (219)..(219): n is a, c, g, or t
tcagtgtactactccacgaccggtgctcgatttagtgacatctcgcagttcgtttggggggagaggagcccagcactgggattccgaggtgtttccattcggtgatcagcactgaacacagaggactcaccagtggtagttttggctgagtttgggttttcctgctgctaatttaaaggtgtcagtgtgacggtgtacttggtggtagtcgtgggaggnggtcttacggacccgacgggcccgggggggtcctaggacaccgttctccgtggtcgacacgtccgttcgttggggtcacggtccgtacgtaacgtaaacctaacccgtaggtacggtagttgggttaccggggtaccccacccgtaccgggtaccccgttaccccggggaaagggggggaacgggggttccgttaagggggtaaggtttccggggttaccttaccgttaaaggttttaacgttaaaggtaaaaacgttgggtaacgttgggtaaccgaaacgtaaccgttaacgttaacccgtaacccgggtacccggttaacccggtttacccgggtaaacggggtaaacccgggggttaccctttaaaccgggtttaccctaaaccccgtacgttttaaaccccgtcccggggaaacgtaaaccggtaaaccctttaaaaccgtttaccccggggaaaaaaaccgttaaacccggggttaacggttaaacccgggttaaactttaacccgttaaaaaccggtaaacgggttaaaccgaaaccccgggtttaaccgtaacccgggtaaaaccgggggttaaaacccggtaaaacccgggaaaccgggttaaccccggggtaacccgggtttaaccccggggttttaaaatttttacgttttaaaacccggtttaaggggttttaaacccgtttaagggtttttaaacggaacgggggttttaacccggggttaaaccggttcccccggggggttaaccccgggggttacgggggtaaccccgggtaaccgggggtttaacccttacggggttaccccccgtaccggttttaccccgtacccggtaccccggttacccggtccccgttaacccccggaacccgggttaaacccccggg

SEQ ID NO: 137184 - DNA, 815 bp, Homo sapiens
  misc_feature: GYAE6OF02HB6UE.16.39.D06.1.454.CMB.1.raw
  modified_base (358)..(358): a, c, t, g, unknown or other
  misc_feature (358)..(358): n is a, c, g, or t
tcagtgtactactccacgaccggtgctcgatttagtgacatctcgcagttctttgggtttttgggagaggagcccagcactgggattccgaggtgtttccattcggtgatcagcactgaacacagaggactcaccatggtagttttggctgtagttgggttttccttgctgctaattttaaaaggtgtccagtgtgaggtgtacgttggtggtagtcgtgggaggaggtcttcgacccgacgggtcccgggggggtccctggacgtacctccgtccgtgtcgacgacgcccgttcggtcgggttcgacgtcggtacgaacgtaaaccaaaccgtacgtgagttacggtggggtccccnccgacgtcccgtaccggaagggggtaacgggtccgtagggtagtacggggtctacgtagttagtaaggtaaaagtgtacgtggtacgactaataacgtcgtaaccggccgtacgtaccggtaaggtaacgggccgtaattcccgaacctacgtccgtaccgaagacgtaacgtaaaccttaacgaaaacgtaccgtaagggttactaaacttaccgttaaacaaaacggttacgaaaacccttcgggaccctaacggaaaaccgggtaaacccggaacggaaaccgtaccgggtaccgttaaattaagtttacgttagttacgttaaagggttattacgggttacgttaaccggttccggcccggtaacgggggaccttaacgggggtacccgttacggtacccgttacccggttaccgtcccgttaccgacggtaccccttacccggaaacccggg

SEQ ID NO: 137185 - DNA, 748 bp, Homo sapiens
  misc_feature: GYAE6OF02HSFMX.16.39.D06.1.454.CMB.1.raw
tcagtgtactactccacgaccggtgctcgatttagtgacatctcgcagttctttgggttttggggaggaggagcccagcactgggattccgaggtgtttccattcggtgatcagcactgaacacagaggactcacatggagttttggctgagttgggtttccttgctgctattttaaaggtgtccagtgtgaggtgtacgttgggtggagtcgtagggaggaggcttcgacccgtagggcccgggggggtccctggacggtacttctaccgtgttgcacgcctcgtcgggttcacggcgtaacaagtaaccaaccgtcgtagtacgtcggtcgggtccgaccgacgcccgtaccgaaggggacgggtacgtaggtaacgtcgggtacgttacgtagttagttaagaaagtggtaacgtggtacgaactaacgaatccgtaacgtaccgacgtccgtaggacgggctaacttacaccgtatccacgaagacgtaactaacgtaacaaacgaacgtacggtataacgtacttaaacaacgtaagacgaacgtccgtaaggaaaccggaaaccgacgggtaacccgaacggttacccttagtttaacttaagtttagtaacgttaggttaacggttaggttaacggttaccgtccgggtcccggtacgggaccggtaaaccgggtaccgttaccggtacccgtcccggttacccttacccgtccggaacgtcccctaacccgtaacccggg

SEQ ID NO: 137186 - DNA, 1000 bp, Homo sapiens
  misc_feature: GYAE6OF02HKOI9.16.39.D06.1.454.CMB.1.raw
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctattttaaaggtgtccagtgtgaggtgtacgttggtggagtctggaggaggcttgacccgaggcccgggggggtcctggacgactctccgtgtgcagtcctcgttcgggttcacggtccgtacaacggttaaccaaacccgtacgtcggtaacgttgggttccggggtacccccgtcccgaacggtccccgttacccgggaaacggggggtaaacgggggtccgttaacggggaaacggttcggggttacccgttaacgttaaacgggtttttaacgttttaaacgggtaaaaaagtttcgggaaaggtttaccggggttaacggtaaaacccgtaaacgttaaaccgttacccggttaacccgggtaaccccggtaacccgtttacccgggtaacggggtaaaaccggggtaccccggttaaacctttacccgtaaacccgtaccttaccccggtttaacccgaaacgggtaaaccgtaaaccttaaaacccgtttaaacccgaaaaacgggtaaacccgtaaacgggttaacgtaaacgtttacctttaaaccgtaaaagtaaccgtaaaaccgtaaccggtaacccggtaacgaaacggaaacccggtaacggtaaccggtaaacccggtaccgttaaattaactttaaggtttacgttaaaggtttaacgggtttaagttaacgggttaacggttaacggttccccggggtaaccccggttcggggtaacccggtaacggggaacccggttaccgggtaaccctaaccccggtttcccgtaacccgtccgtaacccggtcccccgttacccgtaaacccggtaaccccggg

SEQ ID NO: 137187 - DNA, 831 bp, Homo sapiens
  misc_feature: GYAE6OF02F2I7M.16.39.D06.1.454.CMB.1.raw
tcagtgtactactccacgaccggtgctcgatttagtgacatctcgcagttcgtttgggggggagaggagcccagcactgggattccgaggtgtttccattcggtgatcagcactgaacacagaggactcaccatggtagttttggctgtagtttcgggttttccttgctgcttaattttaaaaggtgtccagtgtgtaggtgtacgttggtcggagtctgggaggaggtcttcgacccgagggtccggggggtccctggacgtactccgtcctgtgctacgtcctcgtcggtacagtcgtaccgaagtaaccaacctacgtagtagtcgggtacgggcccgtaccacggcctaccggagggggtacggggtcgtagggtaacggtcgggtactcgtaaggtttagtaacggtaaatgtacggttcggtacgaacgtaactacgttacctaccggtaccgtaccgtccggtaagggtaacggcccgttaaagttaccaacccgttattacccgtaccgtaaggaaccgtaaaccttaaacgttaacccgaaaacgggtaaacccgtaggttaacgaaacgttaaccgttaaaccgaaaagttaccgaaactacgggtacctaagggaaaccgtaaaccgggacggtaaccgaaccggtacgttaacttacgtttagtaacgttaagttaacgtttgtaccgggtttaagttcccggtaccggggtcccgtaggggtacccggttaaacgggacccggttagggtacccgttaaccccggtccgttaccctacggtaccccgttacccggtacccggtaaccccgtaaccggg

SEQ ID NO: 137188 - DNA, 796 bp, Homo sapiens
  misc_feature: GYAE6OF02F7XWK.16.39.D06.1.454.CMB.1.raw
  modified_base (594)..(594): a, c, t, g, unknown or other
  misc_feature (594)..(594): n is a, c, g, or t
tcagtgtactactccacgaccggtgctcgatttagtgacatctcgcaggttcttggggggagaggagcccagcactgggattccgaggtgtttccgattcggtgatcagcactgaacacagaggactcaccatggatttggctgagttgggttttccttgctgactattttaaaaggtgtccagtgtcgaggtgtacttggtggagtcgtggaggacgcttgacccagccgggggggttccctggagtactctccgtgttgccacgccttacgtcgggttcacggtcgtcaacggtaaccaaccctacggtgagtcggtcgggtcccgaccgagcccgttaccgaggggtaacggggctagggaactcggggtcacgtgtttaacgttagtaaaacgtgtacgtggttacggactaacgtactcgtaccggtaccacgtccggtaggtaacgggcctaagttaccacccgtatcctaccgaatacggtaacctaacgtttacccaaagggaaccgaacgggtttacaaagtttacctaacgtaaaatcggttaaaccagtacccgtaagggtaaccgaaaccggaacgggaccnccgggtaccgttaaacgtactttacgttagggtttaaaccaggggttttaaacgtcgggtttaggttaaaccgttcccggggtacccgttagggggggacccgttaacggggaaccccgggtttcgtaacccggtaaccggttcccgtttaccgttccccggaacggttcccccgttaacggaaccccgggtaaacccgggg

SEQ ID NO: 137189 - DNA, 747 bp, Homo sapiens
  misc_feature: GYAE6OF02GEPB1.16.39.D06.1.454.CMB.1.raw
  modified_base (237)..(237): a, c, t, g, unknown or other
  misc_feature (237)..(237): n is a, c, g, or t
  modified_base (549)..(549): a, c, t, g, unknown or other
  misc_feature (549)..(549): n is a, c, g, or t
  modified_base (556)..(556): a, c, t, g, unknown or other
  misc_feature (556)..(556): n is a, c, g, or t
  modified_base (712)..(712): a, c, t, g, unknown or other
  misc_feature (712)..(712): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagttttggctggtagttgggttttccttgctgtcttattttaaaaggtgtccagttgtgaggttgtacttgggtggtagtctggtaggaggtcttgaacccgnggcccgggggggttcctgacgactctccgtgtcgcacgccttcgtgggtcagcgtataacgtaaccaaccgtagtcgtagtgggttccggtccgaaccgccgtcccgtaccggacgggggaacggggtccgtagggtaagtcgggttacctacgtagtttaagttaagaaaacgtggtaagttcgggtacaacctaacgacttactacggacctccgtacgtacggaacggaccgtacgttccaccctataccgtaccgagtaaccgaactaaccgttaaccgaacgaaacgtcgggtaataacttacgtanaaacgtntaacgtacgtctaacggacgtaaccggacggaacgttaccgtaacgttattagttaacgttacgtttaagttagttaggttaggttcggttaccggttaccgggtcccggtacgggttcccgggtaacggtaccggtcggtacccgtacggttccnccggttaccgcgtttccccgacgtaacccgtccgg

SEQ ID NO: 137190 - DNA, 733 bp, Homo sapiens
  misc_feature: GYAE6OF02IIIZY.16.39.D06.1.454.CMB.1.raw
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctgggaggaggcttgacccaggccggggggtcctgagactctcctgtgcagctcgtgggttcagcgtcagtaaccaaccacgtgatggtcgggtaccggccacgtccctcccggaaggggaacggggctagggaattcggggtactcgagtttagttacgaaaagtgagtggtagaacactaactactaccggacctacgtacggtaggaacggggcctaacgttccgaaccctagtaccaccgaacgaacgtacctaaaacttccccgaaaaagaaccgtacggttacgaaacttccgttaaaccaaagtaacgaaacgacgtacccgtaagaacgggtaaacccgagggaccctaaccgggtaccttaaagttacgttttacgttagttaaacgttagggtttacgtgggttaacgttacgggttcccggggaccccgttgggggaccgtaaccgggtccgggttagtacccgtaccggttccgtaccctccggtaacccgtccctacccggaccgtaacccggg

SEQ ID NO: 137191 - DNA, 811 bp, Homo sapiens
  misc_feature: GYAE6OF02GTE87.16.39.D06.1.454.CMB.1.raw
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgcttaatttaaaaggtgtccagtgtgaggtgtacttggtggagtctgggaggaggcttgacccgagggccggggggtccctgacgactcctccgtgtgcgacgtcctcgtcggttcagccgtacgaacgtaaaccaaccacgtagagtggtcgggtcccgaccgacgcccgtaccggaggggacgggcgtaggagtcggtctgtagttactagaaagtgtaagtggtagacaactacgtactacgccgtactccggtagacggtcctactacacgactctacgagacgactaacgttaaccaacggtaacgacggtacgtaacgttaccgtaaacgtaaacgttacgtaaaccaccggtaaccgtaacggaaaccggtaaacccggaaacggggtaaccggtaacccggggttaaccgtttaaacggtttaactttttaacgggtttaacgtttaaacgggtttaaggtttaacgggtttacggggtttaggttaaccgggtttccccggggtaacccccgggtttcggggggaacccggttaaccgggggttaacccggttccggttaacccggttacccgtttacccggtaccccggttacccgtacccggttacccccgttaacccggtaaaccccgggg

SEQ ID NO: 137192 - DNA, 683 bp, Homo sapiens
  misc_feature: GYAE6OF02ID7S6.16.39.D06.1.454.CMB.1.raw
  modified_base (227)..(227): a, c, t, g, unknown or other
  misc_feature (227)..(227): n is a, c, g, or t
  modified_base (241)..(241): a, c, t, g, unknown or other
  misc_feature (241)..(241): n is a, c, g, or t
  modified_base (301)..(301): a, c, t, g, unknown or other
  misc_feature (301)..(301): n is a, c, g, or t
  modified_base (321)..(321): a, c, t, g, unknown or other
  misc_feature (321)..(321): n is a, c, g, or t
  modified_base (386)..(386): a, c, t, g, unknown or other
  misc_feature (386)..(386): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccagtggagttttggctgtagttcgggttttccttgctgtctaagttttaaaggtgtcagtgtgtaggtgtacgttggtggagtcgtgggaggnggtcttcgacccgngggccggggggtccctgagctcgtcctgtgcagcctgtggtcagtcgtacaagaaccacncgtagtgtcggtcgggtccnccacgcccgtacggagggggacgggtgtagggtagtcggtctattagttagtagaaatgagtganaacactactccgtacgccgtacgtcggacggtaacggcctactacccactactccacgaagactaacctactaaccgaaacgacgtaacggtagtaacttctaaactaagtaacgaaccgacgtaccgtaaggaaacggaaccggaacggacccgtaacgggtaccttaagttactttaagttagttaaggttaggttggttagggttacgtaccggttccgggtccgggtacggggaccggtacgggtaccggtacggtcctccgtccgtcctaccgaccgtcccgtaccgaccgg

SEQ ID NO: 137193 - DNA, 797 bp, Homo sapiens
  misc_feature: GYAE6OF02FJF5B.16.39.D06.1.454.CMB.1.raw
  modified_base (397)..(397): a, c, t, g, unknown or other
  misc_feature (397)..(397): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggagtttggctgagttgggttttccttgctgctatttaaaggtgtccagtgtgaggtgtacgttggtggagtcgtgggaggaggtcttgacccacgggtccgggggggtccctggacgtacctcctcctggtcgcacgtcctcgtgggttcagcgtcagttaaccaaccacggtgagtggtgggtcccgcctacgccctccgaggggaacgggctaggaactggggtactcgtagtttaagttagaaatggagttggtanaccgtactaacgttcgaccggcccgtaacgtccggtaacggaacgggtccgtacttaccaccgtactacctaccgaagacgtaacgtaacttaccgaaaacggtaccgtaaaccggtagtaaacccgttcgttaaacgaaacgttacgaaaccgtaacggcccttaacgggaaaccggtaaaccccgggaagggtaacccgtaaccggggtacccttaagttaaacgttttaccgttaagttaaacgttaagggttttacgtaaggggtttaccggttacggttaccccggggacccggtttcgggggaacccgttaaccggggggtaacccgttacgggttacccttaccccggttcttaccccggtacgaccgttaccccgtacccgtaaaccccggg

SEQ ID NO: 137194 - DNA, 901 bp, Homo sapiens
  misc_feature: GYAE6OF02GAP7Y.16.39.D06.1.454.CMB.1.raw
  modified_base (201)..(201): a, c, t, g, unknown or other
  misc_feature (201)..(201): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctaattttaaaggtgtcagtggtgaggtgtacttggnggagtctggaggaggcttagacccgagggccggggggtccctgacgactctacctgtgcacgtcctacgttgggttacaggtcgtacaaggttaaaccaaccgacgttacgagtggttacgggtcccgacccgtagcccgttaccgggaggggtaaggggtacctaggggaaacgttcggggtaccttacgtaagtttacgttaagtaaaaacgttcgaagttggtacgaacctaagtaacttacgtaaccgcccgtaacgtcccggtaaggaaacggggtccctaatttacccgaaccctagtttacccgaacgtaagtaacgaaaccgtaaacgtttaacccgaaaacggtaaccgtaacggttaaacgtaacttaccgttaaaccgtaaaacggtaccgaaacccgtaagggtacccgttaaacggaaaccggaaaccggttaacgggaaccccgtaaaccggggttaacccgttaaaatttacggttttaaacgttacggttaaaaggttaacggggttttagaaccgggggttttaacggttacccgggtttacccgggacccccgggttaagggggtaacccggtaaacgggggtttaaaccccggtcggttaaaccccgtcccggttaacccttacccggtaaccccgtacccggtaacccccgttaccccgggaaaccgttaaaccccgggg

SEQ ID NO: 137195 - DNA, 777 bp, Homo sapiens
  misc_feature: GYAE6OF02HADG3.16.39.D06.1.454.CMB.1.raw
  modified_base (371)..(371): a, c, t, g, unknown or other
  misc_feature (371)..(371): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaggtgtccagtgtgaggtgtacttggtggagtctgggaggaggcttgacccgaggccggggggtccctgagactctcctgtgcgacgcctcgtcggttcagcgtcagtaacaaccgacgtgatggtggccgccagccgtccgagggagggctaggaagtgggtactcgtagttagttagaaagtgagtggtanaacaacgaatactaccggaccgtacgtccggtaggaacgggtccgtaacgttccaccgtacttaccgtaccgaagtaacgaacctaaacgttaacccaaaacggtaacccgtaacggttacgtaaacgtttaccgttaacgaaaattacggaaacccgtacgtaccggttaagaaccggtaaaccggtaacgggaaccgtaaccggggtaccgtttaaagtttaacgtttaagtttacgtttaaacggtttaggtttaaacgtttaggggttaacggtttaaccggtttcccggggaccccggttacggggggaacccgttaacgggggtaacccggttacggtacccggtaccccggttaccgttccccgtacggacccggtaccccgttacccgtaaacccggg

SEQ ID NO: 137196 - DNA, 805 bp, Homo sapiens
  misc_feature: GYAE6OF02F6QZ0.16.39.D06.1.454.CMB.1.raw
  modified_base (147)..(147): a, c, t, g, unknown or other
  misc_feature (147)..(147): n is a, c, g, or t
tcagtgtactactccacgaccggtgctcgatttagtgacatctcgcagttctttgggggggagaggagcccagcactgggattccgaggtgtttccattcggtgatcagcactgaacacagaggactcaccatggagttttggctgngttgggttttccttgctgctaattttaaaaggtgtccagtgtgaggttcgtacttggtggagtcgtggaggaggtcttgacccgacggccgggggggtccctgagtacctcgtcctggtgccgtacgtccgtccgtgggttcacggtcgtacgacgtaaccaacctaacttgagtggtcgggtcccgccgtacgcctaccggacggggaagggtccgtaggaagtcgggtctctagttaagtataaaagtgagtaggtacgacgtaactaacgtcgtaccgaccggtacgtccggtacgggaacgggtcccggtaacttacccacccgttaacttccctaaccggaagtaccggtaaacctaacgtttaccgaaaacggaaccgtaacggttacgtaacgttacctaacgaaacgtaacgaaaccgtacgtaccgtacgtaacggaaacccggtaacggaccgtaaccggtaaccgttaattaaacgtttggtttaacggttaaggtttaacggtttaaggttacgggttaaggtaccgggttttacccgggtaccccgtcggggggtaaccgtaaacggggtacccggttaccggtacccgtaccggttccgtcccgttaccggacccgtccccgtaaccgtaccccggtaacccgg

SEQ ID NO: 137197 - DNA, 711 bp, Homo sapiens
  misc_feature: GYAE6OF02HTFYP.16.39.D06.1.454.CMB.1.raw
  modified_base (184)..(184): a, c, t, g, unknown or other
  misc_feature (184)..(184): n is a, c, g, or t
  modified_base (390)..(390): a, c, t, g, unknown or other
  misc_feature (390)..(390): n is a, c, g, or t
tcagtgtactactccacgaccggtgctcgatttagtgacatctcgcagttcgtttggggggagaggagcccagcactgggattccgaggtgtttccattcggtgatcagcactgaacacagaggactcaccatggagttttggctgagttggtttcctgctgctatttaaaggtgtcagtgtgnggtgtagttggtggagtcgtggaggaggcgttagacccgagggccggggggtccctggacgacttcctccgtgtcgcgagtcctcgtggttcagtccgtcgagtaacaaccgacgtgtagtggtcgggtccgccgagcccgtccgaggggaacgggcgtaggaagttgggtctacgtagtttagttaagaaagtcgtaatgggtanaacgtactaagtcgtaaccgccgtaccgtccggtagggaacggtacctagttccaaccgtacgtcctaccgtaacgacgaacctaaacgtaaccgaaaggaccgtaacggtagaaacttccttaaacgaaagttacgaaacgcgtaccgttaggaaacgtaacccgggaggtaaccgacggtaccgttaatcgtttattaggtaatttacggtagttgggttaacggttaacgttccccgggtaccgtaggggacccgttaggggtaaacctggtaacctcccgttactccgtaccgacgtcccctacaccggaacccggg

SEQ ID NO: 137198 - DNA, 748 bp, Homo sapiens
  misc_feature: GYAE6OF02FGBJI.16.39.D06.1.454.CMB.1.raw
  modified_base (557)..(557): a, c, t, g, unknown or other
  misc_feature (557)..(557): n is a, c, g, or t
tcagtgtactactccacgaccggtgctcgatttagtgacatctcgcagttctttgggttttggggagaggagcccagcactgggattccgaggtgtttccattcggtgatcagcactgaacacagaggactcaccatggtagttttggctgagttgggttttcctgctgctaatttaaaggtgtccagtgtgaggtgtacgttggtggagtctgggaggaggtcttcggaccccgtacggggtcccgggggggttccctggacgtaccttcctccgttggttgccgacgtcccttcgttgggttccaggtccgtctaacggtaaccaaccgtacgtgagttcggtcgggtcccgcctacgcctaccggaggggtaacggggtctaggaaggtgggtctcgtaagtttattagaaaagtcgagtcggacgtacaacgtactacgtaccggccgtactccggtaggaacgggtcctacttaccgactactccgtacgagtaacgtactacgttaccgaaaacggaccgtaacggttactaacttactaaaccgttaaanaccgtaactacggcctaaagggacgtaaacggacgtaccgagggtaccttaagttaattacggttacgtaatttacggttagttacggggttagttaccggtaccgggtcccggtcggggaaccgtaacggggtcccggttggaccccttacgggtcctaccgtcggtacccctaccggtaccaacccggg

SEQ ID NO: 137199 - DNA, 714 bp, Homo sapiens
  misc_feature: GYAE6OF02H9TO2.16.39.D06.1.454.CMB.1.raw
  modified_base (259)..(259): a, c, t, g, unknown or other
  misc_feature (259)..(259): n is a, c, g, or t
  modified_base (307)..(307): a, c, t, g, unknown or other
  misc_feature (307)..(307): n is a, c, g, or t
  modified_base (314)..(314): a, c, t, g, unknown or other
  misc_feature (314)..(314): n is a, c, g, or t
tcagtgtactactccacgaccggtgctcgatttagtgacatctcgcagttcgtttggggagaggagcccagcactgggattccgaggtgtttccattcggtgatcagcactgaacacagaggactcaccatggagtttgctgagtttgggttttcctgctgcttaagtttaaaggtgtccagtgtgaggtgttacgtggtggagtcgtgggaggaggtcgttcgaccgacgggccgggggtcctgacgacctctcgtgngcacgctcgtggttcagcgtcacgtaacacagtgagtgtcggccgccncgtaccnccgagggacggcgtaggagtcggtctacgtacgttagtagaaatgtagtggactaacacgataccgccgacgtacgtacgtaaggaaccggctaactaccaccgtctaccgtacaagacgtaaactacgtaacccgaaagaaccgtaggtataacttacgtaactaaagaccgaacgaccgttagacgttaagggaaacccgtacgaccggttaaccgactttacgtaacgtttaagtaccgttagtaaacggtttggacgtttttaacgggtccgttaccccgggtaccgttcggggaacccggttaaacgggttaccggtccccggttaaccgtaccccggttttcgacccgtaccggttaccccgaacccgttaccccgaaccccggttaacccggg

SEQ ID NO: 137200 - DNA, 763 bp, Homo sapiens
  misc_feature: GYAE6OF02IA42Z.16.39.D06.1.454.CMB.1.raw
  modified_base (429)..(429): a, c, t, g, unknown or other
  misc_feature (429)..(429): n is a, c, g, or t
  modified_base (437)..(437): a, c, t, g, unknown or other
  misc_feature (437)..(437): n is a, c, g, or t
tcagtgtactactccacgaccggtgctcgatttagtgacatctcgcagtttctttgggttttgggggagaggagcccagcactgggattccgaggtgtttccattcggtgatcagcactgacacagaggactcaccatggtagttttggctgtagttgggttttccttgctgtacttaattttaaaggtgtccagtgtgaggtgtattggtggagtcgtgggaggaggcttgaccccgagggcccgggggggttccctaggagtacctctccgtgtcgcacgccttcgtcgggttcacgtcgtacaacgtaaaccgaaccgtacgtagtatcgggttccgggtccgacccgacggtaccccgtaccggaagggggaacggggcgttaagggagttcgggtacctacgtagttatagaaaatgagtgganaacactanacctcgaccgctcggaaggacgggtacctagtccacgactacgaccgagacgtaacctaacgttaccaaacggaaccgtacggtaaacgtactacgttaacaaacgttacaacgtagtacctacgggaaacgtaccgggaacgacccgaacggttactacgttaagtttacgtttaaggttacggtttaaggttaggtacgggtttacggttaaccgggttccccggggtacccgggtacgggggtaacccgtaccggggtaccggttaccggtacccgtacccgtcccgttcccgacggtacccgtaccctacccgtaacccggg

SEQ ID NO: 137201 - DNA, 674 bp, Homo sapiens
  misc_feature: GYAE6OF02HKTDV.16.39.D06.1.454.CMB.1.raw
  modified_base (306)..(306): a, c, t, g, unknown or other
  misc_feature (306)..(306): n is a, c, g, or t
  modified_base (371)..(371): a, c, t, g, unknown or other
  misc_feature (371)..(371): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctattttaaaggtgtccagtgtgaggtgtacttggtggagtctggaggaggcttgacccaggccgggggggtccctaggagacctctcctgtgcagcctctgggttcagcgtcacgtaacaaccacgtcgagtggtggtccnccagcctaccgagggacgggctggaagtcgggtctcgtaagttattagaaaattggatggtgaanactaatctacgccgtacgtccggtagaacggccgtattccgactacgtctaccaagacgtacgaacttaccgaaacgaacgtaaccgggtaagtaaacgttacttaaccaaagtagtaaacgagtacccgtaaggaaccgaaacccggtacggaaccgacggaccgttataacgtttaagttgttaacgttaggttacgtaggttacggttaacgttccgggacccggtcgggtaccggtacggtaaccggtcggtaccgacccgttctaccgtccgacgtacccacccgtaccgaacccggg

SEQ ID NO: 137202 - DNA, 836 bp, Homo sapiens
  misc_feature: GYAE6OF02FKDDX.16.39.D06.1.454.CMB.1.raw
  modified_base (197)..(197): a, c, t, g, unknown or other
  misc_feature (197)..(197): n is a, c, g, or t
  modified_base (549)..(549): a, c, t, g, unknown or other
  misc_feature (549)..(549): n is a, c, g, or t
  modified_base (625)..(625): a, c, t, g, unknown or other
  misc_feature (625)..(625): n is a, c, g, or t
tcagtgtactactccacgaccggtgctcgatttagtgacatctcgcagttctttgggttttgggagaggagcccagcactgggattccgaggtgtttccattcggtgatcagcactgaacacagaggactcaccatggagttttggctgagttgggttttcctgctgcttaatttaaaggtgtccagtgtgaggttntacgttggtggatcgtgggaggaggtcttgacccgagggtcccgggggggtacccttggacgtaccgttcctcctgtcgcacgtccgtcgttcggaacttcctacgtttaggcgtacctatcgccgtaatggaacgtccgttacggggtcccgtaccgacggtacctaccgggaacggggtaaggggtctaagggtaacggttgggttcccttaagtaacgtacttaaccgaacgaagaccgtaagttacggtaacgtaccgcgtagttacggacctacgtaggtaccgttcggtacgggtaaaccgggttccctttaaccgaccgtttactcccctaacgtaacgggtaanaaaccgttaacctaccgaaacgtaacccgtaccgtacgttacgtttagttaaccgtaaagttaacgacggttaacncggtttacgtaagggaacggttcgtaaccgggacggttaaccgtacccgggaactttaaaccggttagtttaaccgttacggttacggtaaacggtaccggtaaacgggttacgggttaacggggttcggtttacccgggaacggttccggttaacgggttaccgttaacccgggtttaagtttaccgggtaaccccgtttaaccgggggg

SEQ ID NO: 137203 - DNA, 784 bp, Homo sapiens
  misc_feature: GYAE6OF02JNC84.16.39.D06.1.454.CMB.1.raw
  modified_base (316)..(316): a, c, t, g, unknown or other
  misc_feature (316)..(316): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctgggaggaggacttgacccgaggccgggggggtccctgacgacctctcctgtgcagtcctgtcgggttcacgcgtcaggtaaccaaccgtacgtgagtggtcgggtccncacgccgtaccggaggggaacggggcgtaggtaagtcgggtcgtcgtaagtttagtaggtaaaagtagtagtggtagtacgaacaagtacctaccggccgtaacgttccggaacggacgggacccgtaagttaccaacctcgtacctacgaggaacgacctaaagttaaccgaaacgaaaccgtaagggtaactaacttaccgttaacaaacgttaccggaaacaaccggtacccgttaacggaaccgtaaaccggaacggtaaccgtaacccggggaacccgttaaattaacggtttaactttaaggttaaagtttaacgggttaaagttacggggtttacggtaaccggtttaccggggacccccggttagggggaacccccggttaagggggacccgggttcggttacccgacccggtttcacccggttaccgaacccggcccttaccccggaccggaacccggg

SEQ ID NO: 137204 - DNA, 748 bp, Homo sapiens
  misc_feature: GYAE6OF02GRX9J.16.39.D06.1.454.CMB.1.raw
  modified_base (311)..(311): a, c, t, g, unknown or other
  misc_feature (311)..(311): n is a, c, g, or t
tcagtgtactactccacgaccggtgctcgatttagtgacatctcgcagttcctttgggtttggggagaggagcccagcactgggattccgaggtgtttccgattcggtgatcagcactgaacacagaggactcaccatggagtttggctgagttgggtttccttgctgctattttaaaggtgtccagtgtgagtgtacttggtggagtcgtggaggaggcttcgaccacggccgggggggtccctggacggactctccgtgtcgcagtcctcgttacggggttcacgcgtacacggtaaccaaccgacgtntagtcggtgggtccgtaccgacggtcccgtaccgaagggggtacggggtacgtacggaaggtcgggttacctagtacggtttaagttacggaaaaagttcggaagttacgggtacgaaccgtaacgtaaccgttcgtaaccggtccgtaaccgtccggtagggaaaccggggtccgtaacgttaccaccgtactccgtaccgaacgtacgaactaacgttacccgaaacgaaactacgggtaacgtataaccgttacaaacttacgaactacgtccgaacgaacgtaaccggacgacgaccggtacgtaattattagttagttataggttacgtagttacggtagttcccgggaccggtcgggtaccgaaccggggttaacggtcggtacccgttacggtacccgttaccgccgtacgtaccgtacccgtaacccgg

SEQ ID NO: 137205 - DNA, 598 bp, Homo sapiens
  misc_feature: GYAE6OF02HAYMA.16.39.D06.1.454.CMB.1.raw
  modified_base (269)..(269): a, c, t, g, unknown or other
  misc_feature (269)..(269): n is a, c, g, or t
  modified_base (299)..(299): a, c, t, g, unknown or other
  misc_feature (299)..(299): n is a, c, g, or t
  modified_base (303)..(303): a, c, t, g, unknown or other
  misc_feature (303)..(303): n is a, c, g, or t
  modified_base (310)..(310): a, c, t, g, unknown or other
  misc_feature (310)..(310): n is a, c, g, or t
  modified_base (420)..(420): a, c, t, g, unknown or other
  misc_feature (420)..(420): n is a, c, g, or t
  modified_base (437)..(437): a, c, t, g, unknown or other
  misc_feature (437)..(437): n is a, c, g, or t
  modified_base (442)..(442): a, c, t, g, unknown or other
  misc_feature (442)..(442): n is a, c, g, or t
  modified_base (450)..(450): a, c, t, g, unknown or other
  misc_feature (450)..(450): n is a, c, g, or t
  modified_base (454)..(454): a, c, t, g, unknown or other
  misc_feature (454)..(454): n is a, c, g, or t
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtcgtgggagggaggcgttgacccgaggccggggggggtccctggagactctcctgtgcagcctntgggttcaggcgtcagtaaccaaccacgtnatgngggtccncagcctcgaggggaagggctaggaagtgggtctctagttattagaaaatgagtggtagacacaatctacgccgtactcggagaacgggccgtattccacatcctcagaanactaactaccaagaacnggtanaatctaanaaanacgaacagctagaagaccgagacgacgacgtatatagtagtagttagtagtggtagttaacgttcgggcccgtcgggaccgtacgggtaccggtggtacccgacggttcccgttcgcgtaccgccctaccgacccgtaaccggg

SEQ ID NO: 137206 - DNA, 866 bp, Homo sapiens
  misc_feature: GYAE6OF02H1Q68.16.39.D06.1.454.CMB.1.raw
  modified_base (218)..(218): a, c, t, g, unknown or other
  misc_feature (218)..(218): n is a, c, g, or t
  modified_base (228)..(228): a, c, t, g, unknown or other
  misc_feature (228)..(228): n is a, c, g, or t
tcagtgtactactccacgaccggtgctcgatttagtgacatctcgcagttctttgggggggagagggagcccagcactggggattccgaggttgtttccattcggtgatcagcactgaacacagaggactcaccatggagtttggctggagtttgggttttcctgctgtactatttaaaggtgtccagtgtgagtgtactggtgagtctggaggagtnttacgaccgngggcccgggggggtcctaggacgtacctcttcgtgtacggcacgtctcggttgggttcgacggtccggtacaacgttaaccaaccgtaggtagtacgtcgggtccgggtcccgaccgtaaccgtcctaccgggaagggggtacggggaccgttagggtaacggttacgggttacctagttaagggtttaaattaacggaaagttggttaacggtcggggtaactaacctaaccggtaacgtaccgtaccggtaaccggtccgtacgggtacggaacggggtcctaacgttccgtaacctcgtaccgtaaccgtaggaactaaacctaacgtttaaccgtaaaacggaacccgtaaggttaactaaacgttctaaaccggaaaattaccggaagtaccgttaacggaccggaaacgggtaaacccggtaggtaaacccgtaccggggttaaaccctttacgtaaccgtttttaacggttagttaaaccggttaacgggttttaaggttacccgggttaagggtttaccccgttacggggtaccccgggtacggggtaacccggtacgggtacccggtacgtacccggtaaccgtcccttacccgtagacccgtaccctaccccggtaacggaaccccgg

SEQ ID NO: 137207 - DNA, 864 bp, Homo sapiens
  misc_feature: GYAE6OF02IDO8U.16.39.D06.1.454.CMB.1.raw
tcagtgtactactccacgaccggtgctcgatttagtgacatctcgcagttcgtttgggggagaggagcccagcactgggattccgaggtgtttccattcggtgatcagcactgaacacagaggactcaccatggtagttttggctgagtttgggttttccttgctgctagttttaaaggtgtcagtgtgaggtgtacgttggtggagtcgtggaggaggcttcggacccgacggccgggggggtccctaggacgtactcctcctggtcgacacggcctcgtagggttacaggtccgtcaacggtaaaccaaccgaacggtgtaacgttggtacggggtcccgtacccgaacgtccttaccccggaaagggggtaacgggggtccgtaagggaaacggttcgggttacctacgtaacggtttaagttaaggaaaaagtttcggaaggttggtaacgaactaaccgtaaagttccgtaaccggacccgtaccttaccgggtacggaaacggggtacctaacgtttcccgaaacccgtagtacccgtaccgtaagaaccgtaaactaaacgttaaccccgaaaaggtaaacccgtacgggttaaacgaacttaccttaacgaaaagttaccggaaaacgtaccgtaccgtaaggaaccgtaaaccgggaaggtaaccgaacgggtacccgtttaaataagtttacgttaacgttaacgtttaagggttacgtagggtttaaccggtaacgggttcccggggtaaccccgggttaggggaacccggttaaacgggtacccggtcggttaacccaccgggtttcccaccttccggaacgtacccccgaccggtaacccggtaacccggg

SEQ ID NO: 137208 - DNA, 782 bp, Homo sapiens
  misc_feature: GYAE6OF02JJ1X5.16.39.D06.1.454.CMB.1.raw
tcagtgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgtactattttaaaaggtgtccagtgtgaggtgtacttaggtggacgtctggaggacggcttcgacccgaggccggggggtccctggagtacctccgtccgtagtcgcagtccgtcgtggttccagccgtcgagtaaccaaccgacgtgagtcgtgggtcccgacaggtcccctacggaaggggtaacgggcgtacggtagtcggtcgtcctagttagtagaaatcgtagtggtcggaacaactacgttacgtaccgacgtacgtccggtacgaacggggcctaacgttccgaacctaactccgtaaccgacgaacgtaactaaccgttaaccgaacgtaaacgtacggtagtaacttacttaacgaaagtacgaacacgtaccgtaagtaacgaaaccggaggacccgtaaccggtacgttaacgtttaacgtttaacgttacgtttaaagtttaacgggtttacggttaaggttacgggttaaccgtttcccgggggaacccggttaccgggggtaaccgtaaaccggggttaccgggttaacgtaccccggtttaaccgtccgtttaacccgtccgtaaccgtaccccgtttacccggaacccgttaaaccccgggg

SEQ ID NO: 137209 - DNA, 679 bp, Homo sapiens
  misc_feature: GYAE6OF02G10BR.16.39.D06.1.454.CMB.1.raw
tcagtgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgcttaattttaaaaggtgtcctagtgtgaggtgtacttggtggagtctgggaggaggcttgacccagggtcccggggggtccctgacgactctcctgtgcacgtcctcgtggttcagtcgtcagtaaccaacacgtgtatggtacggtccgcgacgcccgtaccgaggggaagggtccgtaggtaacgtcgggtctacgtagtttaagtagaaaacgttgaggtggtagaacactaatctaccgccgtactccgtaggaacggtaccgtactaccacctacgtcctaccgagaataacctaattaccaaagaactacggtactaacttacctaaacaagtacgaactagaccaggaccgaaacgacggacgtacggacgttaattagttagttagtaacgtttagttaaggtggttaggttaccgttaccggggtcccgaggggtaccgaacgggtaccggttacggaccgtcccggttacctccggtacacccggtcgaccctaaccggg

SEQ ID NO: 137210 - DNA, 753 bp, Homo sapiens
  misc_feature: GYAE6OF02HZIOE.16.39.D06.1.454.CMB.1.raw
  modified_base (271)..(271): a, c, t, g, unknown or other
  misc_feature (271)..(271): n is a, c, g, or t
  modified_base (558)..(558): a, c, t, g, unknown or other
  misc_feature (558)..(558): n is a, c, g, or t
  modified_base (565)..(565): a, c, t, g, unknown or other
  misc_feature (565)..(565): n is a, c, g, or t
tcagtgtactactccacgaccggtgctcgatttagtgacatctcgcagttctttgggttttggggagaggagcccagcactgggattccgaggtgtttccattcggtgatcagcactgaacacagagactcacatggtagttttgctgtagttgggttttccttgctgtacttaagttttaaaaggtcgttaccagtgtggtaaggtagttcgttagggtggtagtcgttggaaggaggtcgttcgacccgaggtacccggggggttcccnggacgtactacgtacgtcgtgacagtccttacgttgggttacaacggtcgtacgtaaagtaacctaaccgacgtagtagttaacggtcgggtacccgacctacgcccgttacggaagggtaacggggcgtacggaagtcggtctagtatttaagataaaagtgtagtagacgaactacgaactacgaccgcaaccgtcggacggaacggacgtatacccacactcgtaccgaagaactaagtaacgttaaccaaacgtaacgagtactactacttaacaaaacttanaacgtanaccggtagaaacgaccggaacgtaaccgaccgtaaccgtaattaacgtaactttaaggttaaagttagttaaggttacgttacggttaccggtacccgggtacccgtagggtacccgttaaacggaccggttacggaccgtacccggttccgttaccgaacgtaccccgtacgtaacccgtaacccgg

SEQ ID NO: 137211 - DNA, 764 bp, Homo sapiens
  misc_feature: GYAE6OF02I41PN.16.39.D06.1.454.CMB.1.raw
  modified_base (271)..(271): a, c, t, g, unknown or other
  misc_feature (271)..(271): n is a, c, g, or t
  modified_base (312)..(312): a, c, t, g, unknown or other
  misc_feature (312)..(312): n is a, c, g, or t
  modified_base (716)..(716): a, c, t, g, unknown or other
  misc_feature (716)..(716): n is a, c, g, or t
tcagtgtactactccacgaccggtgctcgatttagtgacatctcgcagttctttggggggagaggagcccagcactgggattccgaggtgtttccattcggtgatcagcaactgaacacagaggactcaccatggtagttttgctgagttgggttttcttgctgctatttaaaggtgtcagtgtgagtcgtactggtgagtctggaggagcttgaccgagggccggggggtcctggacgaccttctccgtgtcgcacgtcctcgtgggtcncgcgtcgagtaaccaccgtacgtgacgtcggtagggtcccnccgtacgcccgttcggaacggggtaacggtctagggtatcgggtccgttctagttagtaagaaacttggtagtacggtagacctaacgactccgtaaccgcgtaccggttcgcgggtaaacggccgtacttacccgactacttcgcaagaccgtaatacgtacaaaacgacaacggttagacttaacgttacaaacgttacgaaacgttccacgtaccgaagtaaaccccgtgggaaaccgaacccggttacgtaacgtttaagttttaaaccgttcgtttaaacggttaacgggtttttacgtacggggtttaagggtttaccccggcgggggttacccccggtaggggggtaaccccggtaacggggttaacccggttccggggtaaccgttaccccggttntccccggtaaaccgtacccgggtacccttaccccgggaaccgtaccgg

SEQ ID NO: 137212 - DNA, 756 bp, Homo sapiens
  misc_feature: GYAE6OF02IR5U0.16.39.D06.1.454.CMB.1.raw
  modified_base (190)..(190): a, c, t, g, unknown or other
  misc_feature (190)..(190): n is a, c, g, or t
  modified_base (193)..(193): a, c, t, g, unknown or other
  misc_feature (193)..(193): n is a, c, g, or t
  modified_base (271)..(271): a, c, t, g, unknown or other
  misc_feature (271)..(271): n is a, c, g, or t
  modified_base (291)..(291): a, c, t, g, unknown or other
  misc_feature (291)..(291): n is a, c, g, or t
  modified_base (467)..(467): a, c, t, g, unknown or other
  misc_feature (467)..(467): n is a, c, g, or t
tcagtgtactactccacgaccggtgctcgatttagtgacatctcgcagttcgttttgggttttggggagaggagcccagcactgggattccgaggtgtttccattcggtgatcagcactgaacacagaggactcaccatggtagttttggctgtagttgggttttccttgctgacttaagtttaaaggtntcngtgtgaggtgtacgttggtgagtcgtggaggagcttacggaccgagggccggggggtcctggacgtctctcgtgtgcngtccgtcgtggttcagcgtnaacgtaaccaacgacgtagtacgtggtcgggtccgccacgccgtaccggaaggggaacgggcgtagggaatcgggtctacgtaagttagtaaggtaaatggtaacgtggtacgaaccattaacgtcgtacgccgtacgtcgtagggaaacggtcacttaccgaacctgtacccganaacggactaacaaacttccgaaaggaacctaacggtacgtaaacttctaaaccgaaagttacgaacacggtaccgtacaaaccggtacggaaacgggccgtaaccggttctaaatttacggttacgttaagtagtttaaacggttggtaaaggttccgggttaaacgtttcccggggtaaccccggtgggggtaaacccgaacgggggtttacccgaccgggttacccggttaaccccgcggttaaccccttcggtaaccccggtacccgtaaccccgtaaaccccggg

SEQ ID NO: 137213 - DNA, 750 bp, Homo sapiens
  misc_feature: GYAE6OF02G9DUM.16.39.D06.1.454.CMB.1.raw
tcagtgtactactccacgaccggtgctcgatttagtgacatctcgcagttctttggggggagaggagcccagcactgggattccgaggtgtttccattcggtgatcagcactgaacacagaggactcaccatggagttttggctgagtttggttttccttgctgcttaattttaaaaggtgtccagtgtgaggttgttacgttgggtgagtcgtgggaggaggcttagacccgagggtcccggggggtcctggacgactctcctgtgcagcctgtcggttcagcctcgaagtaaaccaaccacgtagaagtcggtcgggtccgccgagtccctaccggaaggggaacggggtcgtaggaagtcgggtctacgtaagttattagaaagtgattaggagacaacgaactacgtaccgaccgtacgtcggtaacggaacgggtcacgttaccacctactcctaccaagacgaactaactaacccgaaaggtaaccgtaacggtacgtaattactaacaaacgtagaactacggtacgtacgaacgtaaccggaacgggtaaccgaccgggtaaccgttaagttacgtttaaagttacggttaagttaaggttacgttaggggtttaagtaaccggtttcccggggaacccggtcggggtaacccggtaaccggggttaaccggtcggttaacccgtacccggttccctaccgttccgaaccccggtacccgtaccgaacccggtaaccccggg

SEQ ID NO: 137214 - DNA, 749 bp, Homo sapiens
  misc_feature: GYAE6OF02JYB56.16.39.D06.1.454.CMB.1.raw
  modified_base (118)..(118): a, c, t, g, unknown or other
  misc_feature (118)..(118): n is a, c, g, or t
  modified_base (260)..(260): a, c, t, g, unknown or other
  misc_feature (260)..(260): n is a, c, g, or t
  modified_base (648)..(648): a, c, t, g, unknown or other
  misc_feature (648)..(648): n is a, c, g, or t
  modified_base (659)..(659): a, c, t, g, unknown or other
  misc_feature (659)..(659): n is a, c, g, or t
tcagtgtactactccacgaccggtgctcgatttagtgacatctcgcagttcgtttggggggagaggagcccagcactgggattccgaggtgtttccattcggtgatcagcactgacanagagactcaccatggtagtttggctgtaggttggttttccttgctgacttagttttaaagtgtaccgagtcgtggtaggtcgttaacgtggtggtagtgtggaggaggtcttacggacccgacgggtccgggggggttcccncggaagtccgtcgttccgttcggacgcgaaccggtcccgttcggtaggtttaccgtaggtacggtacctaaacggtaaccaaccggtaccggtagttaggtcggtcgggtacccgacgaccggaccgaccggaggggtaacgggtcggtggtaaaggttcggtaccgtaggttaagttaaggtaaagtaaacgttcggaaacgtttggacgaaccgtaaacgtacggttaacgttacggacccgaacgtaccgggtaacggtaagggtccttaaacgtcccgtaacctacccggtacctaagacgaaccgttacgaaccttaaccgaaacgaaaccgcgtacgtagttacgtagtacaagttacgactagtactgtacgagtaaccgngacctaccggntacgtagtacgtgtacgagtagtacgggtgtaacgttggaccggtgtacgtcgtagtcgtagtcgtacgacggcggtaccggagtaccgg

SEQ ID NO: 137215 - DNA, 930 bp, Homo sapiens
  misc_feature: GYAE6OF02JR86H.16.39.D06.1.454.CMB.1.raw
tcagtgtactactccacgaccggtgctcgatttagtgacatctcgcagttctttggggggagaggagcccagcactgggattccgaggtgtttccattcggtgatcagcactgaacacagaggactcaccatggtagttttgctgagttgggttttccttgctgcttattttaaaggtgtccagtgtgaggtgtacttggtggagtcgtgggaggaggtcgttcggacccgagggcccgggggggtccctggacgtaccgttccttccgtggtcgcgtacgtccgttcgttcggggttccaaggtccggtacaacgtaaacctaacccgacggttgaacgttggtaccggggtcccgacccgtaacggtcccgtacccgggaagggggaacggggtcgtacgggtaaggttcggggttacctacgttaaggtttaagttaggtaaaaattggtaagttcgggtaacgtaaacgaacgtaaacgttaccgtaaccgtacccggtaaccgttccggtaacgggaaaccgggtacccgtaacgttacccaaaccgtacgttaccgttaacccgaaggtaaccggaaaccttaaaccgttaccgaaaacggtaaacccggtaaacccgggttaagttaaaaccgttacccttaaaacgtaaaacgttaccggaaaaccgtacccggttaaccgtaacggaaaccggtaaaaccccggtacgggaaacccggtaaccgggttaccttaagtttaaaccgtttaagttaaccggttaagttaacggttaggtaacgggtttacgggtaaacccggtttcccggggtaacccggtcgggggaaccggttaaccggggtaccggttacggttaccccgtaacccggtttccgaccggttaccggtacccggtacccctaccggtaaacccgtaccggg

SEQ ID NO: 137216 - DNA, 834 bp, Homo sapiens
  misc_feature: GYAE6OF02GSPSU.16.39.D06.1.454.CMB.1.raw
  modified_base (649)..(649): a, c, t, g, unknown or other
  misc_feature (649)..(649): n is a, c, g, or t
tcagtgtactactccacgaccggtgctcgattttagtgacatctcgcagttctttgggttttggggagaggagcccagcactgggattccgagtgtttccattcggtgatcagcactagaacacagaggactcacatggtagttttggctgtagtttgggttttcctgtctgtacttaagttttaaaaggtgtccagtgtgtaggtgttacgtttgggtggtagtcgtgggaggtagtcttacgacccggacgggtcccgggggggtccctggacgtacctccgtccgtgtcgcgacgtccgtcggttggttcgacgtccgtacgaacgtaaacgaacccgtaggtgtagtggtccgggtccgaccgaccggtccgaccgggacgggggtaacggggtacgtagggtagtcggttcgtacgtaggttataacgtaaagtgtaaggtaggtacgaaactaacgtaacgtacgtacccgtccgtaccgttaacccggtaggacccggtccgtaaccgtaccgtacctacctaccgtacctaacgaaccgtaaacgttaaaccttaaccgaaaaccggtaccggtaaacgtacgtttaaactaaccttaaaccgaagttacaaacgtctaaccgtacgaacggtaaaccggngtaaacccggacggtttcgttaaattacgttgtttaaaggttagtttaaagggttccggttaagggttaacgttaccgggtttacccggcccggggttacggggtaacccggttaaccgggtaagggttacccgtaccggtacctccccgttagtccccgtactcccccgtaacccggaaccggg

SEQ ID NO: 137217 - DNA, 907 bp, Homo sapiens
  misc_feature: GYAE6OF02G3YLB.16.39.D06.1.454.CMB.1.raw
tcagtgtactactccacgaccggtgctcgatttagtgacatctcgcagttctttgggggggagaggagcccagcactgggattccgaggtgtttccattcggtgatcagcactgaacacagaggactcaccatggagttttggctgagttgggttttccttgctgacttaagttttaaaaggtgtaccagtgtgaggttgtacgttggtggagtcgtgggaggtagcgttgacccgagggtcccgggggggtccctaggacgactcgtccgtagtcggcagcctcgtgggttcagccgtacaacgtaaccaaccgtacgtagagtggtcgggtcccgtaccgacgtcccgtaccggaaggggaacggtcgtaagggtacgttggggtactaccgtaagtttaactaaggtaaaacgtggtaacgttagggtacgaactaacgtaacgttaccgtacggacccgtaaccggtaccgtaacggggtaacgggtacccgtaagttacccaccgttaacgtaccctaccggaaggtaaccgtaaccgttaaacgtaaaccgtaaaacggaaaccgttaacgggtaacgtaaaccgtttacgtaaacccgtaaaactaaccggtaaacccgtaacggtaacccgtaacgggaaaccggaaacccggggtaaaccgggaaccggttaaccgggtaaccggtttaagtttaaacgtttaacgtttaaggtttaacggtttaagggtttaacgggtcgggtttaaacgggttaacccgggtttacccggggaccccgggtttaacgggggacccggttaaaccggggttacccgggttaaccgggttacccgtacccggttaccgttacccgtacccggtacccgtaccccgttacccgacccggttaacccggg

SEQ ID NO: 137218 - DNA, 1122 bp, Homo sapiens
  misc_feature: GYAE6OF02I9KH7.16.39.D06.1.454.CMB.1.raw
tcagtgtactactccacgaccggtgctcgatttagtgacatctcgcagttctttgggttttggggagaggagcccagcactgggattccgaggtgtttccattcggtgatcagcactgaacacagaggactcaccatggtagttttggctgagttgggttttccttgctgcttaattttaaaggtgtccagtgtgaggtgtacgttggtggagtcgtgggaggaggtcttgacccagggccggggggtccctggacgactctcctgtgcagtcctcgtggttcagtcgtacgaacgtaaccaacccgtagttggaagttcgggtacgggtaccccgtcccgaacggtccccgtaccgggaagggggaacgggggtctaaggggtaacgttcggggttaccttacgttaaggttttaagtttaaggtaaaaaggttggtaacggttacgggttaacgaaaccgtaacgtaaacgtttacccgtaacccgggtaaccccggttaaccgttacccgggttaacggggaaaacccgggggtacccgttaaacgttttaccccgaaaccccgttaaccgtttaccccgtaacccggtaaaccgggtaaaccggtaaaaccctttaaaaccgggttttaaacccggaaaaaaccgggtaaacccggtttaaaaccgggggttaaacgttaaaaccgttttaccccggttaaaaacgtaaaaaccggttaaacgggtaaaaccccgtaaacgggttaacccccgttaaaggggaaaaccccggggtaaaacccggggtaaacccggggtaaaccccggttaaacccccgggggtaaaccccgtttttaaaagttttaaccgggtttttaaacgttttaaacgggttttaaaccgggttttaaaacggggtttttaacgggtttacggggggttttaaaccgggtttttaaccggggtttccccccgggggtttaacccccggggtaacccgggggggttaacccccggggtaaaacgggggttaaccccgggtttaaccggggttacccccgttaacccgggtttaccccgttaccccggttaacccggtacccggtaccccccggttaaccccggtaaaaccccgggg

SEQ ID NO: 137219 - DNA, 814 bp, Homo sapiens
  misc_feature: GYAE6OF02F8FAU.16.39.D06.1.454.CMB.1.raw
  modified_base (314)..(314): a, c, t, g, unknown or other
  misc_feature (314)..(314): n is a, c, g, or t
  modified_base (428)..(428): a, c, t, g, unknown or other
  misc_feature (428)..(428): n is a, c, g, or t
tcagtgtactactccacgaccggtgctcgatttagtgacatctcgcagttctttgggttttggggagaggagcccagcactgggattccgaggtgttccattcggtgatcagcactgaacacagaggactcaccatggtagttttggctgagttgggttttcctgctgcttaagttttaaaggtgtccagtgtgaggtgtacgttggtggagtcgtagggaggaggtacttcggacccgacgggtcccggggggggtcccctggacgtacctccttcccgtgtcggaccgtacggcctccggttgggttaccgngtaccggtcaaacggtaaccaaccctacggtagacttcgggttcgggcccgtaccgacgtacccgtcgggaaggggtacggggcgtaggaacggttcggtcgtacgtaagtttntaaaggtaaatgtaacggtggtacacgaactactcgtaccggaccgtacggtacggtacgggaacggtcctaacgttcccgaactccggtactaaccgactaaacgtacctaaacgttaccgaaagaaccgtacgtaaacgtactaaacgtactaaagtacgtaaacgtaacgacggtacgaaacggaaccggtaccggaaccggtacggttacgtaacttaagttacgttaaggttaccgttaaggggtacttagggggttacgttacccgggttccggtacccggggtaacggggtcgggttaaccgggtacccggttcgggtaaccccttacccgggttacctccccggtacgtaacccggtccccgtaacggtaacccccgg

SEQ ID NO: 137220 - DNA, 782 bp, Homo sapiens
  misc_feature: GYAE6OF02JOHSF.16.39.D06.1.454.CMB.1.raw
  modified_base (183)..(183): a, c, t, g, unknown or other
  misc_feature (183)..(183): n is a, c, g, or t
  modified_base (412)..(412): a, c, t, g, unknown or other
  misc_feature (412)..(412): n is a, c, g, or t
  modified_base (759)..(759): a, c, t, g, unknown or other
  misc_feature (759)..(759): n is a, c, g, or t
tcagtgtactactccacgaccggtgctcgatttagtgacatctcgcagttctttgggttttggggagaggagcccagcactcgggattccgaggtgtttccattcggtgatcagcactgaacacagaggactacaccatggacgtttggctgagttgggtttacctgctgcttatttaaaggngtcagtgtgaggtgtactggtggatcgtggaggaggtacttcgacccgtagggcccgggggggttccttgggaatcgtcttcctggtgactacggtccttcgttgggttacacgtcgtcgtaacgtaaccgaccgacgtgtaagttcggtacgggtacctaccgttacggcccttaccggacggggttaacggggcgtaggtaaggttcgggtactaccgtttaggttnttaacggaaacttggtacgtacgggttacaacgtactacgttcgtaaccggtacccgtagtacccggtaagggaaccggtacccgtaagttaccgaaccgttacgtctaaccgagtacgttaacccaaggttaaccccgtaaggtaaccgacgttttaccgggaactttacggtaaacacggttaacgaaaccgtacggtacgagtaaccggaaccggaggaaccgtccggtacgttaacttcgtagttagtcgttaaggtacgttacgttaggtacccggttacgggtacccccgtggggtaccaacgggttacccgtcggtacccgtaccgttccgtacccggtnaaccgtcccttaccggaacccgg

SEQ ID NO: 137221 - DNA, 1172 bp, Homo sapiens
  misc_feature: GYAE6OF02F8VFH.16.39.D06.1.454.CMB.1.raw
tcagtgtactactccacgaccggtgctcgatttagtgacatctcgcagttctttggggggagaggagcccagcactgggattccgaggtgtttccattcggtgatcagcactgaacacagaggactcacccatggagttttggctgtaggttgggttttccttgctgtcttatttaaaaggtgtccagtgtgaggtgtattggtggagtcgtggaggacggtcttacgacccgtacgggcccgggggggtccctggacggtacctccgtcccgttgtcgtcgacgtcccgtcgttcgggtactacggtccgtacgtaacgtaaaccgtaacccgtaaccgtgaacgttgggtacggggtacccgtaccgtacggtcccgtacccgggagggggtaaacgggcgtaggggtaacggttcgggtaccgttagtaacggtttaagttaacggtaaaacgttaggtaacgtggtacggtaaaccgaaacgttaaacgttacccgtaccgggtaccccgtaaaccgtttcccgggtaacgggtaaaccgggttacccggtacgttaacccctaaccggtaaccctttaacccggtacccggtaaacggtaaaccgtaaaacccgtttaaacggttaaccccggaaaacgggtaaaacccggttaaacccgggttttaaaacgaaaccgttttaaaccccgttaaacggtaaaaaaccggtttccggaaaaaacccgtaccgggttaaccgtttaaaacccggggaaaccgggaaaacccccggtaaaacggggaaccccttaaaaacccccgggggggttaaccggttttaaaacttttttaaacggtttttaaacccggggttttttaaaggtaaaaccgggggttttttaaaacgggttttacgggggttttttaaaacccggggggttaagggggtttttaaaaaacccccgggggggtttttccccccggaaaacccccgggggggggttttccgggggtaaaaacccccgggggtttacccggggggttaaaaccccccggggttttaaccggggttaaacccccccgttaacccgggtttttaaccccggtaccccggtttcccccggggaaaccccggtttacccccccgttaacccccgggaaaacccccgggggtttaaccccccggg

SEQ ID NO: 137222 - DNA, 769 bp, Homo sapiens
  misc_feature: GYAE6OF02IA7V3.16.39.D06.1.454.CMB.1.raw
tcagtgtactactccacgaccggtgctcgatttagtgacatctcgcagttctttgggggagaggagcccagcactgggattccgaggtgtttccattcggtgatcagcactgaacacagaggactcaccagtggtagttttggctcgaggttttcgggtttccttgctgtacttaattttaaaaggtgttaccgagtgtgtaggttgttacgttggtacggtagtcgtggaggaggtcgttcggacccgacgggtccggggggtcctggacgtaccttctccgttagtcgcgacgtcctcggttcggtcgcgtccgtacagtaaaccacgtacgtacgagtcgtcggggtccacgccgtacccgacggaacggggaggtaccgaggagttcggtacctaggtagtttaagtacgtaaagtcgtagtggtacgacaacgtacttcgacccgtaacgaccggttaccgacggtaacgggtcccgtaactttccgaacccttctacggttcccgaaacgaaacgtacctaacgttaaccgaaaggttaaccgaactaacgttacgtaagttcgtacggaaccggtagtaacgtaaggccgttaacgtacgtaaggtaacccgacgaaccgtacgtaacggccctttaacgtacctaaccggttgaaccggtaaccgggtaataccggggtaggttacggtaagttaccgttagttaacgttacgtagtaggtacgggttacggacggttaaaccggaggtaacccgttacgg

SEQ ID NO: 137223 - DNA, 498 bp, Homo sapiens
  misc_feature: GYAE6OF01A99AX.46.67.G01.1.454.CMB.1.raw
tcagactagcagtacacgaccggtgctcgatttagagtatacatattgggtttgggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggccctaagctcctaatctatgctgcatccagtttgcaaagtgggtcccatcgaggttcagtggcagtggatctgggacagatttcactctcaccatcagtaatctgcaacgtgaagattttgcaacttattactgtcaacagaattacaatgttttcggcctaagggacacgactaacaaattaacgaactgtggctgcaccatctgtcttcatcttcccgcatctgtac

SEQ ID NO: 137224 - DNA, 497 bp, Homo sapiens
  misc_feature: GYAE6OF01A0XI4.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggccctaagctcctaatctatgctgcatccagtttgcaaagtgggtcccatcgaggttcagtggcagtggatctgggacagatttcactctcaccatcagtaatctgcaacgtgaagattttgctaacttattactgtcaacagaattacaatgtttcggccaagggacacgactacaaattaacgaactgtgctgcaccatctgtattcatcttcccgccatctgtac

SEQ ID NO: 137225 - DNA, 489 bp, Homo sapiens
  misc_feature: GYAE6OF01BI0EJ.46.67.G01.1.454.CMB.1.raw
  modified_base (464)..(464): a, c, t, g, unknown or other
  misc_feature (464)..(464): n is a, c, g, or t
tcagactagcagtacacgaccggtgctcgatttagagtatacatattgggtttgggagtctcggtcaggacacagcatggacatgagggtcccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctattaaatggtatcaacatagaccagggacggccctaagctcctaatctatgctgcatccagtttgcaaagtgggtcccatcgaggttcagtggcagtggatctgggacagatttcactctcaccatcagtaatctgcaacgtgaagatttgtaacttattactgtcaacagaattacaatgttttcgctaaggacacgactacaaattaacgaactgtagctgcacatntgtcttcatcttccgcatctgatac

SEQ ID NO: 137226 - DNA, 496 bp, Homo sapiens
  misc_feature: GYAE6OF01AZL9U.46.67.G01.1.454.CMB.1.raw
tcagactagcagtacacgaccggtgctcgatttagagtatacatattgggtttgggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggccctaagctcctaatctatgctgcatccagtttgcaaagtgggtcccatcgaggttcagtggcagtggatctgggacagatttcactctcacatcagtaatctgcaacgtgaagattttgctaacttattactgtcaacagaattacaaatgttttcgcctaagggacacgactacaaattaaacgaactgtggctgcaccatctgtctcatcttccgcatctgtac

SEQ ID NO: 137227 - DNA, 508 bp, Homo sapiens
  misc_feature: GYAE6OF01EDSV0.46.67.G01.1.454.CMB.1.raw
  modified_base (408)..(408): a, c, t, g, unknown or other
  misc_feature (408)..(408): n is a, c, g, or t
  modified_base (503)..(503): a, c, t, g, unknown or other
  misc_feature (503)..(503): n is a, c, g, or t
tcagactagcagtacacgaccggtgctcgatttagagtatacatattgggtttggggagtctcggtcaggacacagcatggacatgagggtccccgctcagctcctggggctcctgctactctggctccgatgtgccagatgtgacatcgagctgacccagtctccatcctccctgtctgcaaccgtgggagacagtgtcaccatcacttgccgggcaagtcggaacattgacacctattaaattggtatcaacatagaccagggacgcccctaagctcctaatctatgctgcatccagtttgcaaagtgggtcccatcgaggttcagtgcagtggatctgggacagattcactctcacatcagtaatctgcaacgtgaagtattttgctaacttattactgtacaanagtaattactaattgttttacggacctaagggtacacgtaactaacaaattaaacgaactagtgactgactacatctgtcttctatcttcccgcntctag

SEQ ID NO: 137228 - DNA, 512 bp, Homo sapiens
  misc_feature: GYAE6OF01C4OF3.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccaggacggccctaagctcctaatctatgctgcatccagtttgcaaagtgggtccatcgagttcagtgcagtgatcgtgggacagatttcactctcaccatcagtaatctgacaacgtgaagtattttagactaacttattactgtacaactagtaattacaattgttttacggacctaagggactacgaactaactaaattaacgaactgtagctagctaccatctgtcttcactcttcccgcactctgtac

SEQ ID NO: 137229 - DNA, 508 bp, Homo sapiens
  misc_feature: GYAE6OF01CWH77.46.67.G01.1.454.CMB.1.raw
  modified_base (487)..(487): a, c, t, g, unknown or other
  misc_feature (487)..(487): n is a, c, g, or t
  modified_base (503)..(503): a, c, t, g, unknown or other
  misc_feature (503)..(503): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacactatttaaatgtatcaacatagacaggacgccctaagctcctaatctatgctgcatccagtttgcaaagtgggtccatcgagttcagtgcagtggatcgtgggacagatttcactctcacatcagtaatctgacaacgtgaagtattttgactaacttattactagtacaacagtaattaacaattgttttacgacctaagggacaacgaactaactaaattaacgaactgtagctagcgactatctgtcttnactcttcccgacactntgtac

SEQ ID NO: 137230 - DNA, 567 bp, Homo sapiens
  misc_feature: GYAE6OF01CKNAY.46.67.G01.1.454.CMB.1.raw
  modified_base (201)..(201): a, c, t, g, unknown or other
  misc_feature (201)..(201): n is a, c, g, or t
  modified_base (435)..(435): a, c, t, g, unknown or other
  misc_feature (435)..(435): n is a, c, g, or t
  modified_base (497)..(497): a, c, t, g, unknown or other
  misc_feature (497)..(497): n is a, c, g, or t
tcagactagcagtacacgaccggtgctcgatttagagtatacatattgggtttggggagtctcggtcgaggacacagcatggacatggacgggtccccgctcagctccgtggggctcctgctactctggctcgaggtgccagatgtgacatcgagctcgacccagtcctccatccctccctgtctgaccaaccggtggganacagtgtcaccatcacttggccgggacaaggtcggaactattgacctacttaatttaaatggtatacaacatagaccgagggaccggaccctaagctacctaatctatgctgcactcctagtttcgacgtaaaggtcgggtacccagtcggtaaggttcaggtggctaggtggatcgtagggactagtactttcactctacactatcagtaatctagacaagtagaagtatttnactaacttatactagtacaatataattatattcgtttacgacgtaaggactacgtaactaanaaactaacgaactgtacgactagacgtactatctcgtaccttactacttcctacccgactactctgtaac

SEQ ID NO: 137231 - DNA, 512 bp, Homo sapiens
  misc_feature: GYAE6OF01CR2SD.46.67.G01.1.454.CMB.1.raw
  modified_base (501)..(501): a, c, t, g, unknown or other
  misc_feature (501)..(501): n is a, c, g, or t
  modified_base (507)..(507): a, c, t, g, unknown or other
  misc_feature (507)..(507): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccaggacggccctaagctcctaatctatgctgcatccagtttgcaaagtgggtcccatcgaggttcagtggcagtggatctgggacagatttcactctcaccatcagtaatctgcaacgtgaagtattttgactaacttattactgtacaacagtaattacaattgttttcggacctaagggacacgactaacaaattaacgaactgtagctagacacatctgtcttctactccttacccnctactntgtac

SEQ ID NO: 137232 - DNA, 695 bp, Homo sapiens
  misc_feature: GYAE6OF01ACP99.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaaccggtgggagacagtgtcaccatcacgttggccgggacaaggtcggaaactatttacgaacctaacctttaattttaaattggtaatacaacatacggaccgagggaccgaccctaagcctacctaatctatcgctgactatccgtagtttacgacgtaaagggtcgggtacccagtcggtaggttcgaggtggacgtaggtggatcgtaggactagtactttacactctacactatacagtactctagactaacgtagtaagttatttacgacttaacttacttactacgtaacaaacgtaagttaaacttaacgtaacgtttcggtttaaccggaaccggtaaacgggtaacctaaaccggtaaaccttaaaacgtaaaacgtttaaaccggtaacgttacgggtacggtaccttacggtaacccttaaaccctaagtttcccgttacgtttaccccttaccttaacccgtttcccttaccccgtacttaacgtttccgtacggttaaacc

SEQ ID NO: 137233 - DNA, 491 bp, Homo sapiens
  misc_feature: GYAE6OF01CKO0A.46.67.G01.1.454.CMB.1.raw
  modified_base (344)..(344): a, c, t, g, unknown or other
  misc_feature (344)..(344): n is a, c, g, or t
  modified_base (482)..(482): a, c, t, g, unknown or other
  misc_feature (482)..(482): n is a, c, g, or t
  modified_base (486)..(486): a, c, t, g, unknown or other
  misc_feature (486)..(486): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccaggacggccctaagctcctaatctatgctgcatccagtttgcaaagtgggtcccatcgagttcagtgcagtgatctgggacngatttcactctcaccatcagtaatctgcaacgtgaagattttgctaacttattactgtcaacagaattacaattgtttacgacaaggacacgactacaattaacgaactgtagctgcaccatctgtcttcatcttccncatntgtac

SEQ ID NO: 137234 - DNA, 511 bp, Homo sapiens
  misc_feature: GYAE6OF01DWH7G.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatgtatcaacatagaccagggacggccctaagctcctaatctatgctgcatccagtttgcaaagtgggtcccatcgaggttcagtggcagtggatcgtgggacagatttcactctcaccatcagtaatctgcaacgtgaagtattttgctaacttattactgtacaacagtaattacaattgttttacgacctaagggactaacgaactaactaaattaacgaactgtagctagcacatctgtcttcactcttacccgctatctgtac

SEQ ID NO: 137235 - DNA, 500 bp, Homo sapiens
  misc_feature: GYAE6OF01BB0G3.46.67.G01.1.454.CMB.1.raw
  modified_base (491)..(491): a, c, t, g, unknown or other
  misc_feature (491)..(491): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggccctaagctcctaatctatgctgcatccagtttgcaaagtgggtcccatcgaggttcagtggcagtggatctgggacagattcactctcaccatcagtaatctgcaacgtgaagtattttgactaacttattactgtacaacagaattacaattgtttcgacctaagggactacgactaacaaattaaacgaactgtagctgcacatctgtctcatctccncatctgtac

SEQ ID NO: 137236 - DNA, 764 bp, Homo sapiens
  misc_feature: GYAE6OF01D22P0.46.67.G01.1.454.CMB.1.raw
  modified_base (216)..(216): a, c, t, g, unknown or other
  misc_feature (216)..(216): n is a, c, g, or t
  modified_base (245)..(245): a, c, t, g, unknown or other
  misc_feature (245)..(245): n is a, c, g, or t
  modified_base (260)..(260): a, c, t, g, unknown or other
  misc_feature (260)..(260): n is a, c, g, or t
tcagactagcagtacacgaccggtgctcgatttagagtatacatattgggtttggggacctcctgtgcaagaacatgaagcacctgtggtttgtcctcctgctggtggcagctccagatgggtcctgtcctggtgcaactgcaggagtcgggcccagactggtgacggcctttcggagaccctggtcccctgaccttgccgtctgtctcgtggtcncctcattcgaggttagttcggtttctcgnggggctggggtccgnagccgtccgagggacggtctaggaactacgagttggaagttcggtactcgtcgaagttacggtcggtaacggtttccctaagtttaccgacggtttcccggtacgttaccgttaccggtaaaaggttcggttaccggtaacggttaccgaaaccgtaaagtttacgttcccgttacggtacgggaaccttaccggttacccaaggtaccgtaaagtttccgttaacggtttttcccgaggtaaacgttacgtcggtaacgtttcgtacggttacgacccgtcgtacgtacggtaccgtacgggttctttaacgtaccgtgttacgaccgtaagtacggtacggttacttagttaacgttggttaacgttttggacgtttacgttacgttacgacctaccgtagtacgtccgggtacgggtcctaccgggtccccgtagggtacctaagggtactaccgttgggtaccctaccggttaccttaccgttaggccccgttaacccgg

SEQ ID NO: 137237 - DNA, 520 bp, Homo sapiens
  misc_feature: GYAE6OF01BMUQG.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacactattaaatggtatcaacatagacagggacgccctaagctcctaatctatgctgcatccagtttgcaaagtgggtcccatcgagttcagtgcagtggatctgggacagtattcactctcaccatcagtaatctgcaacgtgaagtatttgactaacttattactgtactaacagtaattacaattcgttttacggacctaaagggacaacgtaacttaacaaattaaacgaactagtagactagctacctatctgtacttacacttcctacccgactatctgtaac

SEQ ID NO: 137238 - DNA, 505 bp, Homo sapiens
  misc_feature: GYAE6OF01AL951.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggccctaagctcctaatctatgctgcatccagtttgcaaagtggggtcccatcgaggttcagtggcagtggatctgggacagatttcactctcaccatcagtaatctgcaacgtgaagtattttgactaactttattactgtacaacagaattacaattgtttcgacaaggacacgaactacaaattaacgaactgtgctgacaccatctgtcttcactccttcccactctctgtac

SEQ ID NO: 137239 - DNA, 595 bp, Homo sapiens
  misc_feature: GYAE6OF01DS525.46.67.G01.1.454.CMB.1.raw
  modified_base (243)..(243): a, c, t, g, unknown or other
  misc_feature (243)..(243): n is a, c, g, or t
  modified_base (584)..(584): a, c, t, g, unknown or other
  misc_feature (584)..(584): n is a, c, g, or t
tcagactagcagtacacgaccggtgctcgatttagagtatacatatggggttggggagtctcggtcaggtacgaccagcgaactggacgaatccgagggtccccgctcagtcctccttcggggcctcctgctactcgtggcctccgaggtcgccaggatagtgacatcgagctgacccagtctccactcctccctgtctgcaaccggtaggagaccacgtgtccaccgatcgacttgccgggnaagtcggtaacattgacaccttattaaacttggtactcgaacataacgaccgacggacggccctaacgctcctaatctatgctgcagtccagtttcgacaaaaggtcgggtacccagtcgaggtttccaaggtcggacgtacgtggtagtcgtggggtacagtagtttacacgtctcacctatcaagtaatctagccaacgtcgtaagtattttagtaactttagtaacttgtttacgaaactaagttaatttactaagttcgttttacggcctaaagggtactaacgtaactacgaaattaacgactagttgctaggacacgtatcagtctacatctccncatctatctcg

SEQ ID NO: 137240 - DNA, 501 bp, Homo sapiens
  misc_feature: GYAE6OF01ECIC1.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctattaaattggtatcaacatagaccaggacggccctaagctcctaatctatgctgcatccagtttgcaaagtgggtcccatcgaggttcagtggcagtggatctgggacagatttcactctcaccatcagtaatctgcaacgtgaaagattttgactaactttattactgtacaacagaattacaatgtttacggaccaagggactacgactaacaaattaacgaactgtgctgcacatctgtcttcatccttccgcatctgtac

SEQ ID NO: 137241 - DNA, 499 bp, Homo sapiens
  misc_feature: GYAE6OF01EVNPB.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctattaaattggtatcaacatagaccaggacggccctaagctcctaatctatgctgcatccagtttgcaaagtggggtcccatcgaggttcagtggcagtgatctgggacagatttcactctcaccatcagtaatctgcaacgtgaagattttgcaactttattactgtcaacagaattaacaatgtttcggaccaagggaccaacgactacaaattaacgaactgtgctgcaccatctgtcttcatcttccgaccatctgtac

SEQ ID NO: 137242 - DNA, 492 bp, Homo sapiens
  misc_feature: GYAE6OF01BELII.46.67.G01.1.454.CMB.1.raw
  modified_base (221)..(221): a, c, t, g, unknown or other
  misc_feature (221)..(221): n is a, c, g, or t
  modified_base (231)..(231): a, c, t, g, unknown or other
  misc_feature (231)..(231): n is a, c, g, or t
  modified_base (340)..(340): a, c, t, g, unknown or other
  misc_feature (340)..(340): n is a, c, g, or t
  modified_base (359)..(359): a, c, t, g, unknown or other
  misc_feature (359)..(359): n is a, c, g, or t
  modified_base (387)..(387): a, c, t, g, unknown or other
  misc_feature (387)..(387): n is a, c, g, or t
  modified_base (407)..(407): a, c, t, g, unknown or other
  misc_feature (407)..(407): n is a, c, g, or t
  modified_base (409)..(409): a, c, t, g, unknown or other
  misc_feature (409)..(409): n is a, c, g, or t
  modified_base (449)..(449): a, c, t, g, unknown or other
  misc_feature (449)..(449): n is a, c, g, or t
  modified_base (451)..(451): a, c, t, g, unknown or other
  misc_feature (451)..(451): n is a, c, g, or t
  modified_base (467)..(467): a, c, t, g, unknown or other
  misc_feature (467)..(467): n is a, c, g, or t
  modified_base (489)..(489): a, c, t, g, unknown or other
  misc_feature (489)..(489): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacgatccgaggctgacccagtcgtccagtcctaccgtgtctagcaaccgtgggagacagtgcacatcacttgccggnaagtcgaacnttgacactattaaagtggtatcaacatagaccagggacgccctaagctcctaatctatgctgcatccagttgcaaagtgggtccatcgaggttcagtggcagtggactntgggacagatttcactctnaccatcataatctgcaagtgaagatttnctaacttattactgtccaananaattacaatgtttcgcaaggcacgatacaataagaactgngntgcactatctgtactnacttcgttaccccatactcgtntac

SEQ ID NO: 137243 - DNA, 512 bp, Homo sapiens
  misc_feature: GYAE6OF01DJ72T.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggccctaagctcctaatctatgctgcatccagtttgcaaagtgggtcccatcgagttcagtggcagtggatctgggacagatttcactctcaccatcagtaatctgcaacgtgaagtattttgctaacttattactgtacaactagtaattaactaattgttttcggacctaagggactaacgaactaacaaattaacgaactgtgctgacaccatctgtcttcactctacccgcactctgtac

SEQ ID NO: 137244 - DNA, 509 bp, Homo sapiens
  misc_feature: GYAE6OF01ASR5A.46.67.G01.1.454.CMB.1.raw
tcagactagcagtacacgaccggtgctcgatttagagtatacatagttagggtttgggagtctcggtcaggaacacagcatggacatgagggtccccgctcagctcctgggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggccctaagctcctaatctatgctgcatccagtttgcaaagtggggtcccatcgaggttcagtggcagtggatctgggacagatttcactctcaccatcagtaatctgcaacgtgaagtattttgctaacttattactgtacaacagtaattacaattgttttcgactaagggacacgacttaacaaattaaacgaactgtagctagcacatctgtctcactcttcccgctactctgtac

SEQ ID NO: 137245 - DNA, 578 bp, Homo sapiens
  misc_feature: GYAE6OF01C1JDR.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacggccctaagctcctaatctatgctgcatccagtttgcaaagtgggtcccatcgaggttcagtggcagtggatcgtgggacagatttcacttctcaccatcagtaatctgacaacgtgaagtattttagactaactttattacttgtacaactaagtaaatttaactaatttagtttttaccggaccgtaaagggtaacctaacgtaacttaactaaaacttaaacgtaaacttacggttaggacttagacctaaccgtattacttgttacctttactacttccctttaccccgaccttacttcgtgtaacg

SEQ ID NO: 137246 - DNA, 497 bp, Homo sapiens
  misc_feature: GYAE6OF01D9FW8.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctattaaattggtatcaacatagaccaggacggccctaagctcctaatctatgctgcatccagtttgcaaagtgggtcccatcgaggttcagtggcagtggatctgggacagatttcactctcaccatcagtaatctgcaacgtgaagattttgctaacttattactgtcaacagaattacaatgttttcggcaagggacacgactacaaattaacgaactgtggctgcaccatctgtcttcatcttcccgccatctgtaac

SEQ ID NO: 137247 - DNA, 502 bp, Homo sapiens
  misc_feature: GYAE6OF01A51UP.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggccctaagctcctaatctatgctgcatccagtttgcaaagtgggtcccatcgaggttcagtggcagtggatctgggacagatttcactctcaccatcagtaatctgcaacgtgaagattttgctaacttattactgtacaacagaattacaatgttttcgacctaagggactacgacttaacaattaaacgaactgtgctgcaccatctgtcttcatcttccgccatctgtac

SEQ ID NO: 137248 - DNA, 514 bp, Homo sapiens
  misc_feature: GYAE6OF01EH0UM.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggccctaagctcctaatctatgctgcatccagtttgcaaagtgggtcccatcgaggttcagtggcagtggatctgggacagattcactctcacatcagtaatctgcaacgtgaagattttgactaacttattacttgtacaacagtaatttacaattgttttcggacctaagggacaacgtactaacaaattaaacgaactgtaggctagacacctatctgtcttcactcttacccgcatctgtac

SEQ ID NO: 137249 - DNA, 611 bp, Homo sapiens
  misc_feature: GYAE6OF01APVSL.46.67.G01.1.454.CMB.1.raw
  modified_base (343)..(343): a, c, t, g, unknown or other
  misc_feature (343)..(343): n is a, c, g, or t
tcagactagcagtacacgaccggtgctcgatttagagtatacatattgggtttgtcctcctgctggtggcacgctcccgaagatgggtaccctgtccctggtgcaactgcaggagtcgggcccacgactggtcgaggccttcggagaaccctgtccctacacctgcgctgtctctggtgcctccatctagtagtggtttcgtactggggctgggtccgcagctcccagggaagggctggaatacattggaagtgtctctcatagtggaggttcctattacagtccgtctctcaagagtcgagtcaccatatctctggacacgtccagccaatcagttttcccngaagactgagttctgtgaccgcgtctgacacgggtctttatactgtgcgagagacggctattagtgtattttggagttggttatttcgactacccgtagtactcggacggggtctcggacccgtggggaccgtaaggggtaactaccgtcggtacctaccggttccgtaccgttacgacccgtaccgaacccgtaaacgggacccctaacgtcccggttacccttcccccgtcggtccctaccccgtcctacccgaaagtcgtacccg

SEQ ID NO: 137250 - DNA, 543 bp, Homo sapiens
  misc_feature: GYAE6OF01A5XVG.46.67.G01.1.454.CMB.1.raw
  modified_base (335)..(335): a, c, t, g, unknown or other
  misc_feature (335)..(335): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccaggggaaggggctggaatacattggaagtgtctctcatagtggaggttcctattacagtccgtctctcaagagtcgagtcaccatatctctggacacgtccagcaatcagttttcccngaagatgagttctgtgaccgccgctgacacgggctttattactgtgcgagagacggctattatgtatttttggagttggttatttcgactaccctagatcggacggggctcgacccgtggggccagggatacgtggtcaccgtctcctagccctccaccgacggcccagtccggtcttccccctggccaccctccctccacgcgcccg

SEQ ID NO: 137251 - DNA, 497 bp, Homo sapiens
  misc_feature: GYAE6OF01EF0UA.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctggcccagtctccatcctccctgtctgcaaccgtgggagacagtgtcaccatcacttgccgggcaagtcggaacattgacacctatttaaattggtatcaacatagaccagggacggccctaagctcctaatctatgctgcatccagtttgcaaagtggggtcccatcgaggttcagtggcagtggatctgggacagatttcactctcaccatcagtaatctgcaacgtgaagattttgctaacttattactgtcaacagaattacaatgtttcgccaagggacacgactacaaattaaacgaactgtgctgcaccatctgtcttcatcttcccgcatctgtac

SEQ ID NO: 137252 - DNA, 506 bp, Homo sapiens
  misc_feature: GYAE6OF01DL2QJ.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaaccgtgggagacagtgtcaccatcacttgccgggcaagtcggaacattgacacctatttaaatgtatcaacatagaccaggacggccctaagctcctaatctatgctgcatccagtttgcaaagtgggtcccatcgagttcagtgcagtgatctgggacagatttcactctcaccatcagtaatctgcaacgtgaagtattttgactaattattactgtacaacagtaattacaattgttttcgaccaagggacacgactaactaaattaacgaatgtaggctgctaccgatctgttcttcattccttacccgcctatctgtaac

SEQ ID NO: 137253 - DNA, 736 bp, Homo sapiens
  misc_feature: GYAE6OF01ACAI6.46.67.G01.1.454.CMB.1.raw
  modified_base (171)..(171): a, c, t, g, unknown or other
  misc_feature (171)..(171): n is a, c, g, or t
  modified_base (179)..(179): a, c, t, g, unknown or other
  misc_feature (179)..(179): n is a, c, g, or t
  modified_base (432)..(432): a, c, t, g, unknown or other
  misc_feature (432)..(432): n is a, c, g, or t
  modified_base (477)..(477): a, c, t, g, unknown or other
  misc_feature (477)..(477): n is a, c, g, or t
  modified_base (670)..(670): a, c, t, g, unknown or other
  misc_feature (670)..(670): n is a, c, g, or t
tcagactagcagtacacgaccggtgctcgatttagagtatacatagttgggtttggggagtctcggtcaggacacagcatggacatggacgggtccccgctcagcctccgtggggctcctgctactcgtggcctccggaggtgccagatgagacagtcgacgctacgaccnctcctccnctccctcctgtcgacggaccgacggtggacacgtacgtctaccactacgtaccgtacggttcggaccggtaactaacggtaccgaacttacgttaacctaaccttaactttaagtttaacgtacgtaacaaccgaacgtaacggacccggaccggacgggtaccctacctatactactactgtagcgtacgacacttacgtacggttaggtaccggaacggtaccgggtccgacgtaggtacggtcggtacgnggtacggtagtaggtactacgtacgggtacacttacttactaccnctaccgaacctagtactagttaagtcctagaacgttaacgttagttactacgtttatacctaacgtttactacgtataacgtaacgtacgtaacttacgtaaggttaccggttaacgaccgtaaacggtacctaagttaacctaaacgttaaagttaccgacttcggtacggtcacctacgtacttaccgttnttaccctacccgttaccctacccggttacccttaccgacggtaattccggttagtcggttaaccgg

SEQ ID NO: 137254 - DNA, 514 bp, Homo sapiens
  misc_feature: GYAE6OF01BKPQS.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggccctaagctcctaatctatgctgcatccagtttgcaaagtggggtcccatcgaggttcagtggcagtggatctgggacagatttcactctcaccatcagtaatctgcaacgtgaagtattttgactaacttattactgtacaactagtaattacaattgttttaccggacctaagggacaacgtactaacaaattaaacgaactgtagctagcaccatctgtcttcatctcccgacatctgtac

SEQ ID NO: 137255 - DNA, 501 bp, Homo sapiens
  misc_feature: GYAE6OF01A5KA7.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaaattggtatcaacatagaccagggacggccctaagctcctaatctatgctgcatccagtttgcaaagtgggtcccatcgaggttcagtggcagtggatctgggacagatttcactctcaccatcagtaatctgcaacgtgaagattttgctaacttattactgtcaacagaattacaatgttttcgacaagggacacgactacaaattaaacgaactgtagctgcaccatctgtcttcattcttcccgcactctgtac

SEQ ID NO: 137256 - DNA, 501 bp, Homo sapiens
  misc_feature: GYAE6OF01A2488.46.67.G01.1.454.CMB.1.raw
  modified_base (498)..(498): a, c, t, g, unknown or other
  misc_feature (498)..(498): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgtacccagtctccatcctccctgtctgcaaccgtgggagacagtgtcaccatcacttgccgggcaagtcggaacattgacacctatttaaattggtatcaacatagaccagggacggccctaagctcctaatctatgctgcatccagtttgtaaagtggggtcccatcgaggttcagtggcagtggatctgggacagatttcactctcaccatcagtaatctgcaacgtgaagattttgctaactttattactgttcaactagaattacaatgttttacgccaagggacacgactacaaattaacgaactgtgctgcacatctgtcttcatcttccgcatctgntac

SEQ ID NO: 137257 - DNA, 521 bp, Homo sapiens
  misc_feature: GYAE6OF01AXBAM.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccactcctccctgtctgccaaccgtgggagacagtgtcaccatcacttgccgggcaagtcggaacattgacacctatttaaatggtatcaacatagaccagggacggccctaagctcctaatctatgctgcatccagtttgcaaagtgggtcccatcgaggttcagtggcagtggatctgggacagatttcactctcaccatcagtaatctgcaacgtgaagtattttgactaactttattactgtacaacagtaaattactaattgttttacggaccgtaagggaactacgaactaacaaattaaacgaactagtaggctagacactatctgtcttcattcctccgcactctgtac

SEQ ID NO: 137258 - DNA, 513 bp, Homo sapiens
  misc_feature: GYAE6OF01CPHT8.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatgtatcaacatagaccagggacgccctaagctcctaatctatgctgcatccagtttgcaaagtgggtcccatcgaggttcagtggcagtggatctgggacagatttcactctcaccatcagtaatctgacaacgtagaagtattttgactaactttattactgtacaacagtaattactaattgttttacgacctaagggacacgactaacaaattaacgaactagtgactgacaccatctgtacttaatcttcccgactatctgatac

SEQ ID NO: 137259 - DNA, 528 bp, Homo sapiens
  misc_feature: GYAE6OF01CFPPJ.46.67.G01.1.454.CMB.1.raw
tcagactagcagtacacgaccggtgctcgatttagagtatacatattagggtttgggagtacgtcggtcacggacacagctatggacatgagggtcccgcgtcagctaccgtggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacggccctaagctcctaatctatgctgcatccagtttgcaaagtggggtcccatcgaggttcagtggcagtggatctgggacagatttcactctcaccatcagtaatctgcaacgtgaaagattttgactaactttattactgttcaaactagtaaattactaaattgttttcggacaagggtacaacgaactaacaaattaaacgaactgtaggctagcaccatcttgtcttcactcttcccgactactctgtaac

SEQ ID NO: 137260 - DNA, 498 bp, Homo sapiens
  misc_feature: GYAE6OF01B4JRM.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggccctaagctcctaatctatgctgcatccagtttgcaaagtgggtcccatcgaggttcagtggcagtggatctgggacagatttcactctcaccatcagtaatctgcaacgtgaagtattttgactaacttattactgtacaacagaattacaattgtttcgacaagggacacgactaacaattaacgaactgtgctgcacatctgtcttcactctcccgcatctgtac

SEQ ID NO: 137261 - DNA, 526 bp, Homo sapiens
  misc_feature: GYAE6OF01A9EQB.46.67.G01.1.454.CMB.1.raw
  modified_base (516)..(516): a, c, t, g, unknown or other
  misc_feature (516)..(516): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagacaggacggccctaagctcctaatctatgctgcatccagtttgcaaagtcgggtcccatcgaggttcagtgcagtgatctgggacagatttcactctcaccatcagtaatctgcaacgtgaagtatttgactaattattactgtacaactagaattataattgtttacggactaagggactacgtaactactaaacttaacgaactgtacgtctacgactaaccctatcctgttaccttacacttccttcccgacctnttcctgtaac

SEQ ID NO: 137262 - DNA, 496 bp, Homo sapiens
  misc_feature: GYAE6OF01AXB6B.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggccctaagctcctaatctatgctgcatccagtttgcaaagtggggtcccatcgaggttcagtggcagtgatctgggacagatttcactctcaccatcagtaatctgcaacgtgaagatttgctaacttattactgtcaacagaattacaatgttttcggacaagggacacgactaacaaattaacgaactgtgctgcaccatctgtctcatcttcccgcatctgtac

SEQ ID NO: 137263 - DNA, 494 bp, Homo sapiens
  misc_feature: GYAE6OF01BN61X.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctattaaatggtatcaacatagaccagggacggccctaagctcctaatctatgctgcatccagtttgcaaagtgggtcccatcgaggttcagtggcagtggatctgggacagatttcactctcaccatcagtaatctgcaacgtgaagattttgctaacttattactgtcaacagaattacaatgtttcgccaagggacacgactacaaattaacgaactgtggctgcaccatctgtcttcatcttcccgcatctgtac

SEQ ID NO: 137264 - DNA, 515 bp, Homo sapiens
  misc_feature: GYAE6OF01CKXDN.46.67.G01.1.454.CMB.1.raw
  modified_base (414)..(414): a, c, t, g, unknown or other
  misc_feature (414)..(414): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacgccctaagctcctaatctatgctgcatccagtttgacaaagtgggtcccagtcgaggttcagtggcagtggatcgtgggacagatttcactctcacatcagtaatctgactaacgtgaagtatttgactaactttatactgtacaanagtaattacaattgtttacgacctaagggactacgactaacaaattaacgaactgtgctagcactatcttgtacttcacttccttacccgccactctgtac

SEQ ID NO: 137265 - DNA, 501 bp, Homo sapiens
  misc_feature: GYAE6OF01ACC73.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccggggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtggggtcccatcgaggttcagtggcagtggatctgggtacagatttcactctcaccatcagtaatctgcaacgtgaagattttgcaacttattactgtcaacagaattacaatgtttcgctaagggacacgactacaaattaaacgaactgtggctgcaccatctgtcttcatcttcccgcatctgatacg

SEQ ID NO: 137266 - DNA, 528 bp, Homo sapiens
  misc_feature: GYAE6OF01CRSD7.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggccctaagctcctaatctatgctgcatccagtttgcaaagtggggtcccatcgaggttcagtggcagtggatctgggacagatttcactctcaccatcagtaatctgcaacgtgaagtattttagactaactttattaacttagttacaacaagtaaattaactaattgttttacggaccgtaaagggactacgaactaactaaattaacgaactgtagctgacacctatcttgtcttcatccttaccgccatctgtac

SEQ ID NO: 137267 - DNA, 563 bp, Homo sapiens
  misc_feature: GYAE6OF01CCSIF.46.67.G01.1.454.CMB.1.raw
tcagactagcagtacacgaccggtgctcgatttagagtatacatattgggtttggggagtctcggtcaggacacagcatggacatgagggtcccgctcagctcctggggctcctgctactctggctccgaggtgccagatgtgacatcgagctgacccagtctccatcctcctgtctgcaaccgtgggagacagtgtcaccatcacttgccgggcaagtcggaacattgacactatttaaatgtatcaacatagaccagggacggccctaagctcctaatctatgctgcatccagtttgacaaagtgggtcccagtcgagttcagtgcagtgatcgtggactagatttcactctcactatcagtaatctagacaacgtgaaagtatttagactaacgtttattactagtacaactaagtaactttaactaagttggtttaaccggactaaagggtactaaccggtaattaaacgtaaacttaaacgaacttggtacggacctacgacctacgtattcttcgttaccttcgtaccttcccgttacccgactacgttctggtaac

SEQ ID NO: 137268 - DNA, 545 bp, Homo sapiens
  misc_feature: GYAE6OF01DWKPI.46.67.G01.1.454.CMB.1.raw
  modified_base (331)..(331): a, c, t, g, unknown or other
  misc_feature (331)..(331): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctccagggagggctggaatacattggaagtgtctctcatagtggaggttcctattacagtccgtctctcaagagtcgagtcaccatatctctggacacgtccagcaatcagttttcccngaagatgagttctgtgaccgccgctgacacgggcgttttaatactgtgcgagagacggctattatgtattttggtagtggttatttcgtacaccctagtagtcgacggggctcggaccccgtggggccaggggtaatacgtggtcaccgtctccttagcctccaccgaacggcccatccggtccttccccctgccaccctcctccaagcgaccg

SEQ ID NO: 137269 - DNA, 501 bp, Homo sapiens
  misc_feature: GYAE6OF01CYC38.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacactatttaaatggtatcaacatagaccagggacggccctaagctcctaatctatgctgcatccagttttgcaaagtgggtcccatcgaggttcagtgcagtggatctgggacagatttcactctcacatcagtaatctgcaacgtgaagtattttgctaacttattactgtcaacagtaattacaatgttttacggacaagggacacgactaacaaattaacgaactgtagctgcaccatctgtcttcatccttcccgctatctgtac

SEQ ID NO: 137270 - DNA, 507 bp, Homo sapiens
  misc_feature: GYAE6OF01ENHCW.46.67.G01.1.454.CMB.1.raw
  modified_base (503)..(503): a, c, t, g, unknown or other
  misc_feature (503)..(503): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggccctaagctcctaatctatgctgcatccagtttgcaaagtgggtcccatcgaggttcagtgcagtggatctgggacagatttcactctcaccatcagtaatctgcaacgtgaagtattttgactaactttattactgtacaacagaattacaattgtttcggaccaagggactacgactaacaaattaaacgaactgtgctgcacctatctgtcttcactcttcccgcactcngtac

SEQ ID NO: 137271 - DNA, 497 bp, Homo sapiens
  misc_feature: GYAE6OF01EBJ9I.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccaggacgccctaagctcctaatctatgctgcatccagtttgcaaagtgggtcccatcgaggttcagtggcagtggatctgggacagatttcactctcacatcagtaatctgcaacgtgaagtattttgctaacttattactgtacaacagaatttacaatgtttacggcaaggacacgactacaaattaacgactagtggctagcaccatctgtcttcatctacccgcatctgtac

SEQ ID NO: 137272 - DNA, 505 bp, Homo sapiens
  misc_feature: GYAE6OF01D62FY.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggccctaagctcctaatctatgctgcatccagtttgcaaagtgggtcccatcgaggttcagtggcagtggatctgggacagatttcactctcaccatcagtaatctgcaacgtgaagtattttgctaacttattactgtacaacagaattacaatgttttcgcctaagggacacgactaacaaattaacgaactgtaggctgcacatactgtcttcactcttcccgctactctgtac

SEQ ID NO: 137273 - DNA, 506 bp, Homo sapiens
  misc_feature: GYAE6OF01EUP7V.46.67.G01.1.454.CMB.1.raw
  modified_base (485)..(485): a, c, t, g, unknown or other
  misc_feature (485)..(485): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacactatttaaattgtatcaacatagaccagggacgccctaagctcctaatctatgctgcatccagtttgcaaagtgggtccatcgaggttcagtgcagtgatctgggacagatttcactctcaccatcagtaatctgcaacgtgaagtattttgacaacttattactgtacaactagtaattacaatgtttcggaccaagggacaacgtaactaacaaattaaacgaactagtgactagctacatctgtcttnactcttcccgactatctgtac

SEQ ID NO: 137274 - DNA, 493 bp, Homo sapiens
  misc_feature: GYAE6OF01BDCMH.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggccctaagctcctaatctatgctgcatccagtttgcaaagtgggtcccatcgaggttcagtggcagtggatctgggacagatttcactctcaccatcagtaatctgcaacgtgaagattttgctaacttattactgtcaacagaattacaattgtttcgccaaggacagactacaattaacgaactgtgctgcaccatctgtcttcatcttcccgcatctgtac

SEQ ID NO: 137275 - DNA, 507 bp, Homo sapiens
  misc_feature: GYAE6OF01CBDF7.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggccctaagctcctaatctatgctgcatccagtttgcaaagtggggtcccatcgaggttcagtggcagtggatctgggacagatttcactctcaccatcagtaatctagcaacgtgaagattttgctaacttattactgtcaacagaattacaattgttttcggacctaagggacacggactaacaaattaacgaactgtaggctagcaccatctgtcttcatcttctgcctatcgtag

SEQ ID NO: 137276 - DNA, 614 bp, Homo sapiens
  misc_feature: GYAE6OF01EGL2Z.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccgcagctcccgaggggaagggctggaatacattggaagtgtctctcatagtggaggttcctattacagtccgtctctcaagagtcgagtcaccatatctctggacacgtccagcaatctacgttttccctagaagatgtagttctgtcgaccgccgctcgacgtacgggtcttttaattacgtgtcgcgagagacggtactattagttagttagttttggttagttggtttagtttacgtacctacctagtagtcggacggggtccgtccgtacccggtcgggccgacgggtaagtacgtcggtcctaccgtcctcctacgtccctcccacccgaaccggacccgacgtccggtcccgttccccgtccgtccctacccctacccgggggggtaccaacgcgtacccg

SEQ ID NO: 137277 - DNA, 525 bp, Homo sapiens
  misc_feature: GYAE6OF01BOU5L.46.67.G01.1.454.CMB.1.raw
  modified_base (415)..(415): a, c, t, g, unknown or other
  misc_feature (415)..(415): n is a, c, g, or t
  modified_base (453)..(453): a, c, t, g, unknown or other
  misc_feature (453)..(453): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacactatttaaatggtatcaacatagaccaggacgccctaagctcctaatctatgctgcatccagtttgcaaagtgggtccatcgaggttcagtgcagtggatcgtgggacagattcactctcacatcagtaatctagcaacgtgaagtatttgactaactttatactgtacaacagtaattanaattgttttacggacgtaagggtactaacgaccttaanaaacttaaacgaactgtagactagcaacctatcttgtccttacacttccttacccgacctacttcgtgtaac

SEQ ID NO: 137278 - DNA, 566 bp, Homo sapiens
  misc_feature: GYAE6OF01B4FAB.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattgtatcaacatagaccagggacggccctaagctcctaatctatgctgcatccagtttgcaaagtgggtcccatcgaggttcagtggcagtggatcgtgggacagatttcactctcaccatcagtaatctgcaacgtgaagtattttgactaacttattacttgtacaacagtaacttactaattgttttacggacctaaggggacctaacgaacttaactaaacgtttaaacgaaacttgtaggtacctaggacctaacctattcttcgttacctttacgtaactttacccgtttacccccgacctacgttccttggtaac

SEQ ID NO: 137279 - DNA, 513 bp, Homo sapiens
  misc_feature: GYAE6OF01EANFG.46.67.G01.1.454.CMB.1.raw
  modified_base (418)..(418): a, c, t, g, unknown or other
  misc_feature (418)..(418): n is a, c, g, or t
tcagactagcagtacacgaccggtgctcgatttagagtatacatattgggtttgggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacggccctaagctcctaatctatgctgcatccagtttgcaaagtgggtccatcgaggttcagtggcagtggatctgggacagatttcactctcaccatcagtaatctgcaacgtgaagtattttagtaacttattactgtacaactagaattanaattgttttacggacctaagggacacgtaactaacaaattaaacgaactagtgctgcaccatctgtcttcattccttcccgcctatctgattacg

SEQ ID NO: 137280 - DNA, 514 bp, Homo sapiens
  misc_feature: GYAE6OF01EPRJO.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctattaaattggtatcaacatagaccaggacggccctaagctcctaatctatgctgcatccagtttgcaaagtggggtcccatcgaggttcagtggcagtggatctgggacagatttcactctcaccatcagtaatctgcaacgtgaagtattttgctaacttattactgtacaacagaattacaatgttttcggacctaagggactacgaacttaacaaattaaacgaactagtagctgacacctatctgtcttcattccttcccgactactctgtac

SEQ ID NO: 137281 - DNA, 570 bp, Homo sapiens
  misc_feature: GYAE6OF01DRA6M.46.67.G01.1.454.CMB.1.raw
  modified_base (212)..(212): a, c, t, g, unknown or other
  misc_feature (212)..(212): n is a, c, g, or t
  modified_base (236)..(236): a, c, t, g, unknown or other
  misc_feature (236)..(236): n is a, c, g, or t
  modified_base (250)..(250): a, c, t, g, unknown or other
  misc_feature (250)..(250): n is a, c, g, or t
  modified_base (375)..(375): a, c, t, g, unknown or other
  misc_feature (375)..(375): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggcctttcggagaccctgtccctcacctgcgctgtctctggtncctcatcagtagtggtttcttcgnggggctgggtccgnagctcccgagggaagggctggaatacagttggaagtgtctctcagtagtggaggttcctattacagtccgtctctcaagagtcgagtcaccatatctctgacacgtccagcaatctagtttcccngaacatgagttctgtcgaccgccgctgacgacgggtctttattactgtgcgagagcgtcttattagtgttattttggagttaggttactttcgactacccgtagtacgtcggaccggggtctccggtacccgtggggcccgtaagggtacgtacgttcggtcctacccgttaccttcccgttagccccttacccg

SEQ ID NO: 137282 - DNA, 579 bp, Homo sapiens
  misc_feature: GYAE6OF01BHLNK.46.67.G01.1.454.CMB.1.raw
  modified_base (372)..(372): a, c, t, g, unknown or other
  misc_feature (372)..(372): n is a, c, g, or t
tcagactagcagtacacgaccggtgctcgatttagagtatacatattgggtttgggggacctccagtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagttagtggtttctcgtggggctgggtccgcagctccgagggaagggctggaatacattggaatgtctctcatagtggaggttcctattacagtccgtctctcaagagtcgagtcaccatatctctggacacgtcagcaatctagttttcccngaatatgtagttctgtacgaccgccgtctgaccacgggtcgttttaattacgtgtgcgagagacggcttatttagtgttagttttggagtttggttatttaccgactaccctagacgtcggaccggggtccgtccggaccccggttggggaccctaaggggtaataccgttcggtccgtacccgttcttcccttagcccgtaccccg

SEQ ID NO: 137283 - DNA, 503 bp, Homo sapiens
  misc_feature: GYAE6OF01AZAW9.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggccctaagctcctaatctatgctgcatccagtttgcaaagtggggtcccatcgaggtttcagtggcagtggatctgggacagatttcactctcaccatcagtaatctgcaacgtgaagattttgctaacttattactgtacaacagtaattacaattgttttcgaccaaggacacgactacaaattaacgaactgtgctgacacatctgtcttcactcttcccgctatctgtac

SEQ ID NO: 137284 - DNA, 501 bp, Homo sapiens
  misc_feature: GYAE6OF01E0SNH.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccaggacggccctaagctcctaatctatgctgcatccagtttgcaaagtgggtcccatcgaggttcagtggcagtggatctgggacagatttcactctcaccatcagtaatctgcaacgtgaagtattttgctaacttattactgtcaacagaattacaatgttttcggcaagggacacgactacaaattaaacgaactagtgctgacaccatctgtctcactcttacccgccatctgtac

SEQ ID NO: 137285 - DNA, 498 bp, Homo sapiens
  misc_feature: GYAE6OF01CBHLU.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggccctaagctcctaatctatgctgcatccagtttgcaaagtgggtcccatcgaggttcagtggcagtggatctgggacagatttcactctcaccatcagtatctgcaacgtgaagattttgctaacttattactgtacaacagaattacaatgttttcggacctaagggacacgactaacaattaacgaactgtgctgcacatctgtctcactcttcccgcatctgtac

SEQ ID NO: 137286 - DNA, 501 bp, Homo sapiens
  misc_feature: GYAE6OF01B6I7T.46.67.G01.1.454.CMB.1.raw
  modified_base (233)..(233): a, c, t, g, unknown or other
  misc_feature (233)..(233): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacaggttnacacctattaaatgtatcaacatagaccagggacggccctaagctcctaatctatgctgcatccagtttgcaaagtgggtcccatcgaggttcagtggcagtggatctgggacagatttcactctcaccatcagtaatctgcaacgtgaaagattttgactaacttattactgtcaacagaaattacaattgtttcgaccaagggacacgactaacaaattaacgaactgtagctagcacatctgtcttcatcttcccgcactctgac

SEQ ID NO: 137287 - DNA, 505 bp, Homo sapiens
  misc_feature: GYAE6OF01ARYD4.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggccctaagctcctaatctatgctgcatccagtttgcaaagtgggtcccatcgaggttcagtggcagtggatctgggacagatttcactctcaccatcagtaatctgcaacgtgaagtattttgctaacttattactgtacaacagaattacaattgtttacggacctaagggacacgaactacaaattaacgaactgtagctgcacatctgtcttcatcttccgacctatctgtac

SEQ ID NO: 137288 - DNA, 510 bp, Homo sapiens
  misc_feature: GYAE6OF01EGNT1.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatgtatcaacatagaccaggacgccctaagctcctaatctatgctgcatccagtttgcaaagtgggtcccatcgagttcagtggcagtgatctgggacagattcactctcaccatcagtaatctgcaacgtgaagtattttagtaacttattactagtacaacagtaattacaattgtttcgacaagggacacgtaactaacaaattaaacgactgtaggctcgacacctatcttgtcttacacttccttcccgacattctgatacg

SEQ ID NO: 137289 - DNA, 634 bp, Homo sapiens
  misc_feature: GYAE6OF01DMW96.46.67.G01.1.454.CMB.1.raw
  modified_base (218)..(218): a, c, t, g, unknown or other
  misc_feature (218)..(218): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatccctccctgtctgcaaccgtgggagacagtgtcaccatcacttgccgggnaagtcggaacattgacaccttatttaaattggtatcaacatagaccagggacggccctaagctcctaatctatgctgcatcctagtttgactaaaggtgggtacccagtcgaggtttcagtggcagtggatcgtgggacagatttcactctcaccattcaagtatctagctaacgtgaagtattttacgactaactttattactgttacaaactaacgtaaatttaactaagtttacggttttaccggaccctaaacggggtacctaaaccggtaaaccttaaacgtaaaaacgtttaaaccggaaacttaggtacgggtccttaaggaccctaaacccgtatttacccgttcgttacccttttacctaacctttaccctttacccccggaacccttacttccgttacggtaaacc

SEQ ID NO: 137290 - DNA, 501 bp, Homo sapiens
  misc_feature: GYAE6OF01EJZTO.46.67.G01.1.454.CMB.1.raw
  modified_base (482)..(482): a, c, t, g, unknown or other
  misc_feature (482)..(482): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggccctaagctcctaatctatgctgcatccagtttgcaaagtggggtcccatcgaggttcagtggcagtggatctgggacagatttcactctcaccatcagtaatctgcaacgtgaagattttgctaacttattactgtcaacagaattacaatgttttcggaccaagggacaacgactaacaaattaacgaactgtgctgacacatctgtctnactcttcccgcatctgtac

SEQ ID NO: 137291 - DNA, 509 bp, Homo sapiens
  misc_feature: GYAE6OF01CPHYP.46.67.G01.1.454.CMB.1.raw
  modified_base (488)..(488): a, c, t, g, unknown or other
  misc_feature (488)..(488): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacgccctaagctcctaatctatgctgcatccagtttgcaaagtgggtcccatcgaggttcagtgcagtgatctgggacagatttcactctcaccatcagtaatctgcaacgtgaagtattttgactaacttattactgtacaactagtaattaacaattgttttacggacctaagggactacgaactaacaaattaacgaactgtgctgcacatctgtcttanactcttacccgctatctgtac

SEQ ID NO: 137292 - DNA, 514 bp, Homo sapiens
  misc_feature: GYAE6OF01EQ6BQ.46.67.G01.1.454.CMB.1.raw
  modified_base (493)..(493): a, c, t, g, unknown or other
  misc_feature (493)..(493): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctattaaattggtatcaacatagaccagggacggccctaagctcctaatctatgctgcatccagtttgcaaagtgggtcccatcgaggttcagtggcagtggatctgggacagatttcactctcaccatcagtaatctgcaacgtgaagtatttgactaactttattactgtacaacagtaattactaattgttttacggacctaagggactaacgactaactaaattaaacgaatagtgctgacactatctgtcttnactcttcccgactatctgtac

SEQ ID NO: 137293 - DNA, 496 bp, Homo sapiens
  misc_feature: GYAE6OF01E4DS4.46.67.G01.1.454.CMB.1.raw
  modified_base (489)..(489): a, c, t, g, unknown or other
  misc_feature (489)..(489): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccaggacggccctaagctcctaatctatgctgcatccagtttgcaaagtgggtcccatcgaggttcagtggcagtggatctgggacagatttcactctcaccatcagtaatctgcaacgtgaagattttgctaacttattactgtcaacagaattacaatgtttcggaccaagggacacgactacaattaaacgaactgtgctgcaccatctgtcttcatcttccgccntctgtac

SEQ ID NO: 137294 - DNA, 516 bp, Homo sapiens
  misc_feature: GYAE6OF01ASSUH.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggccctaagctcctaatctatgctgcatccagtttgcaaagtggggtcccatcgaggttcagtggcagtggatcgtgggacagatttcactctcaccatcagtaatctgcaacgtgaagtatttgactaacttattactgtacaacagtaattacaattgttttcggacctaagggactacgactaactaaattaacgaactgtgtctgacacctatctgttctctatccttacccgctatcgtgtac

SEQ ID NO: 137295 - DNA, 548 bp, Homo sapiens
  misc_feature: GYAE6OF01B0ZEA.46.67.G01.1.454.CMB.1.raw
  modified_base (379)..(379): a, c, t, g, unknown or other
  misc_feature (379)..(379): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggaaggggctggaatacattggaagtgtctctcatagtggaggttcctattacagtccgtctctcaagagtcgagtcaccatatctctggacacgtccagcaaatcagttttccctgaagatgagttctgtgaccgccgctgacacgggcgtttattacngtgcgtagagacggctattatgtattttggagttggttatttcgactaccctagatcgacggggtctcgacccgtggggccagggaactactggtcaccgtctccttagcctccaccgagggcccagtccggtccttcccccgcggtccaccctcctccaagcgtaccc

SEQ ID NO: 137296 - DNA, 502 bp, Homo sapiens
  misc_feature: GYAE6OF01BNPLN.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggccctaagctcctaatctatgctgcatccagtttgcaaagtgggtcccatcgaggttcagtggcagtggatctgggacagatttcactctcaccatcagtaatctgcaacgtgaagattttgctaacttattactgtcaacagtaattacaattgttttcgccaagggacacgactaacaaattaaacgaactgtggctgcaccatctgtcttcatcttcccgccatctgtac

SEQ ID NO: 137297 - DNA, 548 bp, Homo sapiens
  misc_feature: GYAE6OF01BZGO4.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctctggggctgggtccggcagctcccagggagggctggaatacattggaagtgtctctcatagtggaggttcctattacagtccgtctctcaagagtcgagtcaccatatctctggacacgtccagcaatcagttttccctgaagatgagttctgtgaccgccgctgacacgggcgtttattactgtgcgagagacggctattatgtattttggagttggttatttcgtacacccgtagatcggacggggctcggaccccgtggggccagggaatactggtcaccgtctccttagcctccaccgacggcccatccggtccttcccccgtggtcccacccctccctccaacgcgacccg

SEQ ID NO: 137298 - DNA, 592 bp, Homo sapiens
  misc_feature: GYAE6OF01DOUMJ.46.67.G01.1.454.CMB.1.raw
  modified_base (222)..(222): a, c, t, g, unknown or other
  misc_feature (222)..(222): n is a, c, g, or t
  modified_base (257)..(257): a, c, t, g, unknown or other
  misc_feature (257)..(257): n is a, c, g, or t
  modified_base (333)..(333): a, c, t, g, unknown or other
  misc_feature (333)..(333): n is a, c, g, or t
  modified_base (346)..(346): a, c, t, g, unknown or other
  misc_feature (346)..(346): n is a, c, g, or t
tcagactagcagtacacgaccggtgctcgatttagagtatacatagttgggtttgggagtcgtcggtacaggaccacacgcatggacatgaggtcccgctcagctcctggggctcctgctactctggctcggaggtgccagatgtgactatcgagctgaccagtctccatcctcctgtctgcaaccggtgggagacaggtggtcaccatcacgttgccgggnaagtcggaacattgacacttattaaatgtatcaantagacaggacgccctaagctactaatctatgctgcatccgagttgcaagtgggtccatcgagttcagtgcagtgancgtagggacagtnttcacgtctcacatcagtactcagcaacgtgaatatttcgactaattatacttagactaaagtagtaaacttacgaaagtttcggtttacggaaccgaagggtaaccctaacgttaaccgttaaaccgttaaaagttttaaacgacgtttgggtacggtaccgtaacggtacgtaccgtagttacttcggttccttacgtaccgttacccgtttacccgacgttaacttcggttaacggttaaccc

SEQ ID NO: 137299 - DNA, 547 bp, Homo sapiens
  misc_feature: GYAE6OF01A6IRF.46.67.G01.1.454.CMB.1.raw
  modified_base (334)..(334): a, c, t, g, unknown or other
  misc_feature (334)..(334): n is a, c, g, or t
  modified_base (339)..(339): a, c, t, g, unknown or other
  misc_feature (339)..(339): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggaaggggctggaatacattggaagtgtctctcatagtggaggttcctattacagtccgtctctcaagagtcgagtcaccatatctctggacacgtccagcaatcagttttcccngaagntgagttctgtgaccgccgctgacacgggtctttatactgtgcgagagacggctattatgtattttggagttggttatttcgacaccctagagtcgacggggctcggacccgtggggccgagggatacgtggtcaccgtctccttacgcctccaccgacgggcccagtccggtccttcccccgtcggcctacccctcctccaagcgccc

SEQ ID NO: 137300 - DNA, 516 bp, Homo sapiens
  misc_feature: GYAE6OF01BFO62.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattgtatcaacatagaccagggacggccctaagctcctaatctatgctgcatccagtttgcaaagtggggtcccatcgaggttcagtggcagtggatctgggacagatttcactctcaccatcagtaatctgcaacgtgaagattttgactaacttattactgtacaacagaattacaattgtttcgaccaagggacacgactaacaaattaacgaactgtagctagccacctatcttgtcctttacattccttcccgacctactcgtgtaac

SEQ ID NO: 137301 - DNA, 502 bp, Homo sapiens
  misc_feature: GYAE6OF01BU8U1.46.67.G01.1.454.CMB.1.raw
  modified_base (494)..(494): a, c, t, g, unknown or other
  misc_feature (494)..(494): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggccctaagctcctaatctatgctgcatccagtttgcaaagtggggtcccatcgaggttcagtggcagtgatctgggacagatttcactctcaccatcagtaatctgcaacgtgaagattttgactaacttattactgtacaacagaatttacaatgttttcgccaaggacacgactaacaattaaacgaactgtggctgcaccatctgtcttcatcttcccgacnctctgtac

SEQ ID NO: 137302 - DNA, 516 bp, Homo sapiens
  misc_feature: GYAE6OF01DC0TP.46.67.G01.1.454.CMB.1.raw
  modified_base (217)..(217): a, c, t, g, unknown or other
  misc_feature (217)..(217): n is a, c, g, or t
  modified_base (509)..(509): a, c, t, g, unknown or other
  misc_feature (509)..(509): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggnaagtcggaacattgacacctatttaaatggtatcaacatagaccagggacggccctaagctcctaatctatgctgcatccagtttgcaaagtgggtcccatcgaggttcagtggcagtggatcgtgggacagattcactctcaccatcagtaatctgcaacgtgaagtattttgactaacttattactgtacaactagtaattactaattgttttacgactaaggacacgtaactaactaaattaacgaactgtgactgactacatctgttcttctactccttcccgacctntctgtac

SEQ ID NO: 137303 - DNA, 542 bp, Homo sapiens
  misc_feature: GYAE6OF01AIVSP.46.67.G01.1.454.CMB.1.raw
tcagactagcagtacacgaccggtgctcgatttagagtatacatattgggtttggtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggaagggctggaatacattggaagtgtctctcatagtggaggttcctattacagtcgtctctcaagagtcgagtcaccatatctctggacacgtccagcaatcagttttccctgaagatgagttctgtgaccgccgctgacacgggtcgtttatactgtgcgagagacggctattatgtatttttggagttggttatttcgacaccctagactcggacggggctcgacccgtgggccagggatacgtggtcaccgtctccttagcctccaccgacgggcccagtccggtccttccccctggcccaccctcctccagcgtccc

SEQ ID NO: 137304 - DNA, 539 bp, Homo sapiens
  misc_feature: GYAE6OF01BJAQP.46.67.G01.1.454.CMB.1.raw
  modified_base (288)..(288): a, c, t, g, unknown or other
  misc_feature (288)..(288): n is a, c, g, or t
  modified_base (334)..(334): a, c, t, g, unknown or other
  misc_feature (334)..(334): n is a, c, g, or t
  modified_base (347)..(347): a, c, t, g, unknown or other
  misc_feature (347)..(347): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggaaggggctggaatacattggaagtgtctctcatagtggaggttcctattacagtccgtctctcaagngtcgagtcaccatatctctggacacgtccagcaatcagttttcccngaagatgagttcngtgaccgcgctgacacgggcgtttatactgtgcgagagacggctattatgattttggattggttatttcgacaccctagatcgacggggctcgacccgtggggccagggtatacgtggtcaccgtctccttagcctaccaccgaagggcccatccggtccttcccccgtggtccaccctcctccaagcgacc

SEQ ID NO: 137305 - DNA, 498 bp, Homo sapiens
  misc_feature: GYAE6OF01DQWJJ.46.67.G01.1.454.CMB.1.raw
  modified_base (479)..(479): a, c, t, g, unknown or other
  misc_feature (479)..(479): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacggccctaagctcctaatctatgctgcatccagtttgcaaagtgggtcccatcgaggttcagtggcagtggatctgggacagatttcactctcaccatcagtaatctgcaacgtgaagatttgctaacttattactgtcaacagaattacaatgttttacggccaagggacacgactacaaattaacgaactgtagctgcaccatctgtcttnatcttacccgcatctgtac

SEQ ID NO: 137306 - DNA, 546 bp, Homo sapiens
  misc_feature: GYAE6OF01BHG0R.46.67.G01.1.454.CMB.1.raw
  modified_base (330)..(330): a, c, t, g, unknown or other
  misc_feature (330)..(330): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccgagggaaggggctggaatacattggaagtgtctctcataggtggaggttcctattacagtccgtctctcaagngtcgagtcaccatatctctggacacgtccagcaatcagttttccctgaagatgagttctgtcgaccgccgctgacgacgggtctttattacgtgtgcgagagacggctattatgtattttggagttggttatttcgactaccctagactcggacggggtctcggaccccgtggggccagggactacgtcggtcaccgtcctccttcgccctacccg

SEQ ID NO: 137307 - DNA, 513 bp, Homo sapiens
  misc_feature: GYAE6OF01DW5D7.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggccctaagctcctaatctatgctgcatccagtttgcaaagtgggtcccatcgaggttcagtggcagtggatctgggacagatttcactctcaccatcagtaatctgcaacgtgaagtattttgactaactttattactgtacaacagtaattacaattgttttacggacctaagggacacgtaactaacaaattaacgaactgtagctgacaccatctgtcttcacttcttcccgcatctgtac

SEQ ID NO: 137308 - DNA, 514 bp, Homo sapiens
  misc_feature: GYAE6OF01CN9M0.46.67.G01.1.454.CMB.1.raw
  modified_base (504)..(504): a, c, t, g, unknown or other
  misc_feature (504)..(504): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacgccctaagctcctaatctatgctgcatccagtttgcaaagtgggtcccatcgagttcagtgcagtggatctgggacagatttcactctcaccatcagtaatctgacaacgtgaaagtattttagactaactttattaactgtacaactagtaattacaattgttttacgacctaagggactacgaactaacaaattaacgaatgtgactgactacatctgtacttcactcttacccnctatctgtac

SEQ ID NO: 137309 - DNA, 501 bp, Homo sapiens
  misc_feature: GYAE6OF01BFYWN.46.67.G01.1.454.CMB.1.raw
  modified_base (494)..(494): a, c, t, g, unknown or other
  misc_feature (494)..(494): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggccctaagctcctaatctatgctgcatccagtttgcaaagtgggtcccatcgaggttcagtggcagtggatctgggacagatttcactctcaccatcagtaatctgcaacgtgaagtattttgctaacttattactgtcaacagaattacaattgtttcggaccaagggactacgactaacaaattaacgatgtgctgcacctatctgtcttcatccttcccgcntctgtac

SEQ ID NO: 137310 - DNA, 492 bp, Homo sapiens
  misc_feature: GYAE6OF01A6Q49.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggccctaagctcctaatctatgctgcatccagtttgcaaagtgggtcccatcgaggttcagtggcagtggatctgggacagatttcactctcaccatcagtaatctgcaacgtgaagatttgcaacttattactgtcaacagaattacaatgttttcgccaaggacacgactacaataacgaactgtaggctgcaccatctgtctcatcttcccgcatctgtac

SEQ ID NO: 137311 - DNA, 716 bp, Homo sapiens
  misc_feature: GYAE6OF01BDHHB.46.67.G01.1.454.CMB.1.raw
  modified_base (218)..(218): a, c, t, g, unknown or other
  misc_feature (218)..(218): n is a, c, g, or t
tcagactagcagtacacgaccggtgctcgatttagagtatacatattggggtttgggacgtctcggtcccacggacacgagcattggacactgaggtccccgctcagctcctcgggctcccttgctacgtctggcctccgaggtgcctagagtgtgacgactcgagcgtggaacccccagtcctccactccctccctgtctcgcaacccgtcgggtanacctaggttcgtccaaccctataccaacctttgcccggggactaagggttcgggaacgattggaactacccgttatttaaaacgttccggtaagtaccgaacctagtacgaccgagggtacggcccctaaagctaccttaatcgtaatgactgactaatcccagtttcgacgaaacgtgggtcccagtcggaggttcagtggaccagtagatctagggacacgacttacaaactctactaccgtacttacaagtaactacctagactaacggtacgtaagtactttacgactaaccttattacttagttactaacgtagtaacttaacaacttacggtttacggtaccctaagggtacctacggtaaccttaacgtaaactttaaaccgaaccgttacggtacgtaccgtacggtacccgtaaccggtacttaccggtccgttacgttacctaacgttcccgtttacccctacccgtacttcccgttccggtaacccg

SEQ ID NO: 137312 - DNA, 576 bp, Homo sapiens
  misc_feature: GYAE6OF01A3X9F.46.67.G01.1.454.CMB.1.raw
tcagactagcagtacacgaccggtgctcgatttagagtatacatattgggtttggggagtctcggtcaggacacagcatggacatgacgggtccccgctcagctccgtggggctcctgctactctggctccgaggtgccagatgtgacatcgagctcgacccagtctccatccctccctgtctgcaaccggtgggagacagtgtcaccatcacttggccgggcaagtcggaacattgacaccttatttaaattggtatacaacatagaccgagggaccgccctaagctacctaatctatgctgcactcctagtttgactaaaggtcggggtacccagtcggtaggtttcaggtggctagtggatcgtgggacagtattcactctcaccatcaagtaatctgacaacgtgaagttatttgactaacttattactgtacaacagtaatacaatttgtttaccggacgaagggaccaacgtaacttaactaaaacttaaacgaacgttgtacggctagacctacctattcgttcgttccttacgtactttcccgttccccgacctacttccgtagtaac

SEQ ID NO: 137313 - DNA, 518 bp, Homo sapiens
  misc_feature: GYAE6OF01AMYS1.46.67.G01.1.454.CMB.1.raw
  modified_base (341)..(341): a, c, t, g, unknown or other
  misc_feature (341)..(341): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggccctaagctcctaatctatgctgaatccagtttgcaaagtgggtccatcgaggttcagtggcagtggatcngggacagatttcactctcacatcagtaatctagacaacgtgaagtattttgactaacttattactgtacaactagtaattacaattcgtttacggactaagggactacgtaactaactaaacttaacgaactgtacgctgcacatctgtcttcattccttcccgactatctgtatac

SEQ ID NO: 137314 - DNA, 582 bp, Homo sapiens
  misc_feature: GYAE6OF01E5CVG.46.67.G01.1.454.CMB.1.raw
tcagactagcagtacacgaccggtgctcgatttagagtatacatattgggtttggggagtctcggtccaggacacaggcatggactatgagggtcccgctcagctcctggggctcctgctactctggctccgaggttgccagatgttgacatcgagcttgacccagtctccatcctcctgtctgcaaccggtgggagacaggtgtcacctatcacttgccgggcaagtcggaacattgacacctatttaaattcggtatcgaacatagaccagggacggccctaagctcctaatctagtcgctgcatcgagtttgcaagtgggtcccatcgagtttcagtggcagtgatcgtggacagatttcgacgtctcaccatcagtaactctgctaacgtgaagtattttgactaacttattactcgtactaacaagaattacaattaggttttccggacctaaagggacctaacggtaccttaactaaacgtttaaacgaacgttaggtaggtacgttagaccgtaccgtaattccgttgttccttacgaacttaccgtttaccccgacctacgttccgtgtaaccg

SEQ ID NO: 137315 - DNA, 587 bp, Homo sapiens
  misc_feature: GYAE6OF01CV5V1.46.67.G01.1.454.CMB.1.raw
  modified_base (195)..(195): a, c, t, g, unknown or other
  misc_feature (195)..(195): n is a, c, g, or t
  modified_base (217)..(217): a, c, t, g, unknown or other
  misc_feature (217)..(217): n is a, c, g, or t
  modified_base (226)..(226): a, c, t, g, unknown or other
  misc_feature (226)..(226): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacngtgtcaccatcacttgccgggnaagtcgaanttgacacttatttaaatgtatcaacatagaccagggacggaccctagctcctatctatgctgcatcctagtttgactaaaggttcggggtacccagtcggtaggttcaggtggcaggtggatcgtaggggacagtatttcacttctacacatcagtaatctagactaacgtagaaagttattttagacctaactttattacttgtactaacaagtaattactaagttgttttacggaccgtaacgggactaacgtaactaaactaaaacgttaacgaacgttggtacggaccttagaccgtaacctaattccgttacgttccttactacgttcccttacccgacttacttcgtacgtaacg

SEQ ID NO: 137316 - DNA, 539 bp, Homo sapiens
  misc_feature: GYAE6OF01B3264.46.67.G01.1.454.CMB.1.raw
  modified_base (335)..(335): a, c, t, g, unknown or other
  misc_feature (335)..(335): n is a, c, g, or t
tcagactagcagtacacgaccggtgctcgatttagagtatacatattgggtttgtcctcctgctggtgacagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccgaggggaaggggctggaatacattggaagtgtctctcatagtggaggttcctattacagtccgtctctcaagagtcgagtcaccatatctctggacacgtccagcaatcagttttccngaagatgagttctgtgaccgccgctgacacgggctttatactgtgcgagagacggctattatgtattttggagttggttatttcgactaccctagatcggacggggctcgacccgtgggccagggatacgtgtcaccgtctcctagcctccaccgacgggcccagtccggtccttcccccgtggccaccctcctccaagcgccg

SEQ ID NO: 137317 - DNA, 547 bp, Homo sapiens
  misc_feature: GYAE6OF01CCV16.46.67.G01.1.454.CMB.1.raw
  modified_base (289)..(289): a, c, t, g, unknown or other
  misc_feature (289)..(289): n is a, c, g, or t
  modified_base (334)..(334): a, c, t, g, unknown or other
  misc_feature (334)..(334): n is a, c, g, or t
  modified_base (338)..(338): a, c, t, g, unknown or other
  misc_feature (338)..(338): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggcagctcccgagggaagggctggaatacattggaagtgtctctcatagtggaggttcctattacagtccgtctctcaagngtcgagtcaccatatctctggacacgtcagcaatcagttttcccngaanatgagttctgtgaccgcgctgacacgggcttttatactgtgcgagagacggctattatgtattttggagttggttatttcgactacctagatcggacggggctcgacccgtggggccagggactacgtcggtctaccgtctccgttagcctccgaccgagggcccagtccggtccttcccccgtggcctaccctcctccaagcgtaccg

SEQ ID NO: 137318 - DNA, 487 bp, Homo sapiens
  misc_feature: GYAE6OF01EUEN2.46.67.G01.1.454.CMB.1.raw
  modified_base (455)..(455): a, c, t, g, unknown or other
  misc_feature (455)..(455): n is a, c, g, or t
  modified_base (464)..(464): a, c, t, g, unknown or other
  misc_feature (464)..(464): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctattaaatgtatcaacatagaccagggacggccctaagctcctaatctaatgctgcatccagtttgcaaagtgggtcccatcgaggttcagtggcagtgatctgggacagatttcactctcaccatcagtaatctgcaacgtgaagtattttcgctaaacttattactgtcaacagaattacatgtttcgacaaggacacgactacaataacatgtgcngcacatctntctacactctccgacatctgtac

SEQ ID NO: 137319 - DNA, 507 bp, Homo sapiens
  misc_feature: GYAE6OF01C24BC.46.67.G01.1.454.CMB.1.raw
  modified_base (497)..(497): a, c, t, g, unknown or other
  misc_feature (497)..(497): n is a, c, g, or t
  modified_base (502)..(502): a, c, t, g, unknown or other
  misc_feature (502)..(502): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacggccctaagctcctaatctatgctgcatccagtttgcaaagtgggtcccatcgaggttcagtgcagtggatctgggacagatttcactctcacatcagtaatctgacaacgtgaagtattttgactaactttattactgtacaactagtaattactaattgttttacgacctaagggactacgactaacaaattaacgaatgtgctgcacatctgtcttcatccttcccncactntgtac

SEQ ID NO: 137320 - DNA, 511 bp, Homo sapiens
  misc_feature: GYAE6OF01CEQUP.46.67.G01.1.454.CMB.1.raw
  modified_base (491)..(491): a, c, t, g, unknown or other
  misc_feature (491)..(491): n is a, c, g, or t
  modified_base (501)..(501): a, c, t, g, unknown or other
  misc_feature (501)..(501): n is a, c, g, or t
  modified_base (504)..(504): a, c, t, g, unknown or other
  misc_feature (504)..(504): n is a, c, g, or t
tcagactagcagtacacgaccggtgctcgatttagagtatacatattgggtttggggagtctcggtcaggacactagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggccctaagctcctaatctatgctgcatccagtttgcaaagtgggtcccatcgaggttcagtggcagtggatcgtgggacagatttcactctcaccatcagtaatctgcaacgtgaagtattttgactaacttattactgtacaactagtaattacaattgtttacggaccaagggacacgaactaacaaattaacgaactgtagctgcaccatctgtcttnactcttcccnctntctgtac

SEQ ID NO: 137321 - DNA, 512 bp, Homo sapiens
  misc_feature: GYAE6OF01DUK1I.46.67.G01.1.454.CMB.1.raw
  modified_base (490)..(490): a, c, t, g, unknown or other
  misc_feature (490)..(490): n is a, c, g, or t
  modified_base (505)..(505): a, c, t, g, unknown or other
  misc_feature (505)..(505): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatgtatcaacatagaccagggacggccctaagctcctaatctatgctgcatccagtttgcaaagtggggtcccatcgaggttcagtggcagtggatctgggacagatttcactctcaccatcagtaatctgcaacgtgaatattttgctaacttattactgtacaactagaattacaattgttttcggacctaagggacacgtaactaacaaattaaacgaactgtagactgacaccatctgtcttnacttcttcccgactntctgtac

SEQ ID NO: 137322 - DNA, 521 bp, Homo sapiens
  misc_feature: GYAE6OF01D1SGW.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctattaaattggtatcaacatagaccagggacgccctaagctcctaatctatgctgcatccagtttgcaaagtggggtcccatcgaggttcagtggcagtggatctgggacagatttcactctcaccatcagtaatctgctaacgtgtaaagtattttgactaacgtttattaactgtactaaacagaaatttacaattgttttacggaccaagggacaacgtactaacaaattaacgaactgtgctgcacctatctgtcttcacttccttccgacctatctgtac

SEQ ID NO: 137323 - DNA, 565 bp, Homo sapiens
  misc_feature: GYAE6OF01DSWTE.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagacagggacgccctaagctcctaatctatgctgcatccagtttgcaagtgggtccatcgagttcagtgcagtgatcgtggacagtatttcactctcacatcagtatctgacaacgtgaatatttgactaacttattactagtacaactaagtaattactaattaggttttaccggaccgtaacgggactaacgtaacttaaactaaaacgttaaacgaaacgttaggtacggtactagaccgtacctaattacgttcgttacctttactacttcccgttaccccgtacccttacttccgtcgtaacg

SEQ ID NO: 137324 - DNA, 511 bp, Homo sapiens
  misc_feature: GYAE6OF01CZ7LY.46.67.G01.1.454.CMB.1.raw
  modified_base (506)..(506): a, c, t, g, unknown or other
  misc_feature (506)..(506): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacggccctaagctcctaatctatgctgcatccagtttgcaaagtgggtcccatcgaggttcagtgcagtgatctgggacagatttcactctcacatcagtaatctgacaacgtgaaagtattttgactaactttattactgtacaactagtaattaacaattgtttacgaccaagggtacacgactaactaaattaacgaactgtagctgcacatctgtcttacatccttcccgactactntgtac

SEQ ID NO: 137325 - DNA, 523 bp, Homo sapiens
  misc_feature: GYAE6OF01DO059.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggccctaagctcctaatctatgctgcatccagtttgcaaagtgggtcccatcgaggttcagtggcagtggatcgtgggacagatttcactctcaccatcagtaatctagcaacgtgaagtattttgactaactttattactgtacaactagtaattactaattgttttacggaccaaggactacgaactaactaaattaacgaactgtagctagacacctatctgttcttacactccttcccgacctatctgtac

SEQ ID NO: 137326 - DNA, 667 bp, Homo sapiens
  misc_feature: GYAE6OF01CYFEH.46.67.G01.1.454.CMB.1.raw
  modified_base (195)..(195): a, c, t, g, unknown or other
  misc_feature (195)..(195): n is a, c, g, or t
  modified_base (222)..(222): a, c, t, g, unknown or other
  misc_feature (222)..(222): n is a, c, g, or t
tcagactagcagtacacgaccggtgctcgatttagagtatacatattgggtttggggagtctcggtcaggacacagcatggacatgagggtccccgctcagctccgtggggctcctgctactctggctccgaggtgccagatgtgacatcgagctgacccagtctccatccctccctgtctgcaaccggtggganacagtgtcaccatcacttggccggganaagtcggaacattgactacctatttaaatggtatacaacatagaccgagggaccgaccctaagctacctaatctatgctgctatcctagtttgacgtaaaggtcgggtacccagtcggtaggttcgaggtggcgaggtggtatcggtagggactagtatttcactctacacctatctaagtaactcgtagactaacgtagtaagttatttcgaacttaactttattaactagtaacaaactagttaaactttacgtaagtttcggttttaaccggaaccggtaaacgggtaacctaacgtaaacctttaaaactaaaacgttaaaccgaaccgttaggtacgggaccttacgaacccgttaaccctaagtttacccttcggtttaccctttacctaacccgttttccctttacccccggaattacctttaccgttaggttaaccc

SEQ ID NO: 137327 - DNA, 518 bp, Homo sapiens
  misc_feature: GYAE6OF01EJ2MA.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggccctaagctcctaatctatgctgcatccagtttgcaaagtgggtcccatcgaggttcagtggcagtggatctgggacagatttcactctcaccatcagtaatctgacaacgtgaagtattttgctaactttattactgtacaacagaattacaattgtttacggaccaagggacacgaactaacaaattaaacgaactgtgtctgaccaccattctgtccttcacttccttacccgaccattctgtac

SEQ ID NO: 137328 - DNA, 498 bp, Homo sapiens
  misc_feature: GYAE6OF01A5SAG.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggccctaagctcctaatctatgctgcatccagtttgcaaagtggggtcccatcgaggttcagtggcagtggatctgggacagatttcactctcaccatcagtaatctgcaacgtgaagattttgctaacttattactgtacaacagtaattacaattgtttcgcaaggactacgactaacaattaacgaatgtgctgcaccatctgtctcatcttcccgcctatctgtac

SEQ ID NO: 137329 - DNA, 507 bp, Homo sapiens
  misc_feature: GYAE6OF01BGQOY.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacggccctaagctcctaatctatgctgcatccagtttgcaaagtggggtcccatcgaggttcagtggcagtggatctgggacagatttcactctcaccatcagtaatctgcaacgtgaagtattttgactaaactttattaactgtacaacagaattacaattgttttcggacctaagggacacgactacaaattaacgaatgtagctgcacctatctgtcttcactctccgccatctgtac

SEQ ID NO: 137330 - DNA, 530 bp, Homo sapiens
  misc_feature: GYAE6OF01BJ7K6.46.67.G01.1.454.CMB.1.raw
  modified_base (361)..(361): a, c, t, g, unknown or other
  misc_feature (361)..(361): n is a, c, g, or t
  modified_base (503)..(503): a, c, t, g, unknown or other
  misc_feature (503)..(503): n is a, c, g, or t
  modified_base (508)..(508): a, c, t, g, unknown or other
  misc_feature (508)..(508): n is a, c, g, or t
  modified_base (520)..(520): a, c, t, g, unknown or other
  misc_feature (520)..(520): n is a, c, g, or t
  modified_base (525)..(525): a, c, t, g, unknown or other
  misc_feature (525)..(525): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacggccctaagctcctaatctatgctgcatccagtttgcaaagtcgggtcccagtcgagttcagtggcagtggatcgtagggacagatttcactcnctaccatcagtaatctagcaacgtgaagtattttgactaactttattactcgtacaactagtaaattacaagtttcgtttacggaccgtaagggaaccacgtaactaactaaacttaacgaactgtagctagccactatctntcttnacttccttaccnctatntgtac

SEQ ID NO: 137331 - DNA, 887 bp, Homo sapiens
  misc_feature: GYAE6OF01DWFWU.46.67.G01.1.454.CMB.1.raw
tcagactagcagtacacgaccggtgctcgatttagagtatacatattgggtttgggggagtctcggtcaggacacagcatggacatgtagggtcccgctcagctcctgggggctccgtgctactcgtggcctccggaggtcgaccgaagtaggtgtaggaactacgtcgggtacgtcgttacggaccctagtttcctaccgtacttccccttccgttgttcgtacggaccgtaaccgggtaggggaacgtacgtaggttcgtaccaaccggtatccttacggttccgggaccgggaacgtaacgggggttacccggaaactagttacgtaaccctaaccttttaaagttttaaacgttaggttaactaacctaaactaaggtaaccgaaccggtaacgggggttaaccccggtaaacccgttaaggtccttaaaccttaacgttacgttaaggttccgtccgtacggtacctaccgtaccggttaagggtttacggaacgttaaaggggtccggggtaccctaggtaccggtacggttacgtagggtcgggtacgtagggtaggtaacgtacgggtacgggaaactaagtttacttttaccgacgtttcctaccgtaacgtagtaaccggtaagttaacttccgtacgaaccgttaacggttaacgtaaagtttacgtttaacgaaccttaaactttaagttacttacgtaaactaacgtaaagtttaaacttaaactaaggtttacggtttaccggaaccggtaaaggaccgtaacgtaacctaaagtaaaacttaacgtaacgtgtacgtactagtacctaacgtagttacgggttcttaccttcgtaccgtttccgtaccccgtatacggtacgtagtaacccg

SEQ ID NO: 137332 - DNA, 501 bp, Homo sapiens
  misc_feature: GYAE6OF01BLNW7.46.67.G01.1.454.CMB.1.raw
  modified_base (483)..(483): a, c, t, g, unknown or other
  misc_feature (483)..(483): n is a, c, g, or t
  modified_base (494)..(494): a, c, t, g, unknown or other
  misc_feature (494)..(494): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggccctaagctcctaatctatgctgcatccagtttgcaaagtggggtcccatcgaggttcagtggcagtggatctgggacagatttcactctcaccatcagtaatctgcaacgtgaagattttgctaacttattactgtcaacagaattacaattgtttacggacctaagggacacgactacaaattaacgaactgtagctgcacatctgtcttnatcttcccgcntctgtac

SEQ ID NO: 137333 - DNA, 515 bp, Homo sapiens
  misc_feature: GYAE6OF01D8D38.46.67.G01.1.454.CMB.1.raw
  modified_base (510)..(510): a, c, t, g, unknown or other
  misc_feature (510)..(510): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggccctaagctcctaatctatgctgcatccagtttgcaaagtggggtcccatcgaggttcagtggcagtggatctgggacagatttcactctcaccatcagtaatctgcaacgtgaaagtattttagactaactttattacttgtacaactagaattacaatgttttacggccaagggactacgactaacaaattaacgaactgtgctgcactatctgtcttcacttcttacccgcctactntgtac

SEQ ID NO: 137334 - DNA, 571 bp, Homo sapiens
  misc_feature: GYAE6OF01D0O55.46.67.G01.1.454.CMB.1.raw
  modified_base (292)..(292): a, c, t, g, unknown or other
  misc_feature (292)..(292): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggcagcctcccgaggggaaggggctggaatacattggaagtgtctctcatagtggaggttcctattacagtccgtctctcaagngtcgagtcaccatatctctggacacgtccagcaatcagttttcccagaagatgagttctgtcgaccgccgctgacacgggctttatactgtgcgagagacggctattatgtattttggagttggtttatttcgactacccgtagacgtcggacggggctcggacccgtgggccgagggaatacgtggtcaccgtctccgttacgccctccaccgaacgggcccacgtccggtcccttccccccgtcgggtcccacccctaccctcccaagccgtacccg

SEQ ID NO: 137335 - DNA, 524 bp, Homo sapiens
  misc_feature: GYAE6OF01D8S5O.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattgtatcaacatagaccagggacgccctaagctcctaatctatgctgcatccagtttgcaaagtgggtcccatcgaggttcagtggcagtggatcgtgggacagtattcactctcacatcagtaatctgactaacgtgaagtatttagactaactttattactgtacaacagtaattacaattgtttacgacctaagggactaacgtactaacaaattaacgaactagtgctagacacctatctgtacttacacttccttacccgacctacttctgtaac

SEQ ID NO: 137336 - DNA, 549 bp, Homo sapiens
  misc_feature: GYAE6OF01DP1F0.46.67.G01.1.454.CMB.1.raw
  modified_base (336)..(336): a, c, t, g, unknown or other
  misc_feature (336)..(336): n is a, c, g, or t
  modified_base (364)..(364): a, c, t, g, unknown or other
  misc_feature (364)..(364): n is a, c, g, or t
tcagactagcagtacacgaccggtgctcgatttagagtatacatattgggtttgtcctcctgctggtggcagctcccagatgggtcctgtccctggtgcaactgcaggagtccgggcccacgactggtgaggccttcggagaccctgtccctcacctgcgctgtctctggtgcctccatcagtagtggtttctcgtggggctgggtccgcagctccgaggggaaggggctggaatacattggaagtgtctctcatagtggaggttcctattacagtccgtctctcaagagtcgagtcaccatatctctggacacgtccagcaatctagttttcccngaagatgagttctgtgaccgcgctgacncgggtctttatactgtgcgagagacggctattatgtattttggagttggtttatttcgacacccgtagagtcggacggggctcggacccgtgggccagggatacgtgtccacgtctcctagccctccaccgacgggcccagtccggtcccttcccctcggccctacccctcctccaagcgacccg

SEQ ID NO: 137337 - DNA, 547 bp, Homo sapiens
  misc_feature: GYAE6OF01A47DW.46.67.G01.1.454.CMB.1.raw
  modified_base (334)..(334): a, c, t, g, unknown or other
  misc_feature (334)..(334): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggaaggggctggaatacattggaagtgtctctcatagtggaggttcctattacagtccgtctctcaagagtcgagtcaccatatctctggacacgtccagcaatcagttttcccngaagatgagttctgtgaccgccgctgacacgggcgtttatactgtgcgagagacggctattatgtattttggagtggttatttcgacaccctagatcgacggggctcggacccgtggggccagggaactactggtcaccgtctccttagcctccaccgacgggcccagtccggtccttcccccgtcggtcccacccttcctcccaagcgcccg

SEQ ID NO: 137338 - DNA, 531 bp, Homo sapiens
  misc_feature: GYAE6OF01AN9X2.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccaggacggccctaagctcctaatctatgctgcatccagtttgcaaagtgggtcccatcgaggttcagtggcagtggatctgggacagatttcactctcaccatcagtaatctgcaacgtgaagtattttgactaactttattactgtacaactagaatttaacaattgttttaccggacctaagggactaacggaactaacaaattaaacgaactagtagactagaccacctatctgttcttctacttcctttacccgccattctgtaac

SEQ ID NO: 137339 - DNA, 531 bp, Homo sapiens
  misc_feature: GYAE6OF01DCF14.46.67.G01.1.454.CMB.1.raw
  modified_base (354)..(354): a, c, t, g, unknown or other
  misc_feature (354)..(354): n is a, c, g, or t
  modified_base (383)..(383): a, c, t, g, unknown or other
  misc_feature (383)..(383): n is a, c, g, or t
tcagactagcagtacacgaccggtgctcgatttagagtatacatagttgggtttggggagtctcggtcaggacaacagcatggacatgagggtccccgctcagctcctcggggctcctgctactctggctccgaggtgccgagatgtgacatcgagctgacccagtctccatcctccctgtctgcaaccgtgggagacagtgtcaccatcacttgccgggcaagtcggaacattgacactatttaaatgtatcaacatagaccagggacgccctaagctctaatctatgctgcatccagtttgcaagtgggtcccatcgagttcagtgcagtgatctgggacagatttcactcncaccatcagtaatctgacaacgtgaagtnttttagactaacttattactgtacaacagtaatttacaattgttttacgacctaagggtacacgactaactaaactttaacgaaacttgtagcgtgtacaaccgtatacttcgtctttacacttccttacccgcctaactctggtaac

SEQ ID NO: 137340 - DNA, 556 bp, Homo sapiens
  misc_feature: GYAE6OF01C2N77.46.67.G01.1.454.CMB.1.raw
  modified_base (337)..(337): a, c, t, g, unknown or other
  misc_feature (337)..(337): n is a, c, g, or t
  modified_base (357)..(357): a, c, t, g, unknown or other
  misc_feature (357)..(357): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggcagctcccgaggggaaggggctggaatacattggaagtgtctctcatagtggaggttcctattacagtccgtctctcaagagtcgagtcaccatatctctggacacgtccagcaatcagttttcccngaagatgagttctgtgaccncgctgaccacgggtcttttatactgtgcgagagacggctattatgtattttggagtgttatttcgactaccctagatcggacggggctcgaccccgtggggacccagggaatacgtggtcaccgtctccttacgcctccaccgaacgggcccagtccggtccttcccccctggccctaccctccctccaagcgtacccg

SEQ ID NO: 137341 - DNA, 542 bp, Homo sapiens
  misc_feature: GYAE6OF01B8THH.46.67.G01.1.454.CMB.1.raw
  modified_base (369)..(369): a, c, t, g, unknown or other
  misc_feature (369)..(369): n is a, c, g, or t
  modified_base (374)..(374): a, c, t, g, unknown or other
  misc_feature (374)..(374): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtgtttctctggggctgggtccgcagctccgagggagggctggaatacattggaagtgtctctcatagtggaggttcctattacagtccgtctctcaagagtcgagtcaccatatctctggacacgtccagcaatcagttttcccngaagntgagttctgtgaccgcgctgacacgggtcgtttattactgtgcgagagacgctattatgtattttggagttggttatttcgactaccgttagatcggacggggtcctaccggtaccccgtggggaccagggaactacgtcggtcaccgttctcccttgcccgtacccg

SEQ ID NO: 137342 - DNA, 508 bp, Homo sapiens
  misc_feature: GYAE6OF01D6WIK.46.67.G01.1.454.CMB.1.raw
  modified_base (504)..(504): a, c, t, g, unknown or other
  misc_feature (504)..(504): n is a, c, g, or t
tcagactagcagtacacgaccggtgctcgatttagagtatacatattgggtttggggagtctcggtcaggacacagaatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggccctaagctcctaatctatgctgcatccagtttgcaaagtgggtcccatcgaggttcagtggcagtggatctgggacagatttcactctcaccatcagtaatctgcaacgtgaagtattttgactaacttattactgtacaacagtaattacaattgtttcggaccaaggacacgtactaactaaattaacgactgtgctgcaccatctgtctcatccttccgacctatctgtntacg

SEQ ID NO: 137343 - DNA, 535 bp, Homo sapiens
  misc_feature: GYAE6OF01CFCGD.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggaaggggctggaatacattggaagtgtctctcatagtggaggttcctattacagtccgtctctcaagagtcgagtcaccatatctctggacacgtccagcaatctagttttccctgaagatgagttctgtgaccgccgctgacgacgggtcgtttattactgtgcgagagacggctattatgtattttggagttggtttattcgtacacctagagtcgacggggctccggacccgtgggccagggactacgtggtcacgtctccttgcctacccg

SEQ ID NO: 137344 - DNA, 618 bp, Homo sapiens
  misc_feature: GYAE6OF01CADBJ.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggccctaagctcctaatctatgctgcatccagtttgcaaagtgggtccactcgaggttcagtggcgagtggatctgggacagatttctactctcaccatcagtaatctagcaacgtgtaagtattttagtactaactttaacttaacttagtactaactaacgtaacttaacttaaagttacgttttacgggtacccgaaacggggtaacctaaccggtaaccttaaaccgtaaaacgttaaaacggtaaaccttaggttaggaccgttagaccgtaaccctaattaccttcggttacctttccttaacttccctttacccccggtaccctactttaccgtgttaaaccg

SEQ ID NO: 137345 - DNA, 574 bp, Homo sapiens
  misc_feature: GYAE6OF01DD6U2.46.67.G01.1.454.CMB.1.raw
  modified_base (335)..(335): a, c, t, g, unknown or other
  misc_feature (335)..(335): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctctggggctgggtccggcagctcccgaggggaaggggctggaatacattggaagtgtctctcatagtggaggttcctattacagtccgtctctcaagagtcgagtcaccatatctctggacacgtccagcaatcagttttcccngaagatgagttctgtcgaccgccgctgacgacgggtcgtttattactgtgcgagagacggtctattatgtatttttggagttggtttattcgactacctagatcggacggggcctcgacccgtggggccgagggaactacgtggtctaccgtcctccttacgccctccacccgaacgggccctacgtcccggttcccttcccccgtcggccctacccctccctacccaagccgtacccg

SEQ ID NO: 137346 - DNA, 652 bp, Homo sapiens
  misc_feature: GYAE6OF01B966J.46.67.G01.1.454.CMB.1.raw
  modified_base (216)..(216): a, c, t, g, unknown or other
  misc_feature (216)..(216): n is a, c, g, or t
tcagactagcagtacacgaccggtgctcgatttagagtatacatattgggtttggggagtctcggtcaggacacagcatggacatgagggtccccgctcagctcctggggctcctgctactctggctcgaggtgccagatgtgacatcgagctgacccagtctccatcctccctgtctgcaaccgtgggagacagtgtcaccatcacttgccgggnaagtcggaacattgacacttatttaaatgtatcaacatagaccagggaccgaccctaagctacctaatctatgctgcatcctagtttgacaaaggtcgggtacccaagttcggaggttcaggtcggactaggtggatcgtagggactagtactttcacttctacacctataccaagttaactcttagacgtaaacgttagaacgttattttacgaaccttaaatttaacttaacgtacgtaactaaactaagtaaactttaactaaacgttttacggttttaccggaaccgtaaagggtaccctaaacgtaaccttaaaactaaaacgttaaaacgtaaccgttggtacggtaccgtacgtaccgtaacctattaccgttcgttacccttactacctttacccttaccccggtactaacctttccgtaagtaaccg

SEQ ID NO: 137347 - DNA, 546 bp, Homo sapiens
  misc_feature: GYAE6OF01CLUNY.46.67.G01.1.454.CMB.1.raw
  modified_base (335)..(335): a, c, t, g, unknown or other
  misc_feature (335)..(335): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccaggggaaggggctggaatacattggaagtgtctctcatagtggaggttcctattacagtccgtctctcaagagtcgagtcaccatatctctggacacgtccagcaatcagttttcccngaagatgagttctgtgaccgccgctgacacgggcgtttattactgtgcgagagacggctattatgtatttttggagttggttatttcgacaccctagatcgacggggctcgaccccgtggggccagggtatacgtggtcaccgtctccttagcctccaccgaacgggcccagtccggtccttcccccgtggccaccctccctcccagcgcc

SEQ ID NO: 137348 - DNA, 944 bp, Homo sapiens
  misc_feature: GYAE6OF01DHUHG.46.67.G01.1.454.CMB.1.raw
tcagactagcagtacacgaccggtgctcgatttagagtatacatattggggtttggggaggtctcgggtcaccgggaccacgtacgcgattggacattggagggtccccgctcagctcctggggctcctgactactctggctccggaggttggccagatgtggtacctattcgagtctttaggacccagtctccatccgtccctgtctgcgaaccggtgggagacggaggtcgtcgaccatccgtacggtttcgccggggacaaggttccggaacctagtttcggaccaacccgttattttaaaagttgggtaacttaccaaacctacgttaaggtaacccgttaaggggtacccgggacccccttaaaggtccttacccttaaacgttccggttaacgttccggaccgtttcggacccgtaaacggttaccccggtaaggtttttacgggaaccgttaaaaacggggttcggggggtttacccccctaaggttacccgggttaaaggggttttaaccgtaaagggtttacgggtaccggtaagggttaacggggtaaacttaccggttaaggggggtaaaccttaagggttaacgtttttaacccgtaaacctttacccgttaccgtaaacccggtaacgttacccgtaaagggtttaaacttcccgtaacgtaccgtaaaccggttacggtaaaacggttacttttaacggtacctaaaactttaacgttacgtacgttactaaacgtagttaaacttaacgtaagttacggttttaccggaccgtaacgggtactaacggtacttaaacgtaaacgttaaccgtaacgttggttacggacttacggtaccgtaacccgtaggttaccgttacggttaccgtttaccgtaaacgttttcccgttaaccccggtaccgttaacggttccggtggttaaaccgg

SEQ ID NO: 137349 - DNA, 496 bp, Homo sapiens
  misc_feature: GYAE6OF01AWM4K.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacggccctaagctcctaatctatgctgcatccagtttgcaaagtggggtcccatcgaggttcagtggcagtggatctgggacagatttcactctcaccatcagtaatctgcaacgtgaagtattttgctaacttattactgtcaacagaattacaattgtttcgccaagggactacgactacaataacgactgtgctgcacatctgtcttcacttctcccgcactctgtac

SEQ ID NO: 137350 - DNA, 506 bp, Homo sapiens
  misc_feature: GYAE6OF01EJFIU.46.67.G01.1.454.CMB.1.raw
  modified_base (481)..(481): a, c, t, g, unknown or other
  misc_feature (481)..(481): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctattaaattggtatcaacatagaccagggacgccctaagctcctaatctatgctgcatccagtttgcaaagtgggtcccatcgaggttcagtggcagtggatctgggacagatttcactctcacatcagtaatctgcaacgtgaagtattttgactaactttattactgtacaactagtaattacaattgttttacggcctaagggacacgactaacaaattaacgaactgtgctagcacatctntcttcactccttccgccatctgtac

SEQ ID NO: 137351 - DNA, 509 bp, Homo sapiens
  misc_feature: GYAE6OF01EZOQN.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggccctaagctcctaatctatgctgcatccagtttgcaaagtgggtcccatcgaggttcagtggcagtggatctgggacagatttcactctcaccatcagtaatctgcaacgtgaagtattttgctaacttattactgtcaactagaattacaatgtttcggaccaagggacacgactaacaaattaaacgaactgtaggctagcacctatctgtcttcactcttacccgcctatctgtac

SEQ ID NO: 137352 - DNA, 537 bp, Homo sapiens
  misc_feature: GYAE6OF01CAT26.46.67.G01.1.454.CMB.1.raw
  modified_base (217)..(217): a, c, t, g, unknown or other
  misc_feature (217)..(217): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggnaagtcggaacattgacactatttaaatgtatcaacatagaccagggacgccctaagctcctaatctatgctgcatccagtttgacaaagtgggtcccagtcgaggttcagtggcagtggatcgtgggacagtatttcactctacacctatcagttaatctagactaacgtagaagtattttagactaacttattactgtacaactagtaattataagttgtttcggactaagggactacgtaactaactaaattaacgaacttgtaggactagacacctatacttgtaccttactacttccttcccgactactctgtaac

SEQ ID NO: 137353 - DNA, 553 bp, Homo sapiens
  misc_feature: GYAE6OF01BJIC3.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatgtatcaacatagaccaggacggccctaagctcctaatctatgctgcatccagtttgcaaagtgggtccatcgagttcagtggcagtggatcgtgggacagtatttcactctcacatcagtaatctagacaacgtgaagtatttgactaatttacttactgtacaactagtaaatttacaattcgtttacgacctaagggactaacgtaacttaacaaaactttaacgaacgttagtacggtctaacgtaccacctaagttcttacgttacttaccactttcccttaccccgacttagttcctggtaac

SEQ ID NO: 137354 - DNA, 704 bp, Homo sapiens
  misc_feature: GYAE6OF01DY068.46.67.G01.1.454.CMB.1.raw
  modified_base (191)..(191): a, c, t, g, unknown or other
  misc_feature (191)..(191): n is a, c, g, or t
  modified_base (227)..(227): a, c, t, g, unknown or other
  misc_feature (227)..(227): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaacggtggganacagtgtcaccatcacttgccgggacaagtcgaacntgactacttattaatgtatcaacatagaccagggaccgaccctaagcctacctaatctatgctgctatcctaggtttcgacgtaaaggtcggggtacccagtcgtaggttcaggttggctaggtggatcgtagggactagtactttcactctacactatacgtaagtaactcgtagacgtaacgttagtaaagttattttacgaaccttaaacttttactttaacgttacgtaacctaaacgtaacggttaaactttaacgtaacgtttcggttttacccgggaaccgtaaacggggtaaccctaaaccggttaaaccttaaaccgttaaaaacgtttaaaacccggtaaacgttacgggttaccgggtaccttaccggtaaccctaaccgttaacgttaccgtttccgtttacctttacccttaacccgttccccgtttacccccggtaaccttaacgttccgttaacggttaacc

SEQ ID NO: 137355 - DNA, 509 bp, Homo sapiens
  misc_feature: GYAE6OF01CK28I.46.67.G01.1.454.CMB.1.raw
  modified_base (418)..(418): a, c, t, g, unknown or other
  misc_feature (418)..(418): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatgtatcaacatagaccagggacgccctaagctcctaatctatgctgcatccagtttgacaaagtgggtcccatcgaggttcagtggcagtggatcgtgggacagatttcactctcacatcagtaatctgcaagtgaagtattttgactaattattactgtacaacagtaattanaattgttttacgacaaggacacgtaactaataaataacgactagtcgctagacactatctgtcttacacttccttcccgacacttctgtac

SEQ ID NO: 137356 - DNA, 505 bp, Homo sapiens
  misc_feature: GYAE6OF01A9WKJ.46.67.G01.1.454.CMB.1.raw
  modified_base (496)..(496): a, c, t, g, unknown or other
  misc_feature (496)..(496): n is a, c, g, or t
  modified_base (498)..(498): a, c, t, g, unknown or other
  misc_feature (498)..(498): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacgccctaagctcctaatctatgctgcatccagtttgcaaagtggggtcccatcgaggttcagtggcagtggatcgtgggacagatttcactctcaccatcagtaatctgcaacgtgaagtattttgactaactttattactgtacaacagtaattacaattgtttcggactaagggacacgtactaacaaattaacgaactgtgctgcaccatctgtctcactcttcccncntctgtac

SEQ ID NO: 137357 - DNA, 521 bp, Homo sapiens
  misc_feature: GYAE6OF01CNR0L.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccaggacgccctaagctcctaatctatgctgcatccagtttgcaagtgggtcccatcgagttcagtggcagtgatcgtgggacagatttcactctcacatcagtaatctgcaacgtgaagtattttgactaacttattactgtacaactaagtaattacaattgttttacggacctaagggactacgaactaacaaattaacgaacttgtacggactgacaccattactgttcttctactccttcccgacctactctgtaac

SEQ ID NO: 137358 - DNA, 538 bp, Homo sapiens
  misc_feature: GYAE6OF01DAT0I.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggccctaagctcctaatctatgctgcatccagtttgcaaagtgggtcccatcgaggttcagtggcagtggatctggggacagatttcactctcaccatcagtaatctgacaacgtgaaagtattttagactaactttattaactgtacaaactagtaaattaactaattggttttccggacctaaggggacctaacgtaactaactaaattaaaccgaacttgtaggctgactaccattctgtcttcacttccttcccgctactctgtac

SEQ ID NO: 137359 - DNA, 504 bp, Homo sapiens
  misc_feature: GYAE6OF01EK3K9.46.67.G01.1.454.CMB.1.raw
  modified_base (500)..(500): a, c, t, g, unknown or other
  misc_feature (500)..(500): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacggccctaagctcctaatctatgctgcatccagtttgcaaagtggggtcccatcgaggttcagtggcagtggatctgggacagatttcactctcaccatcagtaatctgcaacgtgaagtattttgactaacttattactgtacaacagaattacaattgtttacggacctaagggactacgtaactaacaaattaacgaactgtagctagcacatctgtctcatctccgcatntgta

SEQ ID NO: 137360 - DNA, 646 bp, Homo sapiens
  misc_feature: GYAE6OF01CDCKI.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtgggagacagtgtcaccatcacttgccgggcaagtcggaacattgacacttaatttaaattggtatacaacatagaccgagggaccggaccctaagctcctaatctatgctgcatcctagtttagacgaaaaggtcgggtcccagtcggtaggttcaggtggctaggtggatcgtagggaacagtactttcactcctacaaccatactaagtaatcgtagacgtaacggtagtaaagtattttacgaacttaaactttattaactagtaacaaacgtagtaaacttactaaagtttcgttttaccgggaaccctaaagggtaacctaacggtaaccttaaacgaaaacgtttaaaaccggaacgttgggtacggtacgtacgacccgtaaccctattacccttgttaccctttacaaccgtttccccttacccccgtactactttaccgtagtaaaccg

SEQ ID NO: 137361 - DNA, 564 bp, Homo sapiens
  misc_feature: GYAE6OF01CD8Z1.46.67.G01.1.454.CMB.1.raw
  modified_base (218)..(218): a, c, t, g, unknown or other
  misc_feature (218)..(218): n is a, c, g, or t
  modified_base (229)..(229): a, c, t, g, unknown or other
  misc_feature (229)..(229): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtgggagacagtgtcaccatcacttgccgggnaagtcggaacnttgacactatttaaatggtatcaacatagaccaggacggccctaagctcctaatctatgctgcatccagtttgcaaagtggggtcccatcgagttcagtggcagtggatcgtgggacagatttcactctcaccatcagtaatctagcgaacgtgaagtattttcgactaacttattactgtcaaacagtaattactaattgtttaccggacctaaagggtacctaacggtaactaactaaaagttaacgaactggtacggtactaggcctaaccgtattaccgtgttacccttactacttccgtttacccccgacctaacttccgttaggtaacc

SEQ ID NO: 137362 - DNA, 569 bp, Homo sapiens
  misc_feature: GYAE6OF01A0JUX.46.67.G01.1.454.CMB.1.raw
  modified_base (322)..(322): a, c, t, g, unknown or other
  misc_feature (322)..(322): n is a, c, g, or t
  modified_base (369)..(369): a, c, t, g, unknown or other
  misc_feature (369)..(369): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtgtttctctggggctgggtccgcagctccagggagggctggaatacattggaagtgtctctcatagtggaggttcctattacagtccgtctctcaagngtcgagtcaccatatctcgtggacacgtccagcaatcagttttcccngaagatgagttctgtgaccgccgctgacgacgggtctttattactgtgcgagagacggctattatgtatttttggagttggttactttcgactacccgtagacgtcggaccgggggtctaccggtaccccgtggggacccgaggggtaacttacgttcgggtaccgtacccgttccttacccgttacgtccctaccccgg

SEQ ID NO: 137363 - DNA, 812 bp, Homo sapiens
  misc_feature: GYAE6OF01CEUG5.46.67.G01.1.454.CMB.1.raw
tcagactagcagtacacgaccggtgctcgatttagagtatacatattagggttggggagtacggtccggtaacaggaccacaggcatcggacatgaggtcccgctcagcctctggggctcctggctactctggtctcggaggtgccagatcgagacgatccgagcctggacccagtctcatcctccctggtctgcaaccggtgggagacaggtgtccaccgatcacgttggaccgggtcaagtccggaacatttaggacctacctttaagttttaaaagttcggtaattcctaaaccattaaggaacctaagggggtaaccggtccccgttaaggaccttaccgtaaagttccccgtaaggtcggccttggactacgtcctaggttttgacgtaaacggttcgggggtacccacgttaccggaaggtttaccaggttacgggactagggtagggaatacggttacggggaactacggtattttacacttactaccgaacctagtccgtaaggtaactctagtaccgaaacggttaggaaacgttagttttacggaacttaaacgtttaacgtttaacgtacggttaaccgaaacgtaaccggtaaactttaacgtaaacgtttcggttttaaccgggaacccggtaaacgggaacccgtaaccggtaaacctttaaacgtaaaaccgtttaaacgggtaaccgtacgggttacggaacgttacggtacctaaccggtaacttaccgttcggtttacccgtacgttaacgttacccgttaccccgtaccttacgttccggttagggtaacccg

SEQ ID NO: 137364 - DNA, 540 bp, Homo sapiens
  misc_feature: GYAE6OF01CUYQR.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacggccctaagctcctaatctatgctgcatccagtttgcaaagtgggtcccatcgaggttcagtggcagtggatctgggacagatttcactctcaccatcagtaatctgcaacgtgaagtattttgactaactttattaactgttacaactagtaatttaacaatttgttttacggacctaagggacacgacttaacaaattaacgaacttagtacggctagctaccattccttgttacctttcacttccttaccccgtacctaacttctgtaac

SEQ ID NO: 137365 - DNA, 594 bp, Homo sapiens
  misc_feature: GYAE6OF01CG728.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacactatttaaatgtatcaacatagaccagggacgccctaagctcctaatctatgctgcatccagtttgcaaaggtcgggtcccatcgaggttcagtggctagtggatcgtgggacagtatttcactctcaccatacagtaatctgacaacgtagtaagtactttgacttaacttattactagtacaaactagtaaacttataatttcggttttaccggaaccgtaaagggtaacctaaccggtaaacttaaacgaaaacgtttaaacggaaacgttagggtacgacgtagtacctaacctacgttcttacgtttccttacctaacgttccttacccccggacttaacttcgttaggtaaacc

SEQ ID NO: 137366 - DNA, 539 bp, Homo sapiens
  misc_feature: GYAE6OF01CJOSU.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacactatttaaatggtatcaacatagaccagggacgccctaagctcctaatctatgctgcatccagtttgcaaagtgggtcccatcgagttcagtggcagtgatcgtgggacagtatttcactctcacatcagtaatctgcaacgtgaagtatttgactaacttattactgtacaactagtaattacaattcgttttacggaccgtaaggtaaccacgtaactaacgtaaagttaaacgaacttaggtacggactaggactaaccattctcgttcttacgacttccttacccgtctactcgtgtaacc

SEQ ID NO: 137367 - DNA, 510 bp, Homo sapiens
  misc_feature: GYAE6OF01BWMWP.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggccctaagctcctaatctatgctgcatccagtttgcaaagtgggtcccatcgagttcagtggcagtgatctgggacagatttcactctcaccatcagtaatctgcaacgtgaagtattttgactaacttattacttgtacaacagtaattacaattgttttcgacctaagggactacgactaacaaattaaacgaactgtagctagacacatctgtcttcacttcttcccgccatctgtac

SEQ ID NO: 137368 - DNA, 552 bp, Homo sapiens
  misc_feature: GYAE6OF01EDVQ9.46.67.G01.1.454.CMB.1.raw
  modified_base (336)..(336): a, c, t, g, unknown or other
  misc_feature (336)..(336): n is a, c, g, or t
  modified_base (526)..(526): a, c, t, g, unknown or other
  misc_feature (526)..(526): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccgaggggaaggggctggaatacattggaagtgtctctcatagtggaggttcctattacagtccgtctctcaagagtcgagtcaccatatctctggacacgtccagcaatcagttttcccngaacgatgagttctgtcgaccgccgctgacgacgggtcgtttatactgtgcgagagacggctattatgtattttggagttggttatttcgactaccctagatcggacggggctcgacccgtggggccagggaatacgtcggtcaccgtctcttcgcctccaccgacggcccagtccggtccttcccccgngcccacccctcctaccagcgtacccg

SEQ ID NO: 137369 - DNA, 536 bp, Homo sapiens
  misc_feature: GYAE6OF01C0S3Y.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagacagggacggccctaagctcctaatctatgctgcatccagtttgcaaagtgggtcccatcgaggttcagtggcagtgatctgggacagatttcactctcaccatcagtaatctgcaacgtgaagtattttgactaactttattaactgtacaactagtaaattaactaattacgttttacggacctaagggaacctacgtaactaactaaattaacgaacttagtaggactagactacctatctgtctttcactccttacccgacctacttctgtaac

SEQ ID NO: 137370 - DNA, 501 bp, Homo sapiens
  misc_feature: GYAE6OF01C7E32.46.67.G01.1.454.CMB.1.raw
  modified_base (481)..(481): a, c, t, g, unknown or other
  misc_feature (481)..(481): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacggccctaagctcctaatctatgctgcatccagtttgcaaagtgggtcccatcgaggttcagtggcagtggatctgggacagatttcactctcaccatcagtaatctgcaacgtgaagattttgactaacttattactgtcaacagaattacaatgttttcggaccaagggacacgactaacaaattaacgaactgtggctgcacatctgtcttnatcttacccgccatctgtac

SEQ ID NO: 137371 - DNA, 512 bp, Homo sapiens
  misc_feature: GYAE6OF01B5MYG.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagacaggacggccctaagctcctaatctatgctgcatccagtttgcaaagtgggtcccatcgaggttcagtggcagtgatctgggacagatttcactctcaccatcagtaatctgcaacgtgaaagtattttgactaacttattactgtacaacagtaattactaattgttttacggacctaagggactacgaacttaacaaattaacgaactgtagctgacactatctgtcttcactccttccactatctgtac

SEQ ID NO: 137372 - DNA, 608 bp, Homo sapiens
  misc_feature: GYAE6OF01BRRCI.46.67.G01.1.454.CMB.1.raw
  modified_base (355)..(355): a, c, t, g, unknown or other
  misc_feature (355)..(355): n is a, c, g, or t
tcagactagcagtacacgaccggtgctcgatttagagtatacatattgggtttggggagtctccggtcacggacacagcatggtacattggagggtccccgctcagctccgtggggctcctgctactctggctcggaggtgccagatggttgactatcgagctgacccagtctccattcctccctgtctgcgaaccggtgggaggacagttgtccaccgatcacttgccgggcaagtcggaacattcgacactattaaatgtatcaacatagacaggacgccctaagctctaatctagtgctgcatccagtttgctaaagtgggtcccagtcgaggttcagtggcagtgtatcgngggactagtattcgactctcaccatcagtaatctgacaacgtgaagtactttcgactaattattactgtactaacagtaacttaactaattggtttacggaaccgtaacgggaacctaacggtaacttaacgtaaaacgtttaaacgtaaccgttaggtacggtaccgtacgaccgtaaccctaagttaccttacgttaccttacgtaaccgtttcccgttaccccggaccttacgttccgttagttaacccg

SEQ ID NO: 137373 - DNA, 539 bp, Homo sapiens
  misc_feature: GYAE6OF01B14JT.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatgtatcaacatagacaggacgccctaagctcctaatctatgctgcatccagtttgcaaagtgggtcccatcgagttcagtgcagtgatcgtggacagatttcactctcaccatcagtaatctgacaacgtgaagtattttagactaatttattactgtacaacagtaacttactaagttcgtttacggaccgtaaagggacctaacgtaacttaaactaaattaaacgaacttgtagacttagactacctatcgttgttcttacgacttccttacccgacctacttcgtgtaacg

SEQ ID NO: 137374 - DNA, 618 bp, Homo sapiens
  misc_feature: GYAE6OF01DA86L.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggccctaagctcctaatctatgctgcatccagtttgcaaagtgggtcccatcgaggttcagtggcagtggatcgtgggacagatttcactctcaccatcagtatctgacaacgtgaagtattttagactaactttattaatgtacaaactagtaaatttactaaattcggtttttaccggaaccgtaaaggggtaacctaacggtaaaccttaaacgtaaaaactttaaaaccggaaaccgttacggttacgggtacttacggacccgtaaccctaagttacccttcggttacctttacctaactttacccgtttacccccggacccttaacttccgttacggttaaacc

SEQ ID NO: 137375 - DNA, 506 bp, Homo sapiens
  misc_feature: GYAE6OF01BX3HU.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccaggacgccctaagctcctaatctatgctgcatccagtttgcaaagtgggtcccatcgaggttcagtggcagtgatcgtgggacagtattcactctcacatcagtatctgcaagtgaagtattttgactaactttattactgtacaatagtaattactaattgtttcgacaaggactacgaactaacaaagttaacaactgtagctgccacatctcgtcttcacttcctccctacacttctgtaac

SEQ ID NO: 137376 - DNA, 536 bp, Homo sapiens
  misc_feature: GYAE6OF01ADCBY.46.67.G01.1.454.CMB.1.raw
  modified_base (376)..(376): a, c, t, g, unknown or other
  misc_feature (376)..(376): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcgaaacattgacacctatttaaattggtatcaacatagaccagggacggccctaagctcctaatctatgctgcatccagtttgacaaagtgggtcccatcgaggttcagtggcagtggatcgtgggacagtatttcactctcaccatcataatcngcaacgtgaagtatttgactaacttattactgtacaactagtaattactaattcgtttacggaccgaaggacaacgtaactaactaaattaacgaactgtgctagacctaccgtattcgtgttaccttactacgttcccttacccgacctactcgtgtac

SEQ ID NO: 137377 - DNA, 572 bp, Homo sapiens
  misc_feature: GYAE6OF01AOJR5.46.67.G01.1.454.CMB.1.raw
  modified_base (289)..(289): a, c, t, g, unknown or other
  misc_feature (289)..(289): n is a, c, g, or t
  modified_base (336)..(336): a, c, t, g, unknown or other
  misc_feature (336)..(336): n is a, c, g, or t
  modified_base (437)..(437): a, c, t, g, unknown or other
  misc_feature (437)..(437): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctcgtggggctgggtccggcagctcccgagggaaggggctggaatacattggaagtgtctctcatagtggaggttcctattacagtccgtctctcaagngtcgagtcaccatatctctggacacgtccagcaatctagttttcccngaacgatgagttctgtcgacccgccgctgacacgggtcgttttatacgtgtgcgagagacggctattatgtagttttggagttgttattcgacaccgtagntcggacggggctcggacccgtgggaccgagggatacgtgtacctaccgtctccgtcgcctaccgaccgaacgggcccacgtcccggttcccttcccccgtcggtccctacccctcctacccgaacgcgtaccccg

SEQ ID NO: 137378 - DNA, 525 bp, Homo sapiens
  misc_feature: GYAE6OF01B051H.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacggccctaagctcctaatctatgctgcatccagtttgcaagtgggtcccatcgaggttcagtggcagtgatcgtgggacagattcactctcacatcagtaatctagactaacgtgaagtatttgactaactttattactgtacaactagtaattactaattgtttacggacctaaggactaacgtaactaacaaattaacgaactgtagactagacaccattctcgtcttacgacttccttacccgactactctgtaac

SEQ ID NO: 137379 - DNA, 799 bp, Homo sapiens
  misc_feature: GYAE6OF01CAAFN.46.67.G01.1.454.CMB.1.raw
tcagactagcagtacacgaccggtgctcgatttagagtatacatattgggtttgggtcctcctgcctggtggcagctcccaggattgggtcctgtccctggtgcaactgcaggagtcgggcccacgactggtgagggcctttcgggagaccctgtccctcgtaccctgcgctgttctcgtggtcgcctccatcgagtagtggtttcttcgtggggctggggtccggcaggccgtcccgaggggaacggggctagggaactacgagttggaagttcgtctctcagtaggtggaggttcctattacagtccgtctctcgaagagtcgagtccaccgatactctctcggacacggtccagcaagtcgtacggttttcccaggaagtacttggtagttcgtaggtacggaacccgtccgtactacggaacgtaccggggtcgtttttaacgttacccggttggttacggacggtaacggtaacggtaccgggtaccttaagtttacttaggttaacgttttttacgggaaggttttacggttttaacgtttaccggtaaccgttaaccccgttaggtaacgttaccgggtaacgggggtccctaccggtaaccccggttagggggaacccgtaacgggggtaaccttaccggttcgggtacccgtacccgttaccgttacccggttaccggtccccgttacccgaacccggtaaccgggtacccctacggttcccggttccccgtttaccccccgtggtacccctaccccgttacccgtacccgtaaccggaccgtaccccgg

SEQ ID NO: 137380 - DNA, 520 bp, Homo sapiens
  misc_feature: GYAE6OF01C4WPZ.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggccctaagcctctaatctatgctgcatccagtttgcaaggtgggtcccatcgaggttcagtggcagtggatcgtgggacaggtatttcactctcaccatacagtaatctgacaacgtgaagtatttgactaacttattactgtacaacagtaattactaattgtttcggactaacggacacgtactaacaaattaacgaactgtagctgaccacctatctgtcttcacttccttacccgcctactctgtac

SEQ ID NO: 137381 - DNA, 507 bp, Homo sapiens
  misc_feature: GYAE6OF01DA33X.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaaccgtgggagacagtgtcaccatcacttgccgggcaagtcggaacattgacacctatttaaatggtatcaacatagaccagggacggccctaagctcctaatctatgctgcatccagtttgcaaagtgggtcccatcgaggttcagtgcagtgatctgggacagatttcactctcacatcagtaatctgacaacgtgaagtattttagactaacttattactgtacaacagtaattacaattgtttcgaccaagggacacgactaactaaattaacgaacttgtagctagcaaccatctgtcttcatccttacccgctatctgtac

SEQ ID NO: 137382 - DNA, 498 bp, Homo sapiens
  misc_feature: GYAE6OF01CINGX.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacggccctaagctcctaatctatgctgcatccagtttgcaaagtgggtcccatcgagttcagtgcagtgatctggacagatttcactctcaccatcagtaatctgcaacgtgaagtattttgactaacttattactgtcaacagaattacaattgtttacgacaagggacacgactacaaattaacgaactgtgactgacgacatctgtcttcatccttcccgctatctgtac

SEQ ID NO: 137383 - DNA, 534 bp, Homo sapiens
  misc_feature: GYAE6OF01AZK8V.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggccctaagctcctaatctatgctgcatccagtttgcaaagtggggtcccatcgaggttcagtggcagtggatcgtgggacagatttcactctcaccatcagtaatctgacaacgtgaagtatttcgactaactttattactgtacaactagaattacaattgttttacggacctaagggactaacggtaactaacgtaaaattaacgaacttgtacgctagacctactatctgtcttcacttccttacccgacacttcgtgtaac

SEQ ID NO: 137384 - DNA, 508 bp, Homo sapiens
  misc_feature: GYAE6OF01CLPX1.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacgccctaagctcctaatctatgctgcatccagtttgcaaagtgggtcccatcgaggttcagtgcagtggatcgtgggacagatttcactctcaccatcagtaatctgcaacgtgaagtatttgactaacttattactgtacaactagtaattactaattgttttacggacctaagggtacaacgactaacaaattaacgaactgtagctgacacatctgtcttcatccttccgcatctgtac

SEQ ID NO: 137385 - DNA, 561 bp, Homo sapiens
  misc_feature: GYAE6OF01BEU84.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcaattgccgggcaagtcgaacatgacactattaaatgtatcaacatagaccagggacgccctaagctcctaatctatgctgcatccagtttgcaagtgggtcccatcgagttcagtggcagtggatcgtgggacagtatttcactctcacatcagtaatctgactaacgtgaagtatttgactaacttattactgtacaaactagtaattaactaattgttttacggacctaaagggtactaacgtaactaactaaaacgttaaacgaacttaggtacggtactacggacctaacctattaccttcgtacctttacctaacgttcccttaccccgtaccttaacttccgttgtaac

SEQ ID NO: 137386 - DNA, 544 bp, Homo sapiens
  misc_feature: GYAE6OF01AGZNI.46.67.G01.1.454.CMB.1.raw
  modified_base (334)..(334): a, c, t, g, unknown or other
  misc_feature (334)..(334): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggaaggggctggaatacattggaagtgtctctcatagtggaggttcctattacagtccgtctctcaagagtcgagtcaccatatctctggacacgtccagcaatcagttttcccngaagatgagttctgtgaccgcgctgacacgggtctttatactgtgcgagagacggctattatgtattttggagttggttatttcgacacctagatcggacgggctcgacccgtggggccagggaatacgtggtcaccgtctccttagccctccaccgaacgggcccagtccggtccttccccgtcggccaccctccctccaagcgtcccg

SEQ ID NO: 137387 - DNA, 508 bp, Homo sapiens
  misc_feature: GYAE6OF01BYN4I.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggccctaagctcctaatctatgctgcatccagtttgcaaagtgggtcccatcgaggttcagtggcagtggatctgggacagatttcactctcaccatcagtaatctgcaacgtgaagtattttgactaacttattactgtacaaacagtaattacaattgttttcggaccaagggacacgactaacaaattaacgaactgtgctgcacatctgtcttcacttccttcccgctatctgtac

SEQ ID NO: 137388 - DNA, 571 bp, Homo sapiens
  misc_feature: GYAE6OF01AGEGI.46.67.G01.1.454.CMB.1.raw
  modified_base (334)..(334): a, c, t, g, unknown or other
  misc_feature (334)..(334): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggaaggggctggaatacattggaagtgtctctcatagtggaggttcctattacagtccgtctctcaagagtcgagtcaccatatctctggacacgtccagcaatcagttttcccngaagatgagttctgtgaccgccgctgacacgggtcgtttatactgtgcgagagacggctattatgtattttggagttggttatttcgactacccgtagacgtcggacggggtcctcggaccccgtggggcccagggtaactacgtggtccaccgtctccttacgccctccaccgaacggccccagtccggttacccttcccccgtcggtcccacccctccctacccaagcgtacccg

SEQ ID NO: 137389 - DNA, 518 bp, Homo sapiens
  misc_feature: GYAE6OF01AJKX2.46.67.G01.1.454.CMB.1.raw
  modified_base (508)..(508): a, c, t, g, unknown or other
  misc_feature (508)..(508): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggccctaagctcctaatctatgctgcatccagtttgcaagtgggtcccatcgaggttcagtggcagtggatcgtgggacagatttcactctcaccatcagtaatctgcaacgtgaagtattttgactaattattactgtacaactagtaattacaattgtttcggaccaagggacacgactaacaaattaacgaacttgtaggtactgacaccattctgttccttcacttccttcccacncttcctgtac

SEQ ID NO: 137390 - DNA, 534 bp, Homo sapiens
  misc_feature: GYAE6OF01BB1TG.46.67.G01.1.454.CMB.1.raw
  modified_base (370)..(370): a, c, t, g, unknown or other
  misc_feature (370)..(370): n is a, c, g, or t
  modified_base (427)..(427): a, c, t, g, unknown or other
  misc_feature (427)..(427): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggcctttcggagaccctgtccctcacctgcgctgtctctggtgcctccatcagtagtggtttcttctggggctgggtccgcagctccagggaagggctggaatacattggaagtgtctctcatagtggaggttcctattacagtccgtctctcaagagtcgagtcacatatctctggacacgtcagcaatcagttttcccngaagatgagttctgtgaccgccgctgacacgggtcgtttatactgtgcgagagacgntattatgtagttttggagttggttatttcgactaccgtagtagtcggacggggctccggacccgtggggccagggactacgtggtccaccgtctccttgcctacccg

SEQ ID NO: 137391 - DNA, 565 bp, Homo sapiens
  misc_feature: GYAE6OF01CCNLX.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaatggtatcaacatagacagggacgccctaagctcctaatctatgctgcatcctagtttgacaaggtcgggtcccagtcgaggttcagtgcagtgatcgtagggacagtatttcactctacaccatcagtactctgacaacgtagaagttattttgacttaacttattactagtacaactagtaaacttaacgtaattcgttttacggaccgtaaggtaaccaacgtaaccttaactaaacgttaaacgtaacgtgttacgctacgacctaaccgtattaccttgttacttacttacttcctcccctacctactcgttgtaacg

SEQ ID NO: 137392 - DNA, 596 bp, Homo sapiens
  misc_feature: GYAE6OF01CL1XO.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagacaggacgccctaagctcctatctatgctgcatccagtttgcaaagtgggtcccatcgagttcagtgcagtgatcgtgggacagtatttcactctcacatacagtaatctagcaacgtgaagtattttgactaattattactgtaccaactagtaaattaactaagttgttttaccggaccgtaagggtaacctaacgtaaccttaaactaaaacgtttaaaccgtaaaccgttaggttacgggtaccttaggacctaacccgtaattccttacggttaccctttactaacctttccctttacccccggtacccttaacgttcccgttagttaaaccg

SEQ ID NO: 137393 - DNA, 728 bp, Homo sapiens
  misc_feature: GYAE6OF01C2W96.46.67.G01.1.454.CMB.1.raw
  modified_base (226)..(226): a, c, t, g, unknown or other
  misc_feature (226)..(226): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcgganctagtacgactacttaattaagttagtactaacaactaagtaacgaaccggaaggggacccgtaacccgtaacgtcccttaacctaacttaccgttaagtcgtacgttcgactaacctaccgtttaggtttacgaacgtaaaggggttcccgggaaccctagtacgggttacgttacgagggttcggacgtagggtacggtacttcgggtacgggaactagtttactttaccacttcctaccaacctatacgtaagttactcgtacgaaccgttaaggtagtaaagttttagttacgtaacttaacttttaattacgttacgtaactaagtaacttaaacttaactaagttttccggtttaaccggaaccggtaaacggaaccgtaaaccgttaacttaaaacttaaacgttaaaaccgtagttacggacgtacgtacgtacccaacttacgttcttcgttaccttacgtaccttttcccgacccgtactcgttgttaaccg

SEQ ID NO: 137394 - DNA, 552 bp, Homo sapiens
  misc_feature: GYAE6OF01CX24N.46.67.G01.1.454.CMB.1.raw
  modified_base (336)..(336): a, c, t, g, unknown or other
  misc_feature (336)..(336): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggcagctcccaggggaaggggctggaatacattggaagtgtctctcatagtggaggttcctattacagtccgtctctcaagagtcgagtcaccatatctctggacacgtccagcaatcagttttcccngaagatgagttctgtgaccgcgctgacacgggtcgtttatactgtgcgagagacggctattatgtatttttggagttggttatttcgactaccctagatcgacggggctcggacccgtggggcccagggaactacgtggtcaccgtctccttacgcctccaccgacggcccagtccggtccttcccccgtgcccaccctcctcccaagcgtacccg

SEQ ID NO: 137395 - DNA, 514 bp, Homo sapiens
  misc_feature: GYAE6OF01CJ1E8.46.67.G01.1.454.CMB.1.raw
  modified_base (423)..(423): a, c, t, g, unknown or other
  misc_feature (423)..(423): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcgaacattgacactatttaaatgtatcaacatagacagggacggccctaagctcctaatctatgctgcatccagtttgcaaagtcggggtcccagtcgaggttcagtggcagtggatcgtgggacagtatttcactctcaccatcagtaatctagcaacgtgaagtattttgactaattattactgtacaactagtaattanaattgtttacgacgtaaggacacgaacttaacaaattaacgaactgtagctgacactatctgtcttcattcctacccgactactctgtaac

SEQ ID NO: 137396 - DNA, 636 bp, Homo sapiens
  misc_feature: GYAE6OF01DZ6C6.46.67.G01.1.454.CMB.1.raw
  modified_base (194)..(194): a, c, t, g, unknown or other
  misc_feature (194)..(194): n is a, c, g, or t
  modified_base (247)..(247): a, c, t, g, unknown or other
  misc_feature (247)..(247): n is a, c, g, or t
tcagactagcagtacacgaccggtgctcgatttagagtatacatattgggtttggggagtcgtcggtcaggacacagcatggacatgagggtccccgctcagctcctggggctcctgctactctggctccggaggtgccagatgtgacatcgagctgaccctagtctccatcctcctgtctgcaaccgtggganacagtgcaccatcacttgcggcaagtcgaacatgacactattaatgtatcaanatagacaggacgccctaagctacctaatctatgctgctatcctagtttcgcgaaacggtcgggtacccagtcggaggttcgagtggctaggtggtaagtcgtagggactaagtactttcgactcctacgaaccctagtaccagttaactacgttagacgtaacgtgtaaagttattttagaccttaaatttacgttaactacgttaactaaactaagttaacttaacgttaacgtttacggtttacgaaccgtaaacgggtaacctaaacgtaacgttaaactaaaacgttaaaccgaacttaggttacggtaccgtacgactaaccgtattactcgttaccttaccgtacctttacccttaccccgaccttaacttcgtagttaaccg

SEQ ID NO: 137397 - DNA, 558 bp, Homo sapiens
  misc_feature: GYAE6OF01DWX4G.46.67.G01.1.454.CMB.1.raw
  modified_base (217)..(217): a, c, t, g, unknown or other
  misc_feature (217)..(217): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggnaagtcggaacattgacacctatttaaatgtatcaacatagacagggacggccctaagctctaatctatgctgcatccagtttgacaaagtgggtacccagtcgaggttcagtggcagtggatcgtgggacagtatttcactctcacatcagtaatctagacaacgtgaagtatttgactaaactttattactagtactaactaagtaatttaactaagttcggttttacggaacgtaaagggactaacgtaacttaaactaaaattaacgaacttggtaggtactagaccgtaccattctcgttaccttacaacttccttacccgactacttcgtgtaacg

SEQ ID NO: 137398 - DNA, 532 bp, Homo sapiens
  misc_feature: GYAE6OF01D6BOJ.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacactatttaaatggtatcaacatagaccagggacgccctaagctcctaatctatgctgcatccagtttgcaaagtgggtcccatcgaggttcagtggcagtggatcgtggacagtatttcactctcacctatcagtaatctgacaacgtgtaagtatttgactaacttattactgtacaactagtaacttataattgttttacggacctaaggacctaacgtactaactaaacttaaacgaactagtacgtactagactacctatctcgtcttctacttccttacccgactactctgtac

SEQ ID NO: 137399 - DNA, 665 bp, Homo sapiens
  misc_feature: GYAE6OF01B175F.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgagggccttcggagaccctgtccctcacctgcgctgtctctggtgcctccatcagtagtggtttcttcgtggggctgggtccggcagctcccgaggggaagggctggaatacattggaagtgtctctcatagtggaggttcctattacagtccgtctctcaagagtcgagtcaccatatctctggacacgtcagcaatctacgttttccagaagatgagttctgtcgaccgccgctgacgacgggtctttattactgtgcgagagacggactattagtgttagttttggtagttggtttatttcggtaacctacccgtagtacgtcgggtaccggggtcctaccggaccccgttggggacccgaaggggtaaacgttaccgttcggttacccgtacccggttccttacccgtttacgccccgttacccgaacccggtaacggggcccctaacggttccccgggttacccctttcccccccggtacgggtaccccctacccccgttccccgttaacccgaaacggtaccggtaaccccg

SEQ ID NO: 137400 - DNA, 563 bp, Homo sapiens
  misc_feature: GYAE6OF01EOLJA.46.67.G01.1.454.CMB.1.raw
  modified_base (337)..(337): a, c, t, g, unknown or other
  misc_feature (337)..(337): n is a, c, g, or t
  modified_base (532)..(532): a, c, t, g, unknown or other
  misc_feature (532)..(532): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggcagctcccgaggggaaggggctggaatacattggaagtgtctctcatagtggaggttcctattacagtccgtctctcaagagtcgagtcaccatatctctggacacgtccagcaatcagttttcccngaagatgagttctgtgaccgcgctgacacgggtctttatacgtgtgcgagagacggctattatgtattttggagttgtttattcgactacctagagtcggacggggctcggacccgtggggaccagggtaattcgtggtcaccgtctcctacgcctaccgaccgacggccctagttcccggtcctttccccccgnggtccctacccctcctacccaagcgtacccg

SEQ ID NO: 137401 - DNA, 502 bp, Homo sapiens
  misc_feature: GYAE6OF01BJ7UU.46.67.G01.1.454.CMB.1.raw
  modified_base (495)..(495): a, c, t, g, unknown or other
  misc_feature (495)..(495): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctattaaatgtatcaacatagaccagggacgccctaagctcctaatctatgctgcatccagtttgcaaagtgggtcccatcgaggttcagtggcagtggatctgggacagatttcactctcaccatcagtaatctgcaacgtgaagtattttgactaactttattactgtacaacagtaattacaattgttttcgacctaagggactacgaactaacaaattaacgaatgtgctgcacatctgtcttcatcttcccgacntctgtac

SEQ ID NO: 137402 - DNA, 508 bp, Homo sapiens
  misc_feature: GYAE6OF01B33U8.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggccctaagctcctaatctatgctgcatccagtttgcaaagtgggtcccatcgagttcagtggcagtgatcgtggacagatttcactctcaccatcagtaatctgcaacgtgaagtattttgactaacttattactgtacaactagtaattacaattgtttcgacctaagggactacgactaacaaattaacgaactgtgctgcacctatctgtcttcactccttcccgccactctgtac

SEQ ID NO: 137403 - DNA, 511 bp, Homo sapiens
  misc_feature: GYAE6OF01A2XGV.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatgtatcaacatagaccagggacgccctaagctcctaatctatgctgcatccagtttgcaaagtgggtcccatcgaggttcagtggcagtggatcgtgggacagatttcactctcaccatcagtaatctgcaacgtgaagtatttagactaacttattactgtacaacagtaattacaattgtttcgaccaaggacacgactaactaaataacgaactgtagactgcctacatactcgtcttcacttccttcccgacctatctgtaac

SEQ ID NO: 137404 - DNA, 582 bp, Homo sapiens
  misc_feature: GYAE6OF01B9SXG.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggccctaagctcctaatctatgctgcatccagtttgcaaagtggggtcccatcgaggttcagtggcagtggatctgggacagatttcactctcaccatcagtaatctgcaacgtgaagtattttgactaactttattacttagtacaaacagtaaatttaacaattgttttaccggacctaaggggaactaacggtaacttaaactaaaagtttaaaccgaacgttagttagggaccttaggaccgtaaccctaattccttcggttacctttactaactttccctttaccccggtaccctacttccgtgttaac

SEQ ID NO: 137405 - DNA, 709 bp, Homo sapiens
  misc_feature: GYAE6OF01ED9GC.46.67.G01.1.454.CMB.1.raw
tcagactagcagtacacgaccggtgctcgatttagagtatacatattggggttttgggggagtctcggtcagggacacctagccagtggaccaagtcgtacgggtcccccgtcgtcagcctcctggggcttcctgctactctggctccgacgtgccgaagtagtgtgacattcggtacgtcttgaccctagttctaccgatccctcctgtctgcaaccgtgggagacgaggtgtcggaccgattcgaccttggcccgggtggaacgttcggaaactattcgacctaccttaatttaaacttggtacttcaacgattacgaaccgtagggaccggcccttaagcgtacctaatcttagtcgcctgtcctacgtccggaggtttcgacgaaagggttcggggtcccagtacgtaggttcaagggtggcgtaggtacggaaatcgtgggacagtacttcgacgtcgacactatacctaagtactctaggactaacgtacgtaaactaattttcgactaactttattacgtgtacaaactagtaaacttacaagttacggtttcgaaccgtaagggtacctaacggtaacttaacgtaaagtttaaacgtaacgttaggtcggactaaggacctaaccgttaattaccgttaacgttaacctttacgaacgtttacccgtttaccccgaccggtttaattacccgtgttaacg

SEQ ID NO: 137406 - DNA, 508 bp, Homo sapiens
  misc_feature: GYAE6OF01DLDWB.46.67.G01.1.454.CMB.1.raw
  modified_base (227)..(227): a, c, t, g, unknown or other
  misc_feature (227)..(227): n is a, c, g, or t
  modified_base (498)..(498): a, c, t, g, unknown or other
  misc_feature (498)..(498): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaanattgacacctatttaaatgtatcaacatagaccagggacgccctaagctctaatctatgctgcatccagtttgcaaagtgggtcccatcgaggttcagtgcagtggatcgtgggacagatttcactctcaccatcagtaatctgacaacgtgaagtattttgactaacttattactgtacaacagtaattacaattgtttacggactaagggacacgtactaactaaattaaacgaactagtgactgactacatctgtcttcactcttccnctatctgtac

SEQ ID NO: 137407 - DNA, 574 bp, Homo sapiens
  misc_feature: GYAE6OF01DEJ1V.46.67.G01.1.454.CMB.1.raw
  modified_base (337)..(337): a, c, t, g, unknown or other
  misc_feature (337)..(337): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggcagctcccgaggggaaggggctggaatacattggaagtgtctctcatagtggaggttcctattacagtccgtctctcaagagtcgagtcaccatatctctggacacgtccagcaatcagttttcccngaagatgagtttctgtcgaccgccgctgacgacgggtctttaattactgtgcgagagacggcttattatgtatttttggagttggtttatttcgacctacctagacgtcggacggggcctcgacccgtggggaccgagggactacgtcggtccaccgtctccttacgccctccaccgaacgggccctacgtccggtccttcccccgtcggtcccacccctcctaccaagcgtacccg

SEQ ID NO: 137408 - DNA, 504 bp, Homo sapiens
  misc_feature: GYAE6OF01B6XKZ.46.67.G01.1.454.CMB.1.raw
  modified_base (411)..(411): a, c, t, g, unknown or other
  misc_feature (411)..(411): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacactattaaatggtatcaacatagaccagggacggccctaagctcctaatctatgctgcatccagtttgcaaagtgggtcccatcgagttcagtggcagtggatcgtgggacagatttcactctcaccatcagtaatctgcaacgtgaagtattttgactaactttattactgtacaanagtaattacaatgtttcggacaaggacaacgactaacaaattaacgaacttgtggctgcacctatctgtcttcactcttcccgacatctgtac

SEQ ID NO: 137409 - DNA, 505 bp, Homo sapiens
  misc_feature: GYAE6OF01AZH2C.46.67.G01.1.454.CMB.1.raw
  modified_base (483)..(483): a, c, t, g, unknown or other
  misc_feature (483)..(483): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacgccctaagctcctaatctatgctgcatccagtttgcaaagtggggtcccatcgaggttcagtggcagtggatctgggacagatttcactctcacatcagtaatctgcaacgtgaaagtattttgactaacttattactgtcaacagtaattacaattgtttcgacaagggacaacgactaacaaattaacgaactgtgctagcactatctgtcttnacttctcccgactactctgtac

SEQ ID NO: 137410 - DNA, 558 bp, Homo sapiens
  misc_feature: GYAE6OF01DCQ2B.46.67.G01.1.454.CMB.1.raw
  modified_base (350)..(350): a, c, t, g, unknown or other
  misc_feature (350)..(350): n is a, c, g, or t
tcagactagcagtacacgaccggtgctcgatttagagtatacatattgggtttggggagtctcggtcaggacacagaatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacactatttaaatggtatcaacatagaccagggacggccctaagctcctaatctatgctgcatccagtttgacaaaggtcgggtcccatcgagttcagtgcagtgatcgtgggacagtnttcactctcacatcagttaatctagcaacgtgaagtattttgactaacttattactgtacaaacagtaattaactaatttcggtttacggaccgaaagggtaccaacgtaactaaactaaattaaacgacgttagtacgtctacgaccacctacgttcttgttccttactacttcccttaccccgtacctattccttagtacttaccg

SEQ ID NO: 137411 - DNA, 519 bp, Homo sapiens
  misc_feature: GYAE6OF01DOEAO.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcgaacatgacactattaatgtatcaacatagaccagggacgccctaagctctaatctatgctgcatccagtttgacaagtgggtcccatcgaggttcagtggcagtggatcgtgggacagtatttcactctcacatcagtaatctgacaacgtagtaagtattttagactaactttattactagtacaactagtaattactaattcggtttacggaccgaaagggactacgtaactaactaaattaacgactgtgctagacactatctgtcttcacgttcctacccgactatctgtac

SEQ ID NO: 137412 - DNA, 521 bp, Homo sapiens
  misc_feature: GYAE6OF01CJGS9.46.67.G01.1.454.CMB.1.raw
  modified_base (419)..(419): a, c, t, g, unknown or other
  misc_feature (419)..(419): n is a, c, g, or t
  modified_base (513)..(513): a, c, t, g, unknown or other
  misc_feature (513)..(513): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacgccctaagctcctaatctatgctgcatccagtttgacaaaggtcggggtcccagtcgaggttcaggtggcagtggatcgtgggacagatttcactctcacatcagtatctagcaacgtgtaatattttagactaacttattactgtactaanagtaattactaattgtttacgactaagggactacgtaactaacaaattaacgaactgtagctagacacctatctgtctatactccttcccactntcgtgtac

SEQ ID NO: 137413 - DNA, 593 bp, Homo sapiens
  misc_feature: GYAE6OF01BNFGG.46.67.G01.1.454.CMB.1.raw
  modified_base (379)..(379): a, c, t, g, unknown or other
  misc_feature (379)..(379): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctcgtggggctgggtccgcagctccgagggaagggctggaatacagttggaagtgtctctcatagtggaggttcctattacagtccgtctctcaagagtcgagtcaccatatctctgacacgtccagcaatctacgttttcccagaagntgagttctgtcgaccgccgctgacgtacgggtctttatacgtgtgcgagagacgtcttagttagtgttagttttggagttggtttattacgaccgtacccgtaggtacgtccgggaccggggtcctacccgggaccccggttgggggacccgtaggggtaacttaccggtcgggtacctacccggttaccttcccgttacgccctaacccccgg

SEQ ID NO: 137414 - DNA, 541 bp, Homo sapiens
  misc_feature: GYAE6OF01D2BD8.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctattaaattgtatcaacatagaccagggacgccctaagctcctaatctatgctgcatccagtttgcaaagtgggtcccatcgaggttcagtggcagtggatcgtgggacagatttcactctcacatcagtaatctgacaacgtgaagtattttgactaactttattacttgtacaactagtaactttacaattgtttacggacctaagggacctaacgtaacctaactaaattaaacgaacgttagtacggactagactacctattcttgtccttctacttccttaccccgtcctactctgtaac

SEQ ID NO: 137415 - DNA, 806 bp, Homo sapiens
  misc_feature: GYAE6OF01EM4BN.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgacgacggtggacgacgtagtcgtaccactactacctacgtccgggccggacgtaacggtaaccggaacttagttacgaacctaacttttaaatttaagttacggtactaaccaaactaacgtaaccgaaccggaacggggaccccgtaacccgtaagtcccttaacctactacgttagtcgtcgtcgactacctacgtttaggttcgaacggtaagggttccggacctagtacggttacgtacgaggtcggacgtagggtagtacttacgggacggaacgtaagtttacttacgtaccctcgtaccaactactacgttaaagttacttccgacgaaccgtaaggttaacggtaaagttttacgtttaccgtaacctttaaacttttactttaaccgtacgtaaacctaaacgtaagtttaaacttaacttaacggtttttcgggttaacccgaaacgggtaaacggaaccgtaaaccgttaaacttaaaacgtttaaaacgtaaaccgttacggtacgggtaccggtaccgtaccgtaaccctaaccgttagtttaccgtacgttttaccctacgttaccccgttttccccggtacccctaacgttacctttcgtaagttaaaccc

SEQ ID NO: 137416 - DNA, 504 bp, Homo sapiens
  misc_feature: GYAE6OF01CNVGX.46.67.G01.1.454.CMB.1.raw
  modified_base (479)..(479): a, c, t, g, unknown or other
  misc_feature (479)..(479): n is a, c, g, or t
  modified_base (499)..(499): a, c, t, g, unknown or other
  misc_feature (499)..(499): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacggccctaagctcctaatctatgctgcatccagtttgcaaagtgggtcccatcgaggttcagtggcagtggatctgggacagatttcactctcaccatcagtatctgcaagtgaagtatttgactaactttattactgtacaacagtaacttacaattgtttccgactaagggactacgactaacaaattaacgaactgagctgacacatctntctcactccttcccgcactntgtac

SEQ ID NO: 137417 - DNA, 547 bp, Homo sapiens
  misc_feature: GYAE6OF01BH5H8.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggcagctcccgagggaaggggctggaatacattggaagtgtctctcatagtggaggttcctattacagtccgtctctcaagagtcgagtcaccatatctctggacacgtccagcaatcagttttccctgaagatgagttctgtgaccgcgctgacacgggtcgtttatactgtgcgagagacggctattatgtattttggagttggttatttcgactaccctagatcgacggggctcggaccctgggccagggatacgtggtcaccgtctcctagcctccaccgacggcccagtccgtccttcccccgtcggtcccacccctcctcccaagcgtacccg

SEQ ID NO: 137418 - DNA, 656 bp, Homo sapiens
  misc_feature: GYAE6OF01AD860.46.67.G01.1.454.CMB.1.raw
  modified_base (206)..(206): a, c, t, g, unknown or other
  misc_feature (206)..(206): n is a, c, g, or t
  modified_base (329)..(329): a, c, t, g, unknown or other
  misc_feature (329)..(329): n is a, c, g, or t
  modified_base (335)..(335): a, c, t, g, unknown or other
  misc_feature (335)..(335): n is a, c, g, or t
  modified_base (387)..(387): a, c, t, g, unknown or other
  misc_feature (387)..(387): n is a, c, g, or t
tcagactagcagtacacgaccggtgctcgatttagagtatacatattggtttgtctctgctggtggcagctcccagatgggtcctgtccctggtgcaactgcaggagtcgggcccacgactggtgaggccttcggagaccctgtccctcacctgcgctgtcactggtgcctccatcagtagtggtttctcgtgggctgggtccggnagctcccgagggagggctggaatacattggaagtgtctctcagtagtggaggttcctagttacagtccgtctctcaagagtcgagtcaccatatctctggacacgtcagcaatcagtttcccngaacgntgagttctgtcgaccgcgctgacacgggctttatactgtgcgtagagacggntattatagtattttggagttggttatttcgtacaccctagatccggtaacgggggtcttcggtaaccccgtcggggtacccgaagggggtaacttaccggttacgggtccctaacccgggttcccgttacccgttaccgttaccccgtaccctaaccccggtaacggggtacccccaacggttcccggttcccccgtttaccccccggtaccgggtacccccgttacccccttaccccgttaccccggtaaacggtccgtaacccccgg

SEQ ID NO: 137419 - DNA, 564 bp, Homo sapiens
  misc_feature: GYAE6OF01BH65Q.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccaggacggccctaagctcctaatctatgctgcatccagtttgcgtaaagtcggggtcccagtccggaggttcagtggcagtggatcgtgggacaggatttcactctcaccatcagtaatctgacaagtgtaagtattttgactaacttattactgtacaaactagtaaatttactaaattcgttttacggaaccgtaacgggtaacaaccgtaacttaactaaacttaaacgaaccttaggtacggactacgacctaacctattcctagttcttactacttccttacccgacctctctgtaac

SEQ ID NO: 137420 - DNA, 552 bp, Homo sapiens
  misc_feature: GYAE6OF01AXR9Q.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggaaggggctggaatacattggaagtgtctctcatagtggaggttcctattacagtccgtctctcaagagtcgagtcaccatatctctggacacgtccagcaatcagttttccctgaagatgagttctgtgaccgccgctgacacgggctttattactgtgcgagagacggctattatgtatttttggagttggtttatttcgactaccctagatcgacggggctcgacccgtggggccagggatacgtggtcaccgtctccttacgccctccaccgaacgggcccagtccggtccttcccccgtcggtcccacccctcctcccaagcgcccg

SEQ ID NO: 137421 - DNA, 539 bp, Homo sapiens
  misc_feature: GYAE6OF01CAMZW.46.67.G01.1.454.CMB.1.raw
  modified_base (217)..(217): a, c, t, g, unknown or other
  misc_feature (217)..(217): n is a, c, g, or t
  modified_base (416)..(416): a, c, t, g, unknown or other
  misc_feature (416)..(416): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggnaagtcggaacattgacactatttaaatgtatcaacatagacagggacggccctaagctcctaatctatgctgcatccagtttgcaagtgggtccatcgagtcagtggcagtgatcgtgggacagtatttcactctacacatcagtaatctgacaacgtgaagtatttgactaacttattactgtacaactagtaattanaagttgtttcggacctaagggacctaacggtaactaactaaagttaacgaacttggtagactagacctaacctattctgttaccttactacgttcccttacccgacctacttccgtagtaacg

SEQ ID NO: 137422 - DNA, 534 bp, Homo sapiens
  misc_feature: GYAE6OF01A2HM0.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatgtatcaacatagaccagggacggccctaagctcctaatctatgctgcatccagtttgcaaagtgggtccatcgaggttcagtggcagtggatcgtgggacagatttcactctcaccatcagtaatctagctaacgtgtaagtatttgactaacttattactgtacaactagtaattacaattcgttttacggactaagggactacgtaactaactaaattaaacgaacgtagtacggactaggaccaacctatacttgttacttcacttccttcccacctactctgtac

SEQ ID NO: 137423 - DNA, 550 bp, Homo sapiens
  misc_feature: GYAE6OF01DTL9Z.46.67.G01.1.454.CMB.1.raw
  modified_base (329)..(329): a, c, t, g, unknown or other
  misc_feature (329)..(329): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggcctttcggagaccctgtccctcacctgcgctgtctctggtgcctccatcagtagtggtttctctggggctgggtccggcagctcccgagggaaggggctggaatacattggaagtgtctctcatagtggaggttcctattacagtccgtctctcaagngtcgagtcaccatatctctggacacgtccagcaatctagttttcccagaagtatgtagttctgtgacccgcgctgacacgggtcgtttattactgtgcgagagacggctattatgtatttttggagttggtttatttcgactaccctagtacgtcggacggggctcggaccccgtggggaccgagggaactacgtcggtcaccgtctccttgccctacccg

SEQ ID NO: 137424 - DNA, 542 bp, Homo sapiens
  misc_feature: GYAE6OF01DWMW7.46.67.G01.1.454.CMB.1.raw
  modified_base (408)..(408): a, c, t, g, unknown or other
  misc_feature (408)..(408): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcgaacattgacacctatttaatgtatcaacatagaccaggacgccctaagctctaatctatgctgcatccagtttgcaagtgggtcccatcgaggttcagtgcagtgatctgggacagatttcactctcacatcagtaatctgcaacgtgaatattttagactaactttattacttagtacctaaanaagtaatttaacaatttacgttttacggacccgaaagggtaaccaacgtaacttaaactaaaatttaaaccgaaacttgtacgctgaccgtacctattcgttgtaccttcacttccttacccgctatctgtaac

SEQ ID NO: 137425 - DNA, 532 bp, Homo sapiens
  misc_feature: GYAE6OF01D683U.46.67.G01.1.454.CMB.1.raw
  modified_base (510)..(510): a, c, t, g, unknown or other
  misc_feature (510)..(510): n is a, c, g, or t
tcagactagcagtacacgaccggtgctcgatttagagtatacatattgggtttggggagtcgtcggtacaggaccacagcatggacatgagggtccccgctcagctcctggggctcctgctactctggcttccgaggtgccagatgtgacatccgagctgacccagtctccatcctccctgtctgcaaccgtgggagacaggtgtcaccatcacttgccgggcaaggtcggaacattgactaccttatttaaattggtatcaacatagaccgagggacgccctaagcctcctaatctatgctgcagtccagtttgcaagtcgggtacccatcgaggttcaggtggctagtggatcgtgggacaggtatttcgactctccaccatcagtaactctagaccaacgtgaagtatttacgactaactttattactgtacaactagaattactaattgtttacgacgaaggacacgactaacgaaattaacgatgtgctagcgacatctgtcttnacttccgtaccgcatcgtgtac

SEQ ID NO: 137426 - DNA, 616 bp, Homo sapiens
  misc_feature: GYAE6OF01DNE7K.46.67.G01.1.454.CMB.1.raw
  modified_base (584)..(584): a, c, t, g, unknown or other
  misc_feature (584)..(584): n is a, c, g, or t
tcagactagcagtacacgaccggtgctcgatttagagtatacatagttgggtttgggggagtctcggtcaggacgacagtcactgggacataggacgggttccccgctctaggctcctggggctcctgctactctggctccggaggtgccagatgtggacatcgagcttgaccctagtctcctatcctcctgtctgcaaccggtgggagactaggtgtcaccagtactacttcgccgggcaagggtccggaacattcgacacctatttaaatggtatcaacatagaccagggacgtaccctaagctactaatctatgtctgcatcctagttggcgaagtgggtccagtcgagtcagtagcagtggatcgtagggacagtattcgactctctacgagtacagtaactcgtcgactaacggtagaagtactttacgaactaactttatacttgtactaactaacgtaaatttaccaaatttcggttttaaccgggaccgtaaaacggggacctaacggtaacgtaaactaaaacgttaacgaaacttaggtagtacttagacctaacctattcctagttaccttanaacgttccgttacccgacctagttcgtgtaac

SEQ ID NO: 137427 - DNA, 502 bp, Homo sapiens
  misc_feature: GYAE6OF01BI44U.46.67.G01.1.454.CMB.1.raw
  modified_base (497)..(497): a, c, t, g, unknown or other
  misc_feature (497)..(497): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacgccctaagctcctaatctatgctgcatccagtttgcaaagtggggtcccatcgaggttcagtggcagtggatctgggacagatttcactctcaccatcagtaatctgcaacgtgaagtattttgactaactttattactgtacaacagaattacaattgtttcgaccaagggacacgactaacaattaaacgaactgtgactgcacatctgttctcatccttccgcatntgtac

SEQ ID NO: 137428 - DNA, 672 bp, Homo sapiens
  misc_feature: GYAE6OF01DIY2Y.46.67.G01.1.454.CMB.1.raw
  modified_base (192)..(192): a, c, t, g, unknown or other
  misc_feature (192)..(192): n is a, c, g, or t
  modified_base (218)..(218): a, c, t, g, unknown or other
  misc_feature (218)..(218): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaaccggtggganacagtgtcaccatcacttgccggganaagtcggaacattcgactacttatttaaatgtatacaacatacgacgagggaccggaccctaagcctacctaatctatgctgcatcctagtttgactaagtcgggtccagtcgagtcaggtgcagtgatcgtagggacaggtactttcgactctacactatacaagtaactctagactaacgtagaagttatttacgacttaacgtttacttacgtacgtactaaactaagtaaacttaacgtaagtttacggttttaccggaaccgtaaacggggtaaccttaaaccgtaaaccttaaaacgttaaaaacgtttaaaaccggtaaaccgtttacgggttaacggtaccttaacggaaccttaaacccgttagttacccgtttacggttaccctttaccttaaccgtttacccctttaccccgacccttaactttcccgttaacggttaaaccg

SEQ ID NO: 137429 - DNA, 551 bp, Homo sapiens
  misc_feature: GYAE6OF01AKYFU.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggccctaagctcctaatctatgctgcatccagtttgcaaagtggggtcccagtcgaggttcagtggcagtggatcgtgggacagatttcactctcacatcagtaatctgacaacgtgaagtattttgactaacttattactgtacaactaagtaactttacaatttggttttaccggaccgaaggggacctaacggtaacctaactaaaattaaacgaacgttgtaggtactagacctacctatccttgttccttctacttccttcccgaccacttctgtaac

SEQ ID NO: 137430 - DNA, 544 bp, Homo sapiens
  misc_feature: GYAE6OF01A86KN.46.67.G01.1.454.CMB.1.raw
  modified_base (332)..(332): a, c, t, g, unknown or other
  misc_feature (332)..(332): n is a, c, g, or t
  modified_base (532)..(532): a, c, t, g, unknown or other
  misc_feature (532)..(532): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccgcagctccagggaaggggctggaatacattggaagtgtctctcatagtggaggttcctattacagtccgtctctcaagagtcgagtcaccatatctctggacacgtccagcaatcagttttcccngaacgatgagttctgtgaccgccgctgacacgggctttatactgtgcgagagacggctattatgtattttggagttggttatttcgacacctagatcggacggggctcggacccgtgggccagggatacgtggtcaccgtctccttacgcctccgaccgacgggcccacgtccggtccttccccctcggtccaccctccnccaagcgacccg

SEQ ID NO: 137431 - DNA, 494 bp, Homo sapiens
  misc_feature: GYAE6OF01A2YWH.46.67.G01.1.454.CMB.1.raw
  modified_base (467)..(467): a, c, t, g, unknown or other
  misc_feature (467)..(467): n is a, c, g, or t
  modified_base (473)..(473): a, c, t, g, unknown or other
  misc_feature (473)..(473): n is a, c, g, or t
  modified_base (478)..(478): a, c, t, g, unknown or other
  misc_feature (478)..(478): n is a, c, g, or t
  modified_base (485)..(485): a, c, t, g, unknown or other
  misc_feature (485)..(485): n is a, c, g, or t
  modified_base (487)..(487): a, c, t, g, unknown or other
  misc_feature (487)..(487): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggccctaagctcctaatctatgctgcatccagtttgcaaagtgggtcccatcgaggttcagtggcagtggatctgggacagatttcactctcaccatcagtaatctgcaacgtgaagtattttgactaacttattactgtacaacagaattacaattgtttcggacaagggacacgactacaattaacgatgagctgcnctatcngtctnatctccncntctgtac

SEQ ID NO: 137432 - DNA, 551 bp, Homo sapiens
  misc_feature: GYAE6OF01ASE9T.46.67.G01.1.454.CMB.1.raw
  modified_base (248)..(248): a, c, t, g, unknown or other
  misc_feature (248)..(248): n is a, c, g, or t
  modified_base (431)..(431): a, c, t, g, unknown or other
  misc_feature (431)..(431): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtgtttctctggggctgggtccggnagctccagggaaggggctggaatacattggaagtgtctctcatagtggaggttcctattacagtccgtctctcaagagtcgagtcaccatatctctggacacgtccagcaatcagttttccctgagatgagttctgtgaccgccgctgacacgggtcgttttattacgtgtgcgagagacggntattatgtatttttggagttggttatttcgactaccctagacgtcggacggggtctcggacccccgtggggacccaggggaactacgtcgggtcacccgttctcccgttagccctacccg

SEQ ID NO: 137433 - DNA, 541 bp, Homo sapiens
  misc_feature: GYAE6OF01D6C1I.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctctggggctgggtccggcagctcccgagggaaggggctggaatacattggaagtgtctctcatagtggaggttcctattacagtccgtctctcaagagtcgagtcaccatatctctggacacgtcagcaatcagttttccctgaagatgagttctgtgaccgccgctgacacgggtcgtttattactgtgcgagagacggctattatgtatttttggagttggtttatttcgactaccctagatcggacgggggctcggaccccgtggggccagggaactacgtggtccaccgtctccttgccctacccg

SEQ ID NO: 137434 - DNA, 566 bp, Homo sapiens
  misc_feature: GYAE6OF01D2WSU.46.67.G01.1.454.CMB.1.raw
  modified_base (338)..(338): a, c, t, g, unknown or other
  misc_feature (338)..(338): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccgagggaaggggctgggaatacagttggaagtgtctctcatagtggaggttcctattacagtccgtctctcaagagtcgagtcaccatatctctggacacgtccagcaatctagttttcccngaagatgagttctgtgaccgccgctcgacacgggtcgtttattactgtgcgagagacggtctattatgtattttggagttggtttatttcgacaccctagactcggacggggctcgacccgtggggccagggaatacgtcggtacaccgtctcctagccctccaccgtacggcccacgttccggtcccttcccccgtcggccctaccctccctaccaacgcgtacccg

SEQ ID NO: 137435 - DNA, 533 bp, Homo sapiens
  misc_feature: GYAE6OF01CSREG.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacgccctaagctcctaatctatgctgcatccagtttgacaagtgggtcccagtcgaggttcagtggcagtggatcgtgggactagatttcactctcaccatcagtaatctgacaacgtgaagtattttagactaacttattaactgtacaacaagtaaattactaatttgttttaccggaccgtaaggtacctacgaacttaacaaattaacgaactgtagctagcacctattctcgtcttacacttccttcccgactactctgtaac

SEQ ID NO: 137436 - DNA, 500 bp, Homo sapiens
  misc_feature: GYAE6OF01EC44O.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacggccctaagctcctaatctatgctgcatcagtttgcaaagtggggtcccatcgaggttcagtggcagtggatctgggacagatttcactctcaccatcagtaatctgcagtgaagatttgacaacttattactgtcaactagaattacatgttttcggaccaagggacacgactaacaaattaacgaactagtggctgcaccatctgtctcactcttacccgcctatctgtac

SEQ ID NO: 137437 - DNA, 591 bp, Homo sapiens
  misc_feature: GYAE6OF01C55WP.46.67.G01.1.454.CMB.1.raw
  modified_base (211)..(211): a, c, t, g, unknown or other
  misc_feature (211)..(211): n is a, c, g, or t
  modified_base (247)..(247): a, c, t, g, unknown or other
  misc_feature (247)..(247): n is a, c, g, or t
  modified_base (324)..(324): a, c, t, g, unknown or other
  misc_feature (324)..(324): n is a, c, g, or t
  modified_base (437)..(437): a, c, t, g, unknown or other
  misc_feature (437)..(437): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtncctcatcagtagtgtttctcgtggggctgggtccgnagctccgagggagggctggaatacagttggaagtgtctctcatagtggagttcctattacagtccgtctctacaagngtcgagtcacatatctctcggacacgtcagcaatcgtacgttttcccagtaagtatgtacgttctgtcgaccgcgctgacgtacggtctttatacgtgtgcgagagtacggtntattagtgttagtttggagttgtttacttcgaactaccgtagtacgtcggaccggggtactccggtacccggtggggaccggtaacgggtaacgttaccggttacggttacccgtaacccgttccgttacccgttaacggtcccgtaaccccgg

SEQ ID NO: 137438 - DNA, 626 bp, Homo sapiens
  misc_feature: GYAE6OF01BTIH3.46.67.G01.1.454.CMB.1.raw
  modified_base (294)..(294): a, c, t, g, unknown or other
  misc_feature (294)..(294): n is a, c, g, or t
tcagactagcagtacacgaccggtgctcgatttagagtatacatattgggtttgtcctcctgctggtggcagctcccagatgggtcctgtccctggtgcaactgcagggagtcgggcccacgactggtgaggccttcggagaccctgtccctcacctgcgctgtctctggtgcctccatcagtagtggtttcttcgtggggctgggtccggcagctcccgaggggaagggctggaatacagttggaagtgtctcgtcatagtggtaggttcctaattacagtccgtctctcagngtcgagtcacatatctctggaccacgtccagcaatcgtagttttcccagaagagtgagttctgtcgaccgcgctgacgtacgggtctttatacgtggtgcgtagagacggtcttattagttgtagttttggagttggtttattcgactaccgtagtacgtcgggtacgggtcctccggaccccggtaggggacccgtaagggtaacgtaccgttcggtaccgtacccgtccgttaccgttacgtcccctaccgaacccgaaccggtccctaacggttcccggttacccttcccccgtcggtccccaccccttccctaccgaacgcgtacccg

SEQ ID NO: 137439 - DNA, 663 bp, Homo sapiens
  misc_feature: GYAE6OF01BHFLR.46.67.G01.1.454.CMB.1.raw
  modified_base (196)..(196): a, c, t, g, unknown or other
  misc_feature (196)..(196): n is a, c, g, or t
tcagactagcagtacacgaccggtgctcgatttagagtatacatattgggtttggggagtctcggtcaggacacagcatggacatgagggtccccgctcagctccgtggggctcctgctactctggctccgaggtgccagatgtgacatcgagctgacccagtctccatccctccctgtctgacaaccggtggganacagtgtcaccatctacgttcggccgggacaacggtcggaaactagttacgaacctaacctttaattttaaagttcggtactacgaactagtaacgaccgacgggaccgtaccctaagcctactaatctagtcgctagactactcgtagtttagacgtaaggtcgggtaccagtcgtagtcaggtgacgtaggtcgtagtacggtagactagtacttaccactctacaactatacgtagtactcgtacgtacgtaacgtagtaagttatttacgaacttaactttatactacgtaactaagtacgttaacttacgttaagttcggtttacgaaccgtaaggtacctaaacgttaactaaacttaaagtaaccggtaacgttggtacgtacctacggtacctaacgttacttccgtacgttcttacccgttaccttccgttaccccagttaccttcgttcgtaaaccg

SEQ ID NO: 137440 - DNA, 506 bp, Homo sapiens
  misc_feature: GYAE6OF01BCTD6.46.67.G01.1.454.CMB.1.raw
  modified_base (503)..(503): a, c, t, g, unknown or other
  misc_feature (503)..(503): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggccctaagctcctaatctatgctgcatccagtttgcaaagtgggtcccatcgaggttcagtggcagtggatctgggacagatttcactctcaccatcagtaatctgcaacgtgaagtattttgtaactttattactgtacaacagtaatactaattgtttcggccaagggacacgtactaactaaattaacgaacttgtagctgcacatactgtcttcatcttcccgcatctgntac

SEQ ID NO: 137441 - DNA, 624 bp, Homo sapiens
  misc_feature: GYAE6OF01CSZUJ.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacactatttaaatgtatcaacatagacagggacgccctaagctacctaatctatgctgcatccagtttgactaaaggtggggtacccagtcggaggttcaggtcggctagtggatcgtgggacagtatttcactctcaactatcagtaactctagactaacgtagaagttattttgactaactttaattactagtactaaactaagtaaatttaactaagttacggttttacggaaccgtaaacgggaactaaccggtaaaccttaaactaaaacgttaaaccgtaaacgttacggttacggtaccgttacgaacctaacccgtaattacgttcgtttaccgtttaccttaacgttcccctttaccccgtaccttacttccgttgttaaaccg

SEQ ID NO: 137442 - DNA, 527 bp, Homo sapiens
  misc_feature: GYAE6OF01COZBQ.46.67.G01.1.454.CMB.1.raw
  modified_base (190)..(190): a, c, t, g, unknown or other
  misc_feature (190)..(190): n is a, c, g, or t
  modified_base (225)..(225): a, c, t, g, unknown or other
  misc_feature (225)..(225): n is a, c, g, or t
  modified_base (250)..(250): a, c, t, g, unknown or other
  misc_feature (250)..(250): n is a, c, g, or t
  modified_base (254)..(254): a, c, t, g, unknown or other
  misc_feature (254)..(254): n is a, c, g, or t
tcagactagcagtacacgaccggtgctcgatttagagtatacatagttgggtttggggagtctcggtcaggacacagcatggacatgagggtccccgctcagctcctggggctcctgctactctggctcgaggtgccagatgtgacatcgagctgacccagtctccatcctcctgtctgcaacgtggganacagtgtcaccatcacttgccggcaagtcggaacnttgacacctatttaaatgtatcaanatanacagggacgccctagctcctaatctatgctgcatccagtttgcaagtcgggtccagtcgagttcagtggcagtggatcgtgggacaggatttcactctcgacatacagtaatctagacaacgtagaactatttgactaacttattactgtacaactaagtaatactaaattcgtttacggaccaaggtaacacgaacttaacaaacgttaacgaattgtagacgtggactaaccgtattactgttcttcacttccttccgactatcgtgtaac

SEQ ID NO: 137443 - DNA, 561 bp, Homo sapiens
  misc_feature: GYAE6OF01BALVX.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccgaggggaaggggctggaatacattggaagtgtctctcatagtggaggttcctattacagtccgtctctcaagagtcgagtcaccatatctctggacacgtccagcaatcagttttccctgaagatgagttctgtgaccgccgctgacacgggcgtttattactgtgcgagagacggctattatgtagtttttggagttggttatttcgactaccctagacgtcggacggggctcggaccccgtggggccaggggaactacgtggtcaccgtctccttagccctccaccgacgggcccacgtccggtcccttcccccgtcgccacccctccctccaagcgacccg

SEQ ID NO: 137444 - DNA, 544 bp, Homo sapiens
  misc_feature: GYAE6OF01DBPB4.46.67.G01.1.454.CMB.1.raw
  modified_base (217)..(217): a, c, t, g, unknown or other
  misc_feature (217)..(217): n is a, c, g, or t
  modified_base (382)..(382): a, c, t, g, unknown or other
  misc_feature (382)..(382): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggnaagtcggaacattgacacctatttaaatggtatcaacatagaccagggacggccctaagctcctaatctatgctgcatccagtttgcaaagtgggtcccatcgaggttcagtggcagtggatctgggacagatttcactctcaccatcagtaatctgacaacgtnaagtattttgactaacttagttactagtacaactaagtaattacaattgttttacggacctaagggacaacgaacttaacaaattaaacgaacttagtagtacctagacctaacctaattaccttgttaccttcgacttccttacccgacctactctgtaac

SEQ ID NO: 137445 - DNA, 533 bp, Homo sapiens
  misc_feature: GYAE6OF01BMHFT.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggccctaagctcctaatctatgctgcatccagttttgcaaagtgggtcccatcgaggttcagtgcagtgatctgggacagatttcactctcacatcagtaatctgcaacgtgaagtattttgctaactttattactgtacaacaagtaattaactaattggttttacgaccgaagggtaactaacgtaactaactaaattaaacgaacttagtagctagactaccattctgtacttcacttccttacccgaccattcctgtaacg

SEQ ID NO: 137446 - DNA, 513 bp, Homo sapiens
  misc_feature: GYAE6OF01D0HVB.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaatgtatcaacatagaccagggacggccctaagctcctaatctatgctgcatccagtttgcaaagtgggtcccatcgaggttcagtggcagtggatctgggacagatttcactctcaccatacagtaatctgacaacgtgaagtatttgactaacttattactgtacaactagtaattacaattgtttacgactaagggacacgtactaactaaattaacgaactgtagctagacgaactatctgtcttcacttcttacccgcatctgtaac

SEQ ID NO: 137447 - DNA, 597 bp, Homo sapiens
  misc_feature: GYAE6OF01B05LP.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatccctccctgtctgcaaccggtgggagacagtgtcaccatcacttgccgggcaagtcggaacattgacactatttaaatgtatcaacatagacaggacggccctaagctcctaatctatgctgcatccagtttgacaaagtcggggtacccatcgaggtttcagtggcagtgatctgggacagtatttcactctcaccatcagtaactctgacaacgtgtaagtattttgactaactttagttactgtacaactagtaaattactaagtttcgttttaccggaccgtaaagggtaacctaacggtaaaccttaaactaaaagtttaaaccgaaaccgttaggtcggtacctacggacctacccgtaattccgttacgttacctttacctaaacgttccctttacccccggacctacgttcctagttaacc

SEQ ID NO: 137448 - DNA, 659 bp, Homo sapiens
  misc_feature: GYAE6OF01DSMJE.46.67.G01.1.454.CMB.1.raw
  modified_base (195)..(195): a, c, t, g, unknown or other
  misc_feature (195)..(195): n is a, c, g, or t
  modified_base (220)..(220): a, c, t, g, unknown or other
  misc_feature (220)..(220): n is a, c, g, or t
tcagactagcagtacacgaccggtgctcgatttagagtatacatattgggtttggggagtctcggtcaggacacagcatggacatgagggtccccgctcagctcctggggctcctgctactctggctccggaggtgccagatgtgacatcgagctgacccagtctccatccctccctgtctgcaaccggtggganacagtgtcaccatcacttgccgggnaagtcggaacattgacacttatttaaatgtatcaacatagaccagggaccggccctaagctcctaatctatgctgcatcctagtttgacaaaggtcggggtcccagtcggaggttcaggtggacaggtggatcgtggggacaggtatttcgactctacactatcaagttatctagctaacgtgaaagttattttgacttaaatttattacgtagtacaaacgtaagtaactttaacgtaagtttcggttttaccggaaccgtaaaggggtaacctaaaccggttaaccttaaacgtaaaaacgtttaaaccggaaacgtttagggtacgggtaccgttaacgaacccgttaaccttaagttacccgtttaccggtttacctttaccttaaccgtttaccccgtttacccccgtaccttaactttccgtacggttaaacc

SEQ ID NO: 137449 - DNA, 594 bp, Homo sapiens
  misc_feature: GYAE6OF01AK4QV.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggccctaagctcctaatctatgctgcatccagtttgcaaagtgggtcccatcgaggttcagtggcagtggatcgtgggacagtatttcactctcaccatcagtaatctagctaacgtgaagtattttgactaacttattactgtacaactaagtaactttactaatttcggttttaccggaaccgtaaagggacctaaccggtaaccttaaactaaaacgtttaaaccgaacgttaggtacggtacctacggacctaacccgtaattccttcggttacctttacctactttccccgttaccccgtaccctacttccgtggttaacc

SEQ ID NO: 137450 - DNA, 551 bp, Homo sapiens
  misc_feature: GYAE6OF01E4BF4.46.67.G01.1.454.CMB.1.raw
  modified_base (211)..(211): a, c, t, g, unknown or other
  misc_feature (211)..(211): n is a, c, g, or t
  modified_base (333)..(333): a, c, t, g, unknown or other
  misc_feature (333)..(333): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtncctccatcagtagtggtttcttcgtggggctggggtccggcagcctcccgagggaaggggctggaatacagttggaagtgtctctcatagtggaggttcctattacagtccgtctctcaagngtcgagtcaccatatctctggacacgtccagcaatcagttttccctgaagatgtagttctgtcgacccgcgctgaccgtacgggtcgtttaatactgtgcgagagacgctattagtgtattttggagttggtttatttcgactaccgtagcgtcggacggggtctccggaccccgtgggccgagggactacgtggtcaccgtctccttgccctacccg

SEQ ID NO: 137451 - DNA, 506 bp, Homo sapiens
  misc_feature: GYAE6OF01AKVQE.46.67.G01.1.454.CMB.1.raw
  modified_base (496)..(496): a, c, t, g, unknown or other
  misc_feature (496)..(496): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggccctaagctcctaatctatgctgcatccagtttgcaaagtgggtcccatcgaggttcagtggcagtggatctgggacagatttcactctcaccatcagtaatctgcaacgtgaagtattttgactaacttattactgtcaacagtaattacaattgttttacggacctaagggacacgtaactaacaaacttaacgaactgtgctgcacatctgtctcactctccncactctgtac

SEQ ID NO: 137452 - DNA, 566 bp, Homo sapiens
  misc_feature: GYAE6OF01BBGM3.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacggccctaagctcctaatctatgctgcatccagtttgcaaagtggggtcccatcgaggttcagtggcagtggatcgtgggacagatttcactctcaccatcagtaatctgcaacgtgaagtattttagactaaactttattactgtacaacaagtaatttaacaattcgttttaccggacctaaaggggaccaacggtaaccttaaactaaaacgttaaacgaactaggttacggactagacctaaccctattccttcgttcttaccacttccttacccgaccctaactccttagtaacg

SEQ ID NO: 137453 - DNA, 566 bp, Homo sapiens
  misc_feature: GYAE6OF01AI7FF.46.67.G01.1.454.CMB.1.raw
  modified_base (198)..(198): a, c, t, g, unknown or other
  misc_feature (198)..(198): n is a, c, g, or t
  modified_base (234)..(234): a, c, t, g, unknown or other
  misc_feature (234)..(234): n is a, c, g, or t
tcagactagcagtacacgaccggtgctcgatttagagtatacatagttgggtttgggagtctcggtcaggacacagcatggacattgagggtccccgctcagcttcctggggctcctgtactactctggctcgaggtgccagatgtgacagtcgagctgacccagtcgtccatcctccctgtcctgcaaccgtggganacagtgtcacctatcacttgccggcaagtcggaacnttgaccacctattaaatggtatcgaacatagaccgagggacgccctaagctcctaagtctatgctgcatccagtttgcgaaggtcgggtcccatcgagttcagtggcagtggatcgtggacagtatttcactctacacatcaagtactctgacaacgtgaagtattttacggacttaaactttattacttgtacaacaagtaattacaagttacgtttaccggacctaagggtactacgtaacttaactaaattaacgtaacgtggtacgactaggacctacctattcttcgttaccttactacttcccttacccgacctacttctgtaccc

SEQ ID NO: 137454 - DNA, 581 bp, Homo sapiens
  misc_feature: GYAE6OF01B93NC.46.67.G01.1.454.CMB.1.raw
  modified_base (192)..(192): a, c, t, g, unknown or other
  misc_feature (192)..(192): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccgggcaagtcggaacattgacacctatttaaatggtatcaacatagacagggacggccctaagctcctaatctatgctgcatcctagtttgcaaaggtgggtcccatcgaggttcagtggcagtggatctgggacagtatttcactctcacctatcaagtaatctagactaacgtagaaagtattttacgactaactttattaactgtacaactaagtaaatttaactaagttgttttaccggaaccgtaagggaacctaaccgtaacttaaactaaaacgttaaaccgtaaacgttagtacggtactacgacctaacctatacttgttaccttactacttcccttaccccgacctactcgttagtaac

SEQ ID NO: 137455 - DNA, 597 bp, Homo sapiens
  misc_feature: GYAE6OF01CAGMC.46.67.G01.1.454.CMB.1.raw
  modified_base (220)..(220): a, c, t, g, unknown or other
  misc_feature (220)..(220): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatccctccctgtctgcaaccggtgggagacagtgtcaccatcacttggccgggnaagtcggaactattgacaccttatttaaatggtatacaacatagaccagggaccggccctaagctcctaatctatgctgcatccagtttgactaaagtcgggtacccatcggagttcaggtgctaggtgtagtcgtgggacagtatttacatttcactacctatactagtaactcgtagaccgtaagtagtaaagttcttttagaacttaacttattacgtagtaactaacagtaaactttacaagtttcgtttacgaacgtaaggaactaacgtaaactaaactaaacgtaaacacgttagtacggctacggtacctaacctagttccttgttccttactaaccgtttcctacccgtaaccgtattccgtgttaac

SEQ ID NO: 137456 - DNA, 549 bp, Homo sapiens
  misc_feature: GYAE6OF01AU7U2.46.67.G01.1.454.CMB.1.raw
  modified_base (219)..(219): a, c, t, g, unknown or other
  misc_feature (219)..(219): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgaccaggtctcgatccgtccctgtactgcaaccgtgggagacagtgtcaccatcacttgccgggnaagtcgaacattgacacctatttaaatggtatcaacatagacaggacgccctaagctcctaatctatgctgcatccagtttgctaagtcgggtcccagtcgaggttcagtggcagtgatcgtgggacagtattcactctacaccatcagttaatctagacaacgtgtaagtatttagacttaacttatactagtactaatagtaattactagttcgtttacggactaagggactaacgtaacttaactaaagttaaaccgaacgttggtacgaccgtagacctacgtatcttgtccttactacttccgtacccacgtacttcgtagtacc

SEQ ID NO: 137457 - DNA, 514 bp, Homo sapiens
  misc_feature: GYAE6OF01CESPQ.46.67.G01.1.454.CMB.1.raw
  modified_base (503)..(503): a, c, t, g, unknown or other
  misc_feature (503)..(503): n is a, c, g, or t
  modified_base (511)..(511): a, c, t, g, unknown or other
  misc_feature (511)..(511): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccaggacgccctaagctcctaatctatgctgcatccagtttgacaaagtgggtcccatcgaggttcagtggcagtggatcgtgggacagtatttcactctcaccatcagtaatctgacaacgtagaagtattttagactaactttattactgtacaatagtaattataattgtttacgacaaggactacgtactaactaaataacgaactgtagctagacactatctgtcttcactctacccnctactgtntac

SEQ ID NO: 137458 - DNA, 526 bp, Homo sapiens
  misc_feature: GYAE6OF01D7X2X.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacgccctaagctctaatctatgctgcatccagtttgcaaagtgggtcccatcgaggttcagtggcagtggatctgggacagatttcactctcaccatcagtaatctgacaagtgaaagtattttgactaactttattactgtactaactagtaattactaattgtttacggactaagggactacgaactaacaaattaacgaactgtagctagacacctaatctcgttccttcacttccttacccgcctattcctgtaac

SEQ ID NO: 137459 - DNA, 499 bp, Homo sapiens
  misc_feature: GYAE6OF01BFEXW.46.67.G01.1.454.CMB.1.raw
  modified_base (478)..(478): a, c, t, g, unknown or other
  misc_feature (478)..(478): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctattaaattggtatcaacatagaccaggacggccctaagctcctaatctatgctgcatccagtttgcaaagtggggtcccatcgaggttcagtggcagtggatctgggacagatttcactctcaccatcagtaatctgcaacgtgaagattttgactaacttattactgtacaacagaattacaattgtttacgcctaagggactacgactaacaaattaacgaactgtgctgacacatctntctcatctaccgcatctgtac

SEQ ID NO: 137460 - DNA, 585 bp, Homo sapiens
  misc_feature: GYAE6OF01CVMEW.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggcagctcccgaggggaaggggctggaatacagttggaagtgtctctcatagtggaggttcctattacagtccgtctctcaagagtcgagtcaccatatctctggacacgtccagcaatctagttttcccagaagtatgtagttctgtcgacccgccgctgaccgtacgggtcttttatactgtgacgagagacggtctattatgttagttttggagttgttatttcgactacccgtagacgtcggacgggtcctccggacccgtcgggaccgagggtaactacgtcgtaccgtaccgtctccgttacgccctaccgaccgacggccctagtcccgtcccttccccgtcgccctaccctccctaccaacgcgtaccg

SEQ ID NO: 137461 - DNA, 558 bp, Homo sapiens
  misc_feature: GYAE6OF01ENRLY.46.67.G01.1.454.CMB.1.raw
  modified_base (379)..(379): a, c, t, g, unknown or other
  misc_feature (379)..(379): n is a, c, g, or t
  modified_base (384)..(384): a, c, t, g, unknown or other
  misc_feature (384)..(384): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtcccctcacctgcgctgtctctggtgcctccatcagtagtggttttcttcgtggggctgggtccgcagcctcccgagggaaggggctggaatacattggaagtgtctctcatagtggaggttcctattacagtccgtctctcaagagtcgagtcaccatatctctggacacgtccagcaatctagttttcccngaagntgagttctgtcgaccgcgctgacgacgggtcgtttattactggtgcgagagacggtctattatgtattttggagttggtttatttcgactaccctagacgttcggaccggggtctccggaccccgtggggccgtaggggaatacgtggtccaccgttctccttagccctacccg

SEQ ID NO: 137462 - DNA, 598 bp, Homo sapiens
  misc_feature: GYAE6OF01ACWKA.46.67.G01.1.454.CMB.1.raw
  modified_base (193)..(193): a, c, t, g, unknown or other
  misc_feature (193)..(193): n is a, c, g, or t
  modified_base (220)..(220): a, c, t, g, unknown or other
  misc_feature (220)..(220): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtggganacagtgtcaccatcacttggccggganaagtcggaacattcgactacttatttaaattggtatacaacatacgaccgagggaccgccctaagctacctaatctatgctgcatcctagtttgactaaggtcgggtaccagtcgaggttcagtgcaggtgatcgtgggactagtactttcactctacactatactaagtactcgtagactaacgtgtaagttatttacgacttaactttattactagtactaaatagtaacttaactaagtttcgtttacggacgtaaagggtacctaacgtaacttaaacgtaaacgttaaacgacgttggtacggtacctacgtacctaacctattaccgtcgtttaccttactacgttcccttacccgactacttcgtagtaac

SEQ ID NO: 137463 - DNA, 545 bp, Homo sapiens
  misc_feature: GYAE6OF01AVQ6Q.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgactccatcagtagtggtttctcgtggggctgggtccggcagctcccgagggaaggggctggaatacattggaagtgtctctcatagtggaggttcctattacagtccgtctctcaagagtcgagtcaccatatctctgacacgtccagcaatcagttttccctgaagatgagttctgtgaccgccgctgacacgggtcgtttattactgtgcgagagacggctattatgtattttggagttgttatttcgactaccctagactcggacggggtctcggaccccgtggggaccgagggaactacgtcggtctaccgtctcccgttgccctacccg

SEQ ID NO: 137464 - DNA, 533 bp, Homo sapiens
  misc_feature: GYAE6OF01BTVK8.46.67.G01.1.454.CMB.1.raw
  modified_base (211)..(211): a, c, t, g, unknown or other
  misc_feature (211)..(211): n is a, c, g, or t
  modified_base (374)..(374): a, c, t, g, unknown or other
  misc_feature (374)..(374): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtncctccatcagtagtggtttctctggggctgggtccgcagctccagggaagggctggaatacattggaagtgtctctcatagtggaggttcctattacagtccgtctctcaagagtcgagtcaccatatctctggacacgtccagcaatcagttttccctgaanatgagttctgtgaccgccgctgacgacgggtcgtttattactgtgcgagagacggctagttatgtattttggagttggttatttcgactacctagagtcggacggggtctcggacccgtggggcctagggactacgtgtcacgtctccttgcctacccg

SEQ ID NO: 137465 - DNA, 593 bp, Homo sapiens
  misc_feature: GYAE6OF01DB76E.46.67.G01.1.454.CMB.1.raw
  modified_base (256)..(256): a, c, t, g, unknown or other
  misc_feature (256)..(256): n is a, c, g, or t
  modified_base (292)..(292): a, c, t, g, unknown or other
  misc_feature (292)..(292): n is a, c, g, or t
  modified_base (337)..(337): a, c, t, g, unknown or other
  misc_feature (337)..(337): n is a, c, g, or t
  modified_base (341)..(341): a, c, t, g, unknown or other
  misc_feature (341)..(341): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactgggtgaggccttcgggagaccctgtccctcacctgcgctgtctctggtgcctccatcagtagtggtttcttcgtggggctgggtccggcagctcccgaggggaagggctggaatacattggaagtgtctctnatagtggaggttcctattacagtccgtctctcaagngtcgagtcaccatatctctggacacgtccagcaatctagtttccngaantgagttctgtcgaccgccgctgacgtacgggtcttttatacgtgtgcgagagacggtcttagttatgttagttttggagtttgttattcgactaccgtagcgtcggacggggctccggacccgtggggaccgagggtaactcgtcggtcctaccgttccttccgttacgccctaccgaaccggtaacggtccctacgttcccggttaccccttcccccgtcggcccctacccctccctaccaagcgtacccg

SEQ ID NO: 137466 - DNA, 508 bp, Homo sapiens
  misc_feature: GYAE6OF01EFXNI.46.67.G01.1.454.CMB.1.raw
  modified_base (489)..(489): a, c, t, g, unknown or other
  misc_feature (489)..(489): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccaggacgccctaagctcctaatctatgctgcatccagtttgcaaagtggggtcccagtcgaggttcagtggcagtggatctgggacagtatttcactctcaccatcagtaatctgcaacgtgaagtattttgactaactttattacttgtacaacagtaattacaattgttttcggaccaaggacacgtactaacaaattaacgaactgtgctagcacatctgtcttnacttctcccgcatctgtac

SEQ ID NO: 137467 - DNA, 573 bp, Homo sapiens
  misc_feature: GYAE6OF01DFJZ8.46.67.G01.1.454.CMB.1.raw
  modified_base (217)..(217): a, c, t, g, unknown or other
  misc_feature (217)..(217): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggnaagtcggaacattgacactatttaaattggtatcaacatagaccgagggaccggccctaagctacctaatctatgctgctatccagtttgacaaaggtgggtacccagtcgaggttcagtggcagtggatcgtgggacaggtactttcgactcctacaccgtatacaagtaatcgtacgacaacgttgaaagttatttacgactaacttattactgtactaataagtaattaacaatttcggtttacggacgaacgggtactaacgaacttaaactaaattaaacgaacgttagtacgtctacgacctaactatctcgttacttactacttcccttacccgacctacttctgtaac

SEQ ID NO: 137468 - DNA, 535 bp, Homo sapiens
  misc_feature: GYAE6OF01D79JQ.46.67.G01.1.454.CMB.1.raw
  modified_base (211)..(211): a, c, t, g, unknown or other
  misc_feature (211)..(211): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtncctccatcagtagtggtttctctggggctgggtccgcagctccgagggaagggctggaatacattggaagtgtctctcatagtggaggttcctattacagtccgtctctcaagagtcgagtcaccatatctctggacacgtccagcaatcagttttccctgaagatgagttctgtgaccgccgctgacacgggtcgtttattactgtgcgagagacggctattatgtatttttggagttggttatttcgactaccctagatcggacggggctccggcccgtggggccagggaactacgtggtcaccgtctccttgccctacccg

SEQ ID NO: 137469 - DNA, 647 bp, Homo sapiens
  misc_feature: GYAE6OF01EEH0T.46.67.G01.1.454.CMB.1.raw
tcagactagcagtacacgaccggtgctcgatttagagtatacatattgggtttggggagtcgtcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttcgccgggcaagtcggaacattgactacctatttaaatgtatcaacatagacaggaccgcctaagctactaatctatgctgactatccagtttcgacgtaaaggtcgggtacccagtcgtaggttcaggtggcagtgatcgtaggacagtattcactctcactatacagtaatcgtagacgaacgttagaagttacgtttacgacttaactttattaactcgtaactaaacgtaagttaaactttaacgtaacgtttacggtttaccggaaccgtaaacgggtaactaaccgtaacttaaacgtaaaacgttaaaccgtaacgttaggtacggtaccgtacgtacccgtaaaccgtacgttacgttcggttaccctttaaccgaccgtttacccccgttacccccgtaccctttaacttcccgttacgttaaacccg

SEQ ID NO: 137470 - DNA, 545 bp, Homo sapiens
  misc_feature: GYAE6OF01EF6QK.46.67.G01.1.454.CMB.1.raw
  modified_base (212)..(212): a, c, t, g, unknown or other
  misc_feature (212)..(212): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggcctttcggagaccctgtccctcacctgcgctgtctctggtncctccatcagtagtggtttctctggggctgggtccggcagctcccgagggaaggggctggaatacattggaagtgtctctcatagtggaggttcctattacagtccgtctctcaagagtcgagtcaccatatctctggacacgtccagcaatcagttttccctgaagattgagttctgtgaccgccgctgacgacgggtcgtttattactgtgcgagagacggcttagttatgtattttggagttggtttatttcgactaccctagatcggcggggctccggacccgtggggccagggaactacgtcggtcaccgtcctccttgccctacccg

SEQ ID NO: 137471 - DNA, 579 bp, Homo sapiens
  misc_feature: GYAE6OF01A4B71.46.67.G01.1.454.CMB.1.raw
  modified_base (333)..(333): a, c, t, g, unknown or other
  misc_feature (333)..(333): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccgcagctccagggaagggctggaatacattggaagtgtctctcatagtggaggttcctattacagtccgtctctcaagagtcgagtcaccatatctctggacacgtccagcaatctacgttttcccngaagatgagttctgtcgaccgccgctgacgacgggtcgtttatacgtgtgcgagagacggctattatgtagttttggagttggttatttcgaactacccgtagacgtcggacggggcctcggaccccgtggggccagggaactacgtcggtcaccgtctccttacgccctccgaccgaacgggtcccacgttcccggtacccttcccccgtcggtcccctacccctccctaccgaacgtcgacccg

SEQ ID NO: 137472 - DNA, 571 bp, Homo sapiens
  misc_feature: GYAE6OF01D4J37.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatccgagctgacccagtctccatcctccctgtctgcaaccgtgggagacagtgtcaccatcacttgcccgggcaagtcggaacattgacactatttaaattggtatcaacatagaccaggacggccctaagctcctaatctatgctgcatccagtttgcaaagtgggtcccatcgaggttcagtggcagtggatctgggacagatttcactctcaccatacagtaatctagacaacgttagtaagtatttagtactaacttattaactagtactaactaagtaattactaacgttacgtttacggtaccgtaacgggtaactaacgtaaacttaactaaacttaaacgtaacgtagtacggtacgtacgtacctacctacttcttacgttacttacctaccttaccttacccgtcctactctacg

SEQ ID NO: 137473 - DNA, 571 bp, Homo sapiens
  misc_feature: GYAE6OF01DADAW.46.67.G01.1.454.CMB.1.raw
  modified_base (218)..(218): a, c, t, g, unknown or other
  misc_feature (218)..(218): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatccctccctgtctgcaaccgtgggagacagtgtcaccatcacttgccgggnaagtcggaacattgacacctatttaaatggtatcaacatagaccagggaccggccctaagctcctaatctatgctgcatcctagtttgactaaaggtcgggtcccagtcgaggttcagtgctagtgatcgtgggacagtatttcactctcacctatcagtaatctagactaacgtgaagtatttgactaattattactgtacaactaagtaattactaagttcggtttaccgaccgaagggaacctaacgtaaccttaacgtaaacttaacgaacttaggtacgtactacgacctaaccgtattcgttcgttaccttacaccgttcccctacccgtacctacttcgtgtaacc

SEQ ID NO: 137474 - DNA, 562 bp, Homo sapiens
  misc_feature: GYAE6OF01DSFZV.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctccgagggaaggggctggaatacattggaagtgtctctcatagtggaggttcctattacagtccgtctctcaagagtcgagtcaccatatctctggacacgtccagcaatcagttttccagaagatgagttctgtgaccgccgctgactacgggtcgttttatactgtgcgagagacggctattatgtattttggagttgttattcgactacccgtagatcggacggggctccggacccgtggggccgagggtaactacgtggtcaccgtctcttacgccctaccaccgacgggcccacgtccggttcccttccccctcggcccacccctcctacccaacgcgtacccg

SEQ ID NO: 137475 - DNA, 621 bp, Homo sapiens
  misc_feature: GYAE6OF01B0I82.46.67.G01.1.454.CMB.1.raw
  modified_base (194)..(194): a, c, t, g, unknown or other
  misc_feature (194)..(194): n is a, c, g, or t
  modified_base (221)..(221): a, c, t, g, unknown or other
  misc_feature (221)..(221): n is a, c, g, or t
  modified_base (291)..(291): a, c, t, g, unknown or other
  misc_feature (291)..(291): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatccctccctgtctgcaaccggtggganacagtcgtcaccatcacttggccgggnaagtcgaacattgacacttatttaaatgtatcaacatagacgagggaccgccctaagctacctaatctangctgacatcctagtttgacgtaaaggtcgggtacccagtcggaggttcagtggcaggtgatcgtaggacagtatttcactcacacatacaagtactcgtagacaacgtagtaagttatttacgacttaacttattacgtagtactaacgtagtaaactttaactaagtttacggttttaaccggaaccgtaaacgggtaacctaacggtaaaccttaaacgttaaaacgttaaacgtaacgttaggtacgtacgtacgaccgtaaccgtacttacgttcgttaccttacgttaccttcccttacccgtacctacgttccgtagttaaccg

SEQ ID NO: 137476 - DNA, 568 bp, Homo sapiens
  misc_feature: GYAE6OF01CXP3S.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccaggacggccctaagctcctaatctatgctgcatccagtttgcaaagtgggtcccatcgaggttcagtgcagtgatcgtgggacagtattcactctcacatcagtaatctagacaacgtgaagtattttgactaacttattactagtacaaactaagtaatttacgaaatttcggttttaccggaaccgtaagggtaaccaacggtaaaccttaaacgtaaaacttaaacgaacttggtacggactacggaccacctaattctcgttacttactaacgttccctttacccgacctagttcctggtaac

SEQ ID NO: 137477 - DNA, 571 bp, Homo sapiens
  misc_feature: GYAE6OF01CIKBX.46.67.G01.1.454.CMB.1.raw
  modified_base (299)..(299): a, c, t, g, unknown or other
  misc_feature (299)..(299): n is a, c, g, or t
  modified_base (327)..(327): a, c, t, g, unknown or other
  misc_feature (327)..(327): n is a, c, g, or t
  modified_base (343)..(343): a, c, t, g, unknown or other
  misc_feature (343)..(343): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacactattaaatgtatcaacatagaccagggacgccctaagctcctaatctatgctgcatccagtttnacaagtgggtcccatcgaggtcagtgcngtggatcgtggacagnttcactctcacatcagtaatctgactaacgtgaagtattttagtaaacttattactagtacaacgtagtaatttacaattcgttttacggaccgtaaagggactaacgtaacttaactaaaactttaacgaacttaggtacgtctacgtacctaacctacttacgttggttacctttactaactttcccgttacccccggacccttagttacccttggtaattaaccg

SEQ ID NO: 137478 - DNA, 554 bp, Homo sapiens
  misc_feature: GYAE6OF01B820Q.46.67.G01.1.454.CMB.1.raw
  modified_base (248)..(248): a, c, t, g, unknown or other
  misc_feature (248)..(248): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggttctctggggctgggtccggnagctccagggaaggggctggaatacattggaagtgtctctcatagtggaggttcctattacagtccgtctctcaagagtcgagtcaccatatctctggacacgtccagcaatcagttttcccctgaacgattgagttctgtgaccgccgctgacacgggcgtttattactgtgcgagagacggctattatgtagtttttggagtttggttatttcgactaccctagatcggacggggcttccggaccccgtggggcccgtagggtaactacgtggttccaccgtctacccgttgcccgttaccccg

SEQ ID NO: 137479 - DNA, 562 bp, Homo sapiens
  misc_feature: GYAE6OF01BEPCI.46.67.G01.1.454.CMB.1.raw
  modified_base (193)..(193): a, c, t, g, unknown or other
  misc_feature (193)..(193): n is a, c, g, or t
  modified_base (227)..(227): a, c, t, g, unknown or other
  misc_feature (227)..(227): n is a, c, g, or t
  modified_base (333)..(333): a, c, t, g, unknown or other
  misc_feature (333)..(333): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtggganacagtgtcaccatcacttgccggcaagtcgaacntgacactattaatgtatcaacatagaccaggacggccctaagctcctaatctatgctgcatccagtttgctaagtcgggtccatcgagttcagtggcagtgatcgnggacagtattcgactctcaccatcagtaatctagacaacgtgaagtatttagactaacgttattactgtacaacgtaagtaattacaattggttttaccgaccgtaaacgggactaacgtacttaaactaaacgtttaacgaaactggtacggtactacggacctaacgtaatcgttagttacctttacgtaacttccgttacccgtacctacttccgtggttaaaccc

SEQ ID NO: 137480 - DNA, 551 bp, Homo sapiens
  misc_feature: GYAE6OF01AJD88.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggccctaagctcctaatctatgctgcatccagtttgcaaagtggggtcccatcgaggttcagtggcagtgatctgggacagatttcactctcaccatcagtaatctgcaagtgaagtattttgactaattattactatacaacagtaattactaagttcgttttacgaccgtaagggaccaacgtaacctaactaaacttaaacgaacttagtacgtacctagaccgacctattccgtgttacctttacaacttcccttaccccgacctacttccgtgtaacc

SEQ ID NO: 137481 - DNA, 531 bp, Homo sapiens
  misc_feature: GYAE6OF01C8HI3.46.67.G01.1.454.CMB.1.raw
  modified_base (216)..(216): a, c, t, g, unknown or other
  misc_feature (216)..(216): n is a, c, g, or t
  modified_base (384)..(384): a, c, t, g, unknown or other
  misc_feature (384)..(384): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaaccgtgggagacagtgtcaccatcacttgccgggnaagtcggaacattgacactatttaaatgtatcaacatagaccagggacggccctaagctcctaatctatgctgcatccagtttgcaaagtgggtcccatcgaggttcagtggcagtgatcgtgggacagattcactctcaccatcagtaatctgacaacgtgaaagtntttgactaacttattactgtacaactaagtaattactaattggttttaccggaccaaagggtactacgaacttaaacaaacttaacgaaactgtagctagcaaccattactgttaccttcactcttacccgcctaactcgttgtaac

SEQ ID NO: 137482 - DNA, 530 bp, Homo sapiens
  misc_feature: GYAE6OF01C8L6U.46.67.G01.1.454.CMB.1.raw
  modified_base (217)..(217): a, c, t, g, unknown or other
  misc_feature (217)..(217): n is a, c, g, or t
  modified_base (429)..(429): a, c, t, g, unknown or other
  misc_feature (429)..(429): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggnaagtcgaacattgacacctatttaaatggtatcaacatagaccagggacgccctaagctctaatctatgctgcatccagtttgcaaagtgggtcccatcgaggttcagtgcagtggatcgtgggacagtatttcactctcactatccaagttaactctagacaacgtagtaagtattttagactaactttattactgtacaacagtaattanaattgtttcgactaaggactacgaactaactaaattaacgaacttgtgactacgacacctattctcgttcttactacttcttacccgactactcgtgtaac

SEQ ID NO: 137483 - DNA, 624 bp, Homo sapiens
  misc_feature: GYAE6OF01CAE89.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatgtatcaacatagaccagggacggccctaagctcctaatctatgctgcatccagtttgacaaaggtggggtcccagtcgaggttcagtggcagtggatcgtgggacagtatttcactctcaccatcagtaatctgacaacgtgaagtattttagactaactttattacttagtactaaacaagtaaatttaactaaagtttcggttttaccggaaccgtaaacggggaacctaacggtaaaccttaaacgtaaaacgttaaaaccggtaacgttaggtacggtaccgtacggacctaaccctaattaccgttacgtttaccctttacctaacgtttcccctttacccccggtaccctaactttccgttacggttaaaccg

SEQ ID NO: 137484 - DNA, 543 bp, Homo sapiens
  misc_feature: GYAE6OF01BNUGA.46.67.G01.1.454.CMB.1.raw
  modified_base (373)..(373): a, c, t, g, unknown or other
  misc_feature (373)..(373): n is a, c, g, or t
  modified_base (377)..(377): a, c, t, g, unknown or other
  misc_feature (377)..(377): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggacgaccctgtccctcacctgcgctgtctctggtgcctccatcagtagtgtttcttcgtggggctgggtccgcagctccgagggaagggctggaatacattggaagtgtctctcatagtggaggttcctattacagtccgtctctcaagagtcgagtcaccatatctctggacacgtccagcaatcagttttcccngaanatgagttctgtgaccgccgctgacacgggtcgtttattactgtgcgagagacggctattatgtatttttggagttggtttatttcgactacccgtagacgtcggacgggggctccggaccccgttggggccagggatacgtggtcaccgtctccttgccctacccg

SEQ ID NO: 137485 - DNA, 538 bp, Homo sapiens
  misc_feature: GYAE6OF01BZ5LT.46.67.G01.1.454.CMB.1.raw
  modified_base (211)..(211): a, c, t, g, unknown or other
  misc_feature (211)..(211): n is a, c, g, or t
  modified_base (349)..(349): a, c, t, g, unknown or other
  misc_feature (349)..(349): n is a, c, g, or t
  modified_base (371)..(371): a, c, t, g, unknown or other
  misc_feature (371)..(371): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtncctccatcagtagtggtttctctggggctgggtccggcagctccgagggaagggctggaatacattggaagtgtctctcatagtggaggttcctattacagtccgtctctcaagagtcgagtcacatatctctggacncgtccagcaatcagttttcccngaagatgagttctgtcgaccgccgctgactacgggtctttattactgtgcgagagacggctattatgtagtttttggagttggttatttcgactacccgtagatcggacggggctccggcccgtggggccgagggatacgtcggtcaccgtctccttgccctacccg

SEQ ID NO: 137486 - DNA, 536 bp, Homo sapiens
  misc_feature: GYAE6OF01BQ1A3.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctattaaattggtatcaacatagaccagggacggccctaagctcctaatctatgctgcatccagtttgcaaagtgggtcccatcgagttcagtggcagtggatctgggacagtatttcactctcaccatcagtaatctagcaacgtgaagtattttgactaactttattactcgtacaactaagtaatttaactaattcggttttacggaccgtaagggacctaacgaacttaacaaattaaacgaactaggtgctagcacctatctgttcttactacttccttacccgactactctgtac

SEQ ID NO: 137487 - DNA, 582 bp, Homo sapiens
  misc_feature: GYAE6OF01ECHCI.46.67.G01.1.454.CMB.1.raw
  modified_base (338)..(338): a, c, t, g, unknown or other
  misc_feature (338)..(338): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggcagctcccgaggggaaggggctggaatacagttggaagtgtctctcatagtggaggttcctattacagtccgtctctcaagagtcgagtcacatatctctggacacgtccagcaatctagttttcccngaacgatgagttctgtcgaccgccgctgacgacgggtcgtttatactgtgcgagagacgctattatgtattttggagttgttatttcgactacctagacgtcggacggggcctcggacccgtggggaccgagggtaactacgtcggtcaccgtctccgttacgccctaccgaaccgtacgggtcccacgttcccggtcccttcccccgtcggtccctaccccgtccctaccgaacgcgtacccg

SEQ ID NO: 137488 - DNA, 546 bp, Homo sapiens
  misc_feature: GYAE6OF01EOS65.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctgggctgggtccggcagctcccagggagggctggaatacattggaagtgtctctcatagtggaggttcctattacagtccgtctctcaagagtcgagtcaccatatctctggacacgtccagcaatcagttttccctgaagatgagttctgtgaccgccgctgacacgggctttattactgtgcgagagacggctattatgtatttttggagttggttatttcgacaccctagatcggacggggctcgaccccgtggggccgagggtaactacgtcggtcaccgtctcctacgcctcccaccgacggcccactcgtcccttccccgcgtcccaccctcctaccagcgacccg

SEQ ID NO: 137489 - DNA, 579 bp, Homo sapiens
  misc_feature: GYAE6OF01BPDAP.46.67.G01.1.454.CMB.1.raw
tcagactagcagtacacgaccggtgctcgatttagagtatacataattgggtttggggagggtctcggtcaggacacagcatgggacatgagggtccccgctcaggctcctggggctcctgctactctggctccgaggtgccagatggtgacgatcgagctgacccagtctccatcctccctgtctgcgaaccgtgggagacagtgtcaccatcacttgccgggcaaggtccggaacattgacacctattaaattggtatcaacatagaccagggaccgccctaagctacctaactactatgactgcagtccagtttagcaaacgtgggtacctatcgaggttcagtggcagtggatcgtgggacagtattcactctcacctatcagtaactctgctaacgtgaagtagtttgactaactttattactgtcaactagtaattacaattcgtttacggacctaagggtactaacgtaacttaacgtaaagttaaccgaacgtagtaggtcctaggacctaccgtatccgtcgttaccgttcacgttccccttccccggaccctacttccgttggtaaccc

SEQ ID NO: 137490 - DNA, 646 bp, Homo sapiens
  misc_feature: GYAE6OF01CEFTW.46.67.G01.1.454.CMB.1.raw
  modified_base (208)..(208): a, c, t, g, unknown or other
  misc_feature (208)..(208): n is a, c, g, or t
  modified_base (211)..(211): a, c, t, g, unknown or other
  misc_feature (211)..(211): n is a, c, g, or t
tcagactagcagtacacgaccggtgctcgatttagagtatacatattgggtttgggggagtctcggtcaggacacagccatcggacgattgagggtccccgtctctagctcctggggctcctgactactctggactccgaggtgccagtagtgtgacatcggagtctgacccagtcttaccgatcctcctgtctggcaaccgtggganacngtggtcaccagtcacttggccgggcaacgggtccggaacattcgacaccttatttaaatggtacttcaacgattacgaaccctagggaccggacccttaaggctcctaatctactggcctgcactccaggtttggctaaggtgggtcccatcgagttcagttggctaggtgatctagggactagtactttcacgttctcaccgagtccgtagtaactctcgacaacgtagaaacgtattttacgactaattacttactgttacctaactagtaacttaacaatttcgttttacggacctaacgggtaccaacgaacttaacaaagttaaccgaacgttcgtaggtaccttagtacctaaccgtagttaccgttacgtttccgtttactacgtttacccgtttaccccgtacccttaacttccgttcgtaaacccg

SEQ ID NO: 137491 - DNA, 551 bp, Homo sapiens
  misc_feature: GYAE6OF01DDW4Q.46.67.G01.1.454.CMB.1.raw
  modified_base (337)..(337): a, c, t, g, unknown or other
  misc_feature (337)..(337): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcactgtctctggtgcctccatcagtagtggtttcttctggggctgggtccggcagcctcccgaggggaaggggctggaatacattggaagtgtctctcatagtggaggttcctattacagtccgtctctcaagagtcgagtcaccatatctctggacacgtccagcaatcagttttcccngaagatgagttctgtgaccgccgctgacacgggtctttattactgtgcgagagacggctattatgtattttggagttggttatttcgactacctagatcggacggggctcgacccgtggggccgagggtactacgtggtcaccgtctccgttagccctccaccgacggccctagtccgtccttccccgtcgtcccaccctcctaccagcgcccg

SEQ ID NO: 137492 - DNA, 494 bp, Homo sapiens
  misc_feature: GYAE6OF01ANJCV.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggccctaagctcctaatctatgctgcatccagtttgcaaagtggggtcccatcgaggttcagtggcagtggatctgggacagatttcactctcaccatcagtaatctgcaacgtgaagattttgcaacttattactgtcaacagaattacaatgttttcggccaagggacacgactacaaattaacgaactgtgctgcaccatctgtcttcatcttctgccatctg

SEQ ID NO: 137493 - DNA, 535 bp, Homo sapiens
  misc_feature: GYAE6OF01B56AH.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacactatttaaatgtatcaacatagaccaggacggccctaagctcctaatctatgctgcatccagtttgcaaagtgggtcccatcgaggttcagtgcagtgatcgtggacagtattcactctcacatcagtaatctgctaacgtgaagtatttgactaacttattactagtacaacagtaattaactaattgttttacggacctaaggaactaacgtaactaacgtaaacttaaacgaacttacgtaggtctagaccactattccttagtaccttacacttctccccgtactactcgtgtaacg

SEQ ID NO: 137494 - DNA, 563 bp, Homo sapiens
  misc_feature: GYAE6OF01B5376.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattgtatcaacatagaccagggacgccctaagctcctaatctatgctgcatccagtttgcaaagtcgggtcccatcgagttcagtggcagtggatcgtgggacagatttcactctcaccatcagtatctgcaacgtgtaagtattttagactaacttattactgtacaactaagtaatttaactaattcgttttaccgacgtaacgggaactaacgaaccttaactaaaagttaaacgaaacgttgtacggtcctacggacctacctaattcttacgttaccttactacttccttccccgacctacttccgttagtaacg

SEQ ID NO: 137495 - DNA, 560 bp, Homo sapiens
  misc_feature: GYAE6OF01D0K6N.46.67.G01.1.454.CMB.1.raw
  modified_base (254)..(254): a, c, t, g, unknown or other
  misc_feature (254)..(254): n is a, c, g, or t
  modified_base (331)..(331): a, c, t, g, unknown or other
  misc_feature (331)..(331): n is a, c, g, or t
  modified_base (377)..(377): a, c, t, g, unknown or other
  misc_feature (377)..(377): n is a, c, g, or t
  modified_base (413)..(413): a, c, t, g, unknown or other
  misc_feature (413)..(413): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggcctttcggagaccctgtccctcacctgcgctgtctctggtcgcctccatcagtagtggtttcttcgtggggctggggtccggnagctcccgagggaagggctggaatacattggaagtgtctctcatagtggaggttctattacagtccgtctctcaagngtcgagtcacatatctctggacacgtccagcaatctacgttttccngaagatgtagttctgtcgaccgcgctgacgacggtntttattctgtgcgagagacggtctattagtgtagtttttggagttgtttattcgactaccgtaggtactcggacggggtctccggtaccccgtggggaccctagggaacttcgtacggtcgaccgttcctccgttcgcccgtacccg

SEQ ID NO: 137496 - DNA, 552 bp, Homo sapiens
  misc_feature: GYAE6OF01A51BQ.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggaccgccctaagctcctaatctatgctgcatccagtttgctaaagtggggtcccagtcgaggttcagtggcagtgatcgtgggacagtattcactctacaccatcagtatctgacaacgtgaagtatttgactaactttattactgtacaataagtaattactaattcggtttacggaccgtaagggacaaccgtaactaaactaaattaaacgaacgtgtacggactagcctaactatctcgttaccttactaacttccctacccgtcctaacttcccgtgtaacc

SEQ ID NO: 137497 - DNA, 601 bp, Homo sapiens
  misc_feature: GYAE6OF01E0QLX.46.67.G01.1.454.CMB.1.raw
  modified_base (255)..(255): a, c, t, g, unknown or other
  misc_feature (255)..(255): n is a, c, g, or t
  modified_base (337)..(337): a, c, t, g, unknown or other
  misc_feature (337)..(337): n is a, c, g, or t
  modified_base (401)..(401): a, c, t, g, unknown or other
  misc_feature (401)..(401): n is a, c, g, or t
tcagactagcagtacacgaccggtgctcgatttagagtatacatattgggtttggtcctcctgctggtggcagctcccaggatgggtccctgtccctggtgcaactgcaggagtccgggcccacgactggtgaggccttcggagaccctgtccctcacctgcgctgtctctggtcgcctccatcagtagtggtttctcgtggggctgggtccggcagctcccgagggaagggctggaatacattggaagtgtctntcatagtggagttcctattacagtccgtctctacaagagtcgagtcactatatctctggacacgtcagcaatcagttttccngaacatgagttctgtcgaccgccgctcgactacgggtcttttatacgtgtgcgtagagtacggntattagtgttattttggagttggttatttcggactacccgtagacgtcggacgggcctccggaccccgtggggcccgagggtaacttcgtcggtcctacccgtctccttacgtccctaccgaccgaacgggccctacggttccggttcccttccccccggtaggcccctaccccgtcccgtacccgtaagccgtaccccg

SEQ ID NO: 137498 - DNA, 503 bp, Homo sapiens
  misc_feature: GYAE6OF01B596W.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacgccctaagctcctaatctatgctgcatccagtttgcaaagtgggtcccatcgaggttcagtggcagtgatctgggacagattcactctcaccatcagtaatctgcaacgtgaagattttgctaacttattactgtcaacagaattacaatgttttcggctaagggactacgactaacaaattaacgaactgtaggctagcaccatctgtcttcacttcttcccgaccatctgtac

SEQ ID NO: 137499 - DNA, 596 bp, Homo sapiens
  misc_feature: GYAE6OF01CUW9V.46.67.G01.1.454.CMB.1.raw
  modified_base (210)..(210): a, c, t, g, unknown or other
  misc_feature (210)..(210): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccccgtccctcacctgcgctgtctctggtgcctccatcagtagtggtttcttctggggctgggtccggnagctcccagggaaggggctggaatacattggaagtgtctctcatagtggaggttcctatttacagtccgtctctcaagagtcgagtcaccatatctctggacacgtccagcaaatctacgttttcccctagaagtatgagtttcgtgtcgacccgccgctgacacgggtcgtttatacgtgtgcgagagacggctattatgtattttggagttggttatttcgactacccgtagactcggacggggctccgacccgtgggccaggaactacgtggtcaccgtctaccgttagcccgtaccacccgaacggcccaacgttcccggttacccttcccccgtcggtccctacccccgttcccttacccaaacggtacgccctaacccgg

SEQ ID NO: 137500 - DNA, 539 bp, Homo sapiens
  misc_feature: GYAE6OF01DY2MJ.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacggccctaagctcctaatctatgctgcatccagtttgcaaagtgggtcccatcgaggttcagtggcagtggatcgtgggacagatttcactctcaccatcagtaatctgcaacgtgaagtattttagtaactttattactgtacaaacagtaatttacaattgttttcggacctaaagggacaacggtaactaacaaacttaaacgaacgtagtggactagacaccgtattcttggtccttactattcccttacccgcctaattctgattacg

SEQ ID NO: 137501 - DNA, 548 bp, Homo sapiens
  misc_feature: GYAE6OF01A6XFQ.46.67.G01.1.454.CMB.1.raw
  modified_base (335)..(335): a, c, t, g, unknown or other
  misc_feature (335)..(335): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccaggggaaggggctggaatacattggaagtgtctctcatagtggaggttcctattacagtccgtctctcaagagtcgagtcaccatatctctggacacgtccagcaatcagttttcccngaagatgagttctgtgaccgccgctgacacgggctttatactgtgcgagagacggctattatgtatttttggagttggttatttcgacaccctagactcggacgggggctcggaccccgtggggccaggggtaactacgtggtcaccgtctccttacgcctccaccgagggcccactccggtccttccccgtggtccaccctcctccagcgcc

SEQ ID NO: 137502 - DNA, 597 bp, Homo sapiens
  misc_feature: GYAE6OF01BT7XZ.46.67.G01.1.454.CMB.1.raw
  modified_base (589)..(589): a, c, t, g, unknown or other
  misc_feature (589)..(589): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgccaaccgtgggagacagtgtcaccatcacttgccgggcaagtcggaacattgacaccttatttaaatggtatcaacatagacagggacgaccctaagctacctaatctatgctgcatcctagtttgactaaaggtcgggtacccagtcggagttcaggtggcgtaggtggatcgtagggactagtattcactctacacatcaagtaatctagactaacgtagtaaacgttattttacgaacttaatttaacttacgttacgtactaaaactaggttaaatttaactaagtttcggttttaaccggaaccgtaaagggtaacctaaccgtaaccttaaactaaaacgttaaaccgaactaggtacgtactacgacctactaatcttcgtacttactactccttcccactntctgtaac

SEQ ID NO: 137503 - DNA, 567 bp, Homo sapiens
  misc_feature: GYAE6OF01BKVWT.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctattaaatggtatcaacatagaccagggacggccctaagctcctaatctatgctgcatccagtttgcaaagtggggtcccatcgaggttcagtggcagtggatcgtgggacagatttcactctcaccatcagtaatctgcaacgtgaagtattttgactaactttattactgttacaactaagtaattactaatttggttttaccggaccgtaaagggtacctaacggtaactaaactaaacttaaacgtaactgtaggtctacgacctaacctattacgttcgttacctttactaactttcccttaccccgacctaacgttctaggtaac

SEQ ID NO: 137504 - DNA, 512 bp, Homo sapiens
  misc_feature: GYAE6OF01DSN4X.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcgacattgacacctatttaaatggtatcaacatagaccagggacggccctaagctcctaatctatgctgcatccagtttgcaaaggtgggtcccatcgaggttcagtgcagtggatcgtgggacagatttcactctcaccatcagtaatctgcaacgtgaagtattttgactaactttattactgtacaacagtaattacaattgtttacggacaagggactacgactaactaaattaacgaactgtggtctgacactatctgtacttcacttcctaccgcctatctgtac

SEQ ID NO: 137505 - DNA, 498 bp, Homo sapiens
  misc_feature: GYAE6OF01ESZ2C.46.67.G01.1.454.CMB.1.raw
  modified_base (405)..(405): a, c, t, g, unknown or other
  misc_feature (405)..(405): n is a, c, g, or t
  modified_base (411)..(411): a, c, t, g, unknown or other
  misc_feature (411)..(411): n is a, c, g, or t
  modified_base (413)..(413): a, c, t, g, unknown or other
  misc_feature (413)..(413): n is a, c, g, or t
  modified_base (491)..(491): a, c, t, g, unknown or other
  misc_feature (491)..(491): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacgccctaagctcctaatctatgctgcatccagtttgcaaagtgggtcccatcgaggttcagtggcagtgatctgggacagtatttcactctcaccatcagtaatctgcaacgtgaagtatttgactaacttattactntacaananaattacattgttcgacaagggactacgactaacaattaaacgactgtgctagacactatctgtcttcatcctcccgcntctgtac

SEQ ID NO: 137506 - DNA, 512 bp, Homo sapiens
  misc_feature: GYAE6OF01EGZ4K.46.67.G01.1.454.CMB.1.raw
  modified_base (411)..(411): a, c, t, g, unknown or other
  misc_feature (411)..(411): n is a, c, g, or t
  modified_base (507)..(507): a, c, t, g, unknown or other
  misc_feature (507)..(507): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatgtatcaacatagaccagggacggccctaagctcctaatctatgctgcatccagtttgcaaagtgggtcccatcgaggttcagtggcagtggatcgtgggacagtattcactctcacatcagtaatctgacaacgtgaagtatttcgactaacttattatcccgtanaactagaattacaattagtttcgacctaagggactacgtaactaacaaattaacgaactgtgactgacactatctgtcttcacttctcccatactntgtac

SEQ ID NO: 137507 - DNA, 623 bp, Homo sapiens
  misc_feature: GYAE6OF01D3MKZ.46.67.G01.1.454.CMB.1.raw
  modified_base (289)..(289): a, c, t, g, unknown or other
  misc_feature (289)..(289): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccgagggaaggggctggaatacattggaagtgtctctcatagtggaggttcctattacagtccgtctctcaagngtcgagtcaccatatctctggacacgtccagcaatcagttttccctgaagatgagttctgtgaccgccgctgacacgggcgtttatactgtgcgagagacggctagttagttggtttagtttaggtggtttagtttacgttacgtaaccctacgtagtacggtacggggccggtccgtaccccgtccggggccggacggtaacggtacgttacggtcgtacccgtccgttccgttaccgtccgtccctacccgaaccgggtacccgaccgtccggttcccgttcccccgttcccggccgtaccccctaccctaccctaacgacgccgtaccccg

SEQ ID NO: 137508 - DNA, 612 bp, Homo sapiens
  misc_feature: GYAE6OF01BRHTM.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacttattaaatgtatcaacatagacaggacgccctaagctcctaatctatgctgcatccagtttcgctaaaagtggggtacccaatcgtaggttcagttgcagtggatcgtgggacagtattcactctcaccatcagtatctgacaacgtgaagtatttgactaacttattactgtacaactagtaaattacaaagttgttttacggaccgtaaagggtacctaacggtaaccttaaacgtaaaactttaaaacgaaccgtttaggtacggtaccgttaaggtaccctaaacccgttagttacccgttcggtttaccctttaaccgtaacgttaccccgtttaccccggtaccctaacgtttaccgtacggttaaaccc

SEQ ID NO: 137509 - DNA, 504 bp, Homo sapiens
  misc_feature: GYAE6OF01EE2XL.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacgccctaagctcctaatctatgctgcatccagtttgcaagtgggtcccatcgagttcagtggcagtggatcgtgggacagatttcactctcaccatcagtaatctgcaacgtgaagtattttgactaacttattactgtacaactagtaattacaatgtttcggacaaggacacgactaacaaattaacgactagtagctgcgacatctgtcttcactcttacccgctactcgtgtac

SEQ ID NO: 137510 - DNA, 608 bp, Homo sapiens
  misc_feature: GYAE6OF01D549H.46.67.G01.1.454.CMB.1.raw
  modified_base (222)..(222): a, c, t, g, unknown or other
  misc_feature (222)..(222): n is a, c, g, or t
tcagactagcagtacacgaccggtgctcgatttagagtatacatattgggtttggggagtctcggtcaggacacagcatggacatgagggtccccgctcagctcctggggctcctgctactctggctccggaggtgccagatgtgacatcgagctgacccagtctccatccctccctgtctgcaaccggtgggagacagtgtccaccatcacttggccgggnaagtcgaacattgacactatttaaatgtatcaacatagaccagggaccggccctaagctacctaatctatgctgctatccagttttgacgtaaaggtcggggtccccagtcggtaggttcaggtggcgagtggatcgtgggactagtatttcactctcaccatacaagtaatctagacaacgtagtaagttatttagactaaacgtttattaactagtacaactaagtaaactttaactaagtttcggtttaccggaaccgtaaacgggacctaaaccgttaacttaaacgtaaaacttaaacgaacgttaggtacggtactacgaccgtaccgtattccgtagttaccttactacttcccttacccgtactaacttcgtgtaacg

SEQ ID NO: 137511 - DNA, 518 bp, Homo sapiens
  misc_feature: GYAE6OF01ASSXY.46.67.G01.1.454.CMB.1.raw
  modified_base (510)..(510): a, c, t, g, unknown or other
  misc_feature (510)..(510): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggccctaagctcctaatctatgctgcatccagttttgcaaagtggggtcccatcgaggttcagtggcagtggatctgggacagatttcactctcaccatcagtatctgcaacgtgaagtattttgctaacttattactagtctaacagtaattactaattgttttcgaccaacgggacacgactaactaaattaaacgtaaactgtaggctgacaccatctcgtcttcactcttcccgaccnctctgtac

SEQ ID NO: 137512 - DNA, 517 bp, Homo sapiens
  misc_feature: GYAE6OF01CCMVA.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggccctaagctcctaatctatgctgcatccagtttgcaaagtggggtcccatcgaggttcagtggcagtgatctgggacaggatttcactctcaccatcagtaatctgacaacgtgaagtattttgactaacttattactgtacaacagtaattactaattgtttacggaccaagggactaacgtactaactaaattaacgaactgtgctgacactatctgtacttctacttcttcccacactgtgtac

SEQ ID NO: 137513 - DNA, 555 bp, Homo sapiens
  misc_feature: GYAE6OF01CKW0Y.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacactatttaaatgtatcaacatagaccagggacgccctaagctcctaatctatgctgcatccagtttgcaagtgggtcccatcgagttcagtgcagtgatcgtgggacagatttcactctcaccatcagtatctgacaacgtgaagtattttgactaacttattactgtactaacagtaattactaattgttttacgacctaagggaacaacgtaactaactaaaacgttaaacgaacgttagtacggtactacgacctaaccgtattacgttcgttaccttacgtaacttcccgttaccccgtacctaacttccgtgtaacc

SEQ ID NO: 137514 - DNA, 563 bp, Homo sapiens
  misc_feature: GYAE6OF01DC37N.46.67.G01.1.454.CMB.1.raw
  modified_base (361)..(361): a, c, t, g, unknown or other
  misc_feature (361)..(361): n is a, c, g, or t
tcagactagcagtacacgaccggtgctcgatttagagtatacatattgggtttgggggagtctcggtcaggacacagcatggacatgagggtccccgctcagctcctggggctcctgctactctggctccgaggtgccagatgtgacatcgagctgacccagtctccatcctccctgtctgcaaccggtgggagacagtgtcaccatcacttgccgggcaagtcgacattgacactatttaatgtatcaacatagacagggacgccctaagctactaatctatgctgctatccagtttgacgaaaggtcgggtcccatcgaggttcaggtgcaggtggatcgtgggacagtatttcactcncacatcaagtaatctgacaacgtagtaagtattttagactaactttattacttgtactaactaagtaatttaactaatttcgtttacggaccgtaacgggtaacaacgtaacctaaactaaacttaaacgaacgtgtaggactacgacctaaccattcgtcgttccttactacgttcccttacccgacctattccgtgtaac

SEQ ID NO: 137515 - DNA, 544 bp, Homo sapiens
  misc_feature: GYAE6OF01CVV87.46.67.G01.1.454.CMB.1.raw
  modified_base (217)..(217): a, c, t, g, unknown or other
  misc_feature (217)..(217): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggnaagtcggaacattgacactatttaaatgtatcaacatagacagggacgccctaagctcctaatctatgctgcatccagtttgcaaagtgggtcccatcgaggttcagtgcagtgatcgtgggacagatttcactctcacatcagtaatctgacaacgtgaagtattttagactaacttattactgtacaactagtaattactaattgttttacggactaacgggactaacgaactaactaaacttaaacgaacgttagtacggactagacctaaccgtattaccttacgttcttactaacttcccttacccgacctactctggtaac

SEQ ID NO: 137516 - DNA, 512 bp, Homo sapiens
  misc_feature: GYAE6OF01B0UNA.46.67.G01.1.454.CMB.1.raw
  modified_base (507)..(507): a, c, t, g, unknown or other
  misc_feature (507)..(507): n is a, c, g, or t
  modified_base (509)..(509): a, c, t, g, unknown or other
  misc_feature (509)..(509): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctattaaattggtatcaacatagaccagggacggccctaagctcctaatctatgctgcatccagtttgcaaagtggggtcccagtcgaggttcagtggcagtggatctgggacagtatttcactctcaccatcagtaatctagacaacgtgaagtattttgactaactttattactgtacaacagaattacaattgttttcggactaagggactacgaacttaacaaattaacgaactagtgctgacacatctgtcttcactctccacactntntac

SEQ ID NO: 137517 - DNA, 546 bp, Homo sapiens
  misc_feature: GYAE6OF01CF9J8.46.67.G01.1.454.CMB.1.raw
  modified_base (378)..(378): a, c, t, g, unknown or other
  misc_feature (378)..(378): n is a, c, g, or t
  modified_base (475)..(475): a, c, t, g, unknown or other
  misc_feature (475)..(475): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtcccctcacctgcgctgtctctggtgcctccatcagtagtggtttcttcgtggggctgggtccggcagcctccgagggaaggggctggaatacattggaagtgtctctcatagtggaggttcctattacagtccgtctctcaagagtcgagtcaccatatctctggacacgtccagcaatctagttttcccngaagatgattctgtgaccgcgctgacacgggtctttatacgtgtgtcgagagacggctagttatgtattttggagttggttatttcgactacctagngtcggcggggtctccggacccgtggggccagggaactacgttcggtaccaccgttctccttgccctacccg

SEQ ID NO: 137518 - DNA, 532 bp, Homo sapiens
  misc_feature: GYAE6OF01CIT87.46.67.G01.1.454.CMB.1.raw
  modified_base (359)..(359): a, c, t, g, unknown or other
  misc_feature (359)..(359): n is a, c, g, or t
  modified_base (427)..(427): a, c, t, g, unknown or other
  misc_feature (427)..(427): n is a, c, g, or t
  modified_base (507)..(507): a, c, t, g, unknown or other
  misc_feature (507)..(507): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacggccctaagctcctaatctatgctgcatccagtttgcaaagtggggtcccatcgaggttcagtggcagtggatctgggacagatttcactcncaccatcagtaatctgcaacgtgaagtatttgactaactttattacttgtacaactagtaaacttaanaattgttttcggacctaagggaactacgaactaactaaattaacgaactgtacgtctagaccactattctgttaccttanacttccttacccgctactctgtaac

SEQ ID NO: 137519 - DNA, 618 bp, Homo sapiens
  misc_feature: GYAE6OF01DUNV3.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccaggacgccctaagctctaatctatgctgcatccagtttgactaaagtcgggtcccagtcgaggttcaggtggcagtggatcgtgggactagtatttcactctacacatcagtaatctagcaacgtgaagtatttcgactaacttattactgtactaacgtagtaaactttaacgtaatttcggttttaaccggaacccgtaaacgggtacctaaaccggtaaaccttaaacgtaaaaacgtttaaaccggaaacgtttggtacggtaccttacggaaccctaaccgtaattccgttacgttccctttaccgtaacctttcccgtttacccccgaccttaacttccgttaggttaacc

SEQ ID NO: 137520 - DNA, 503 bp, Homo sapiens
  misc_feature: GYAE6OF01E2U33.46.67.G01.1.454.CMB.1.raw
  modified_base (480)..(480): a, c, t, g, unknown or other
  misc_feature (480)..(480): n is a, c, g, or t
  modified_base (494)..(494): a, c, t, g, unknown or other
  misc_feature (494)..(494): n is a, c, g, or t
  modified_base (496)..(496): a, c, t, g, unknown or other
  misc_feature (496)..(496): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggccctaaagctcctaatctatgctgcatccagttttgcaaagtggggtcccatcgaggttcagtggcagtggatctgggacagatttcactctcaccatcagtaatctgcaacgtgaagtattttgctaacttattactgtcaacagaattacaatgttttcggaccaaggacacgactaacaaattaaacgaactgtgctgcaccatctntcttcatcttcccncntctgtac

SEQ ID NO: 137521 - DNA, 538 bp, Homo sapiens
  misc_feature: GYAE6OF01BSK4S.46.67.G01.1.454.CMB.1.raw
  modified_base (382)..(382): a, c, t, g, unknown or other
  misc_feature (382)..(382): n is a, c, g, or t
  modified_base (476)..(476): a, c, t, g, unknown or other
  misc_feature (476)..(476): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggcagcctcccgagggaaggggctggaatacattggaagtgtctctcatgtggaggttcctattacagtccgtctctcaagagtcgagtcaccatatctctggacacgtcagcaatctagttttcccagaagtntgatttctgtcgaccgcgctgacgcggtcgtttatacgtgtgcgagagacggtctattatgttattttggagttggttatttcgactacctagngtcggacgggtctccggcccgtgggcagggaatcgtcgtcaccgtctccttacgcctacccg

SEQ ID NO: 137522 - DNA, 494 bp, Homo sapiens
  misc_feature: GYAE6OF01DEKCS.46.67.G01.1.454.CMB.1.raw
  modified_base (227)..(227): a, c, t, g, unknown or other
  misc_feature (227)..(227): n is a, c, g, or t
  modified_base (471)..(471): a, c, t, g, unknown or other
  misc_feature (471)..(471): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaaccgtgggagacagtgtcaccatcacttgccgggcaagtcggaacntgacactattaatggtatcaacatagaccaggacgccctaagctctaatctatgctgcatccagtttgcaagtggggtcccatcgaggttcagtggcagtggatcgtggacagatttcactctcacatacagtaatctgacaacgtgaagtatttagctaactttattactagtcaacagtaattacattgtttcggacaagggacacgactaacaattacgactgtgctgcacatctgtcttnacttcttacccgacactctgtac

SEQ ID NO: 137523 - DNA, 503 bp, Homo sapiens
  misc_feature: GYAE6OF01CXB7L.46.67.G01.1.454.CMB.1.raw
  modified_base (493)..(493): a, c, t, g, unknown or other
  misc_feature (493)..(493): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacgccctaagctctaatctatgctgcatccagtttgcaaagtgggtcccatcgaggttcagtggcagtggatctgggactagatttcactctcaccatcagtaatctgacaacgtgaagtattttgactaacttattactgtacaacagtaattacaattgttttacgactaagggacacgactaacaaattaacgaactgtgctgcacatctgtcttcattctcccncactctgtac

SEQ ID NO: 137524 - DNA, 511 bp, Homo sapiens
  misc_feature: GYAE6OF01CS8HA.46.67.G01.1.454.CMB.1.raw
  modified_base (501)..(501): a, c, t, g, unknown or other
  misc_feature (501)..(501): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacgccctaagctctatctatgctgcatccagtttgcaaagtgggtcccatcgaggttcagtggcagtggatcgtgggacagatttcactctcaccatcagtaatctgactaacgtgaagtattttgactacttattactgtacaacagtaattaactaattgtttacggacctaaggactacgactaacaaattaacgaactgtgctgcacctatctgtccttcacttccttcccnctatctgtac

SEQ ID NO: 137525 - DNA, 542 bp, Homo sapiens
  misc_feature: GYAE6OF01BDNL2.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccgagggaaggggctggaatacattggaagtgtctctcatagtggaggttcctattacagtccgtctctcaagagtcgagtcaccatatctctggacacgtccagcaatcagttttccctgaagatgagttctgtgaccgccgctgacacgggtcgtttattactgtgcgagagacggctattatgtattttggagttggtttatttcgactaccctagagtcgacgggggtctccggacccgtggggccagggaatacgtggtcaccgtctccttagccctacccg

SEQ ID NO: 137526 - DNA, 538 bp, Homo sapiens
  misc_feature: GYAE6OF01ANLUJ.46.67.G01.1.454.CMB.1.raw
  modified_base (430)..(430): a, c, t, g, unknown or other
  misc_feature (430)..(430): n is a, c, g, or t
  modified_base (530)..(530): a, c, t, g, unknown or other
  misc_feature (530)..(530): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggaaggggctggaatacattggaagtgtctctcatagtggaggttcctattacagtccgtctctcaagagtcgagtcaccatatctctggacacgtccagcaatcagttttccctgaagatgagttctgtgaccgcgctgacacgggcgtttatactgtgcgagagacggctattatgtatttttggagttggttatttcgacaccctagntcgacggggctcggacccctggggccagggaatacgtggtcaccgtctcctagccctccaccgacggcccagtccggtccttccccctggccaccctccnccagcgcc

SEQ ID NO: 137527 - DNA, 646 bp, Homo sapiens
  misc_feature: GYAE6OF01DX5U8.46.67.G01.1.454.CMB.1.raw
  modified_base (218)..(218): a, c, t, g, unknown or other
  misc_feature (218)..(218): n is a, c, g, or t
  modified_base (377)..(377): a, c, t, g, unknown or other
  misc_feature (377)..(377): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtgggagacagtgtcaccatcacttgccgggnaagtcgaacattgacacttattaatgtatcaacatagaccaggacgccctaagctacctaatctatgctgcactccagtttgacaaagtgggtacccagtcggaggttcagtggcagtggatcgtgggacagtattcactctcacatcagtaactctanactaacgtagtaaagtattttagactaaatttacttaacgttgtaacctaaactaagtaaactttaactaagtttcggttttaccggaccgtaaaggggaaccctaaaccggtaaacgttaaaacctaaaacgtttaaaaccggaacgttacggttacgggtaacctacgggtaaccctaaacccgtaagtttaccctttgttaccccttttactaaccgtttaccccgtttacccccgtaacccgttaactttccgtaggttaaaccc

SEQ ID NO: 137528 - DNA, 546 bp, Homo sapiens
  misc_feature: GYAE6OF01E00SN.46.67.G01.1.454.CMB.1.raw
  modified_base (331)..(331): a, c, t, g, unknown or other
  misc_feature (331)..(331): n is a, c, g, or t
  modified_base (366)..(366): a, c, t, g, unknown or other
  misc_feature (366)..(366): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagacccctgtccctcacctgcgctgtctctggtgcctccatcagtagtggtttcttctggggctgggtccggcagctccagggagggctggaatacattggaatgtctctcatagtggaggttcctattacagtccgtctctcaagagtcgagtcaccatatctctggacacgtccagcaatcagttttcccngaagatgagttctgtgatcgccgctgacacgggtntttatactgtgcgagagacgctattatgtattttggagtggttattcgacacccgtagatcgacggggctcgaccccgtgggccgagggaatacgtggtcaccgtctccttacgcctccgaccgaagggcccacgtccggtccttccccccgtcggccacccctccctcccgaagtaccg

SEQ ID NO: 137529 - DNA, 555 bp, Homo sapiens
  misc_feature: GYAE6OF01EF23V.46.67.G01.1.454.CMB.1.raw
  modified_base (193)..(193): a, c, t, g, unknown or other
  misc_feature (193)..(193): n is a, c, g, or t
  modified_base (426)..(426): a, c, t, g, unknown or other
  misc_feature (426)..(426): n is a, c, g, or t
tcagactagcagtacacgaccggtgctcgatttagagtatacatagttgggtttggggagtctcggtcaggacacagcatggacatgagggtccccgctcagctcctggggctcctgctactctggctccgaggtgccagatgtgacatcgagctgacccagtctccatcctcctgtctgcaaccggtggganacagtgtcaccatcacgttgccgggcaagtcggaacattgactactatttaaattggtatcaacatagaccaggacgcctaagctctatctatgctgcatccagttgcaagtgggtcccagtcgaggttcagtgcagtgatcgtggacagtatttcacgtctcactatcagtaatctagacaacgtagtaagtattttgactaacttattactagtacaactagtaacttaanaattggttttacggaccgtaagggactaacgtaactaactaaagttaaacgtaactagtacggtctagtaccgtaaccgtattacgtcgttaccgttactacgttccttacccgactacttcgtgtaac

SEQ ID NO: 137530 - DNA, 564 bp, Homo sapiens
  misc_feature: GYAE6OF01CPCWU.46.67.G01.1.454.CMB.1.raw
  modified_base (210)..(210): a, c, t, g, unknown or other
  misc_feature (210)..(210): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggnagctcccaggggaaggggctggaatacattggaagtgtctctcatagtggaggttcctattacagtccgtctctcaagagtcgagtcaccatatctctggacacgtccagcaaatcagttttccctagaagatgagtttctgtgaccgccgctgacgacgggtctttattactgtgcgagagacggctattatgtatttttggagttggtttatttcgactacctagatcggacggggcctcgacccgtgggccgagggtaatacgtcggtcaccgtcctccttacgccctccaaccgacggcccagtccggtcccttcccccgtcggccctccctcctacccaagcgtacccg

SEQ ID NO: 137531 - DNA, 595 bp, Homo sapiens
  misc_feature: GYAE6OF01AJ4EV.46.67.G01.1.454.CMB.1.raw
  modified_base (233)..(233): a, c, t, g, unknown or other
  misc_feature (233)..(233): n is a, c, g, or t
  modified_base (247)..(247): a, c, t, g, unknown or other
  misc_feature (247)..(247): n is a, c, g, or t
  modified_base (347)..(347): a, c, t, g, unknown or other
  misc_feature (347)..(347): n is a, c, g, or t
  modified_base (368)..(368): a, c, t, g, unknown or other
  misc_feature (368)..(368): n is a, c, g, or t
tcagactagcagtacacgaccggtgctcgatttagagtatacatattgggtttggggaccgtcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctcactcagtgtgtttctcgnggggctgggtccgnagctccgaggagggctggaatcgattggaagtgtcgtctcatagtggaggttcctattacaggtcctctctcaagagtcgagtcgaccatatctctgacncgtcagcaatcagttttcccngaagactgagttctgtcgaccgccgactgacgacgggtctttagtactggtcgcgagtacgacggtcttattagttgtagtttttgggagtttacggtttagtttacgtaacctacccgttagtacgtcggtaccgggggtccttcccgggtaccccgtgggggtccctaggggtaaacttacgtcggttaccgtacccgtgttacccgttacgtcccgtaaccccg

SEQ ID NO: 137532 - DNA, 548 bp, Homo sapiens
  misc_feature: GYAE6OF01D3WPT.46.67.G01.1.454.CMB.1.raw
  modified_base (334)..(334): a, c, t, g, unknown or other
  misc_feature (334)..(334): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggaaggggctggaatacattggaagtgtctctcatagtggaggttcctattacagtccgtctctcaagagtcgagtcaccatatctctggacacgtccagcaatcagttttcccngaagatgagttctgtgaccgccgctgacacgggcgtttattactgtgcgagagacggctattatgtatttttggagttggttatttcgacaccctagatcgacggggctcggaccccgtggggccaggggaatacgtggtcaccgtctccttagcctccaccgaacgggcccagtccggtccttccccctggccaccctcctccagcgtacccg

SEQ ID NO: 137533 - DNA, 514 bp, Homo sapiens
  misc_feature: GYAE6OF01BUMX0.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggccctaagctcctaatctatgctgcatccagtttgcaaagtggggtcccatcgaggttcagtggcagtggatctgggacagatttcactctcaccatcagtaatctgcaacgtgaagtattttgactaacttattactagtcaacagtaattactaattgtttcggaccaagggacaacgaactaacaaattaacgaactgtgactgacactatctgtcttcaattccttcccgaccatctgtac

SEQ ID NO: 137534 - DNA, 558 bp, Homo sapiens
  misc_feature: GYAE6OF01A7Z96.46.67.G01.1.454.CMB.1.raw
  modified_base (211)..(211): a, c, t, g, unknown or other
  misc_feature (211)..(211): n is a, c, g, or t
  modified_base (339)..(339): a, c, t, g, unknown or other
  misc_feature (339)..(339): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtncctccatcagtagtggtttctctggggctgggtccggcagctcccagggaaggggctggaatacattggaagtgtctctcatagtggaggttcctattacagtccgtctctcaagagtcgagtcaccntatctctggacacgtcagcaatcagttttccctgaaagtatgtagttctgtgaccgcgctgactagggtcgtttatactgtgcgagagacggtctattaatcgtattttggagttggttatttcgactacctagtagtcgtacggggtctccggtaccccgtggggaccctagggaacttcgtacgggtctaccgttaccgtcccttagcccgtacccg

SEQ ID NO: 137535 - DNA, 535 bp, Homo sapiens
  misc_feature: GYAE6OF01CYMP4.46.67.G01.1.454.CMB.1.raw
  modified_base (372)..(372): a, c, t, g, unknown or other
  misc_feature (372)..(372): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcgaacattgacactatttaaatgtatcaacatagaccaggacgccctagctctatctatgctgcatccagtttgacaagtcgggtacccagtcgaggttcagtggcagtgatcgtgggacagtactttcactctacacatacagtaactcngactaacgtagtaattatttagacttaactttatactagtacaactagtaaattactaagtttcggtttacgaccgtaaggactacgaactaactaaataacgaattggtagctagactacctattcgtcttccttactcttcccttccgactatcgtgtaac

SEQ ID NO: 137536 - DNA, 546 bp, Homo sapiens
  misc_feature: GYAE6OF01DVP61.46.67.G01.1.454.CMB.1.raw
  modified_base (211)..(211): a, c, t, g, unknown or other
  misc_feature (211)..(211): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtncctccatcagtagtggtttcttcgtggggctggggtccggcagcctccgagggaaggggctggaatacattggaagtgtctctcatagtggaggttcctattacagtccgtctctcaagagtcgagtcaccatatctctggacacgtccagcaatcagttttccctgaagatgagttctgtgaccgccgctgacacgggtcgtttattactgtgcgagagacgctattatgtattttggagttggttatttcgactaccctagatcggacggggtctccggtaccccgtggggccagggaactacgtcggtcacccgtctcccttgccctacccg

SEQ ID NO: 137537 - DNA, 630 bp, Homo sapiens
  misc_feature: GYAE6OF01BHMNL.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggccctaagctcctaatctatgctgcatccagtttgcaaagtggggtcccagtcgaggttcagtggcagtggatctgggacagatttcactctcaccatcagtaatctgctaacgtgtaagtattttgactaactttatttactgtacaactaagtaatttaactaagtttcgttttaccgggacccgtaaacggggaacctaaccggtaaccttaaactaaaacgtttaaaaccggaacgttaggttacgggtaccttaggtaccgtaacccttaattacccgttcggtttacccttttacccgtaacttttccccgtttaccccccggtacccttaacgtttcccgttacggttaaaccg

SEQ ID NO: 137538 - DNA, 536 bp, Homo sapiens
  misc_feature: GYAE6OF01D41VQ.46.67.G01.1.454.CMB.1.raw
  modified_base (332)..(332): a, c, t, g, unknown or other
  misc_feature (332)..(332): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccgcagctccagggaaggggctggaatacattggaagtgtctctcatagtggaggttcctattacagtccgtctctcaagagtcgagtcaccatatctctggacacgtccagcaatcagttttcccngaagatgagttctgtgaccgccgctgacacgggcgtttatactgtgcgagagacggctattatgatttttggagttggttatttcgacaccctagatcgacggggctcggacccctggggccaggggatacgtggtcaccgtctccttagcctccaccaagggcccagtcggccttccccctggccaccctcctcccaagcgcc

SEQ ID NO: 137539 - DNA, 669 bp, Homo sapiens
  misc_feature: GYAE6OF01DCH98.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctcgaggtgccagatgtgacatcgagctgacccagtctccatcctccctgtctgcaaccgtgggagacagtgtccaccatccacgttggcccgggacaaggtaccggaactatttcgaaccaaccttaattttaaattggtaactacaaacatagaccgaagggaccggaccctaagctactaatctatgctgcatcctagtttcgactaaaggtcgggtacccagtcgaggttcagtggcaggtgatcgtgggactagtactttcactctacacctataccaagtaactctacgactaaacggtagtaaagttacttttacggaacctttaaacgtttactttaacgttagttaaccaaacgtaagtaaactttaactaacgtttcgtttttaacccgggaaccgtaaaggggtaacctaaacggtaaccttaaacgtaaaacgtttaaaccgaacgttacggtacggccttacggaaccctaacctacgttacttcggttaccttactacgtttcccttacccgcctaacttcgtagtaacc

SEQ ID NO: 137540 - DNA, 803 bp, Homo sapiens
  misc_feature: GYAE6OF01DMKNU.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgagggccttcggagaccctgtccctcacctgcgctgtctctggtgcctccatcagtagtggtttcttcgtggggctgggtccggcagcctcccgaggggaaggggctagggaatacagttggaagtgtctctcatagtggaggttcctattacagtccgtctctacagagtcgagtcaccatatctctggacacgtccagctaatctacgttttcccagaagtactggtagtttcctggtcgtacccggccgtacgtacggtaaccgtaccggggttacgtttttaattaccgtaggttggtaccggaaggtacggtaacggtccgtttaagtttagttaggtttaagttttttaggggaaggttttacgggttttaacttttaccggtaaacccgttaaccccgtttaaggtaccggttacccggggtaaccggggggttacccttacccgggtaaccccccgggttagggggaccccggtaagggggtaaacctttaaccgggttacgggttacccgtaccccggttccgtttacccgttaccgtacccccgtacccgaaaccccggtaaccggggtacccctaaaccggttccccgggttacccctttacccccccgtccgggtacccctacccccgttaccccgtaccccgaaacggtacccggtaccccgg

SEQ ID NO: 137541 - DNA, 610 bp, Homo sapiens
  misc_feature: GYAE6OF01AR180.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggccctaagctcctaatctatgctgcatccagtttgcaaagtgggtcccagtcgaggttcagtggcagtggatcgtgggacagatttcactctcaccatcagtaatctgcaacgtgaagtattttagactaacttattactgtacaacaagtaacttacaatttggttttaccggaccgtaaaggggacctaaccggtaacttaaactaaaacgttaaacgaaaccgttggttacgggtacctttacggaccctaaacccgtaattacccgtttacggttacctttacctaacgtttcccctttacccccggtaccctaacgtttcccgttaggttaaaccc

SEQ ID NO: 137542 - DNA, 590 bp, Homo sapiens
  misc_feature: GYAE6OF01CE8CU.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccaggacgccctaagctcctaatctatgctgcatccagtttgacaaggtgggtcccatcgaggttcagtggcaggtggatcgtagggacagtatttcactctacacctatcagtatctgactaacgtagtaagtattttgactaactttattactagtacaaactaagtaattaactaagttggttttaccggaccgtaaagggtacctaacgtaacttaaactaaaacttaacgaaacgttgtacgggtactaggacctaaccgtattacgttcgttacctttacgtaccttcccgttacccccgtaccctaacttccgtacgtaaccg

SEQ ID NO: 137543 - DNA, 567 bp, Homo sapiens
  misc_feature: GYAE6OF01CGN6R.46.67.G01.1.454.CMB.1.raw
  modified_base (333)..(333): a, c, t, g, unknown or other
  misc_feature (333)..(333): n is a, c, g, or t
  modified_base (381)..(381): a, c, t, g, unknown or other
  misc_feature (381)..(381): n is a, c, g, or t
  modified_base (386)..(386): a, c, t, g, unknown or other
  misc_feature (386)..(386): n is a, c, g, or t
  modified_base (443)..(443): a, c, t, g, unknown or other
  misc_feature (443)..(443): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctggggtccggcagcctcccgagggaaggggctggaatacagttggaagtgtctctcatagtggaggttcctattacagtccgtctctcaagngtcgagtcaccatatctcgtggacacgtccagcaatctagttttcccngaagntgagttctgtcgaccgccgctgacgtacgggtcgtttattcgtgtgcgagagacgtntattagtgtagttttggagttggtttactttcgactacccgtagactcgggaccggggtctccggaccccgtggggacctagggactacgtcggtacctaccgtccttccttacgccctacccg

SEQ ID NO: 137544 - DNA, 529 bp, Homo sapiens
  misc_feature: GYAE6OF01APR00.46.67.G01.1.454.CMB.1.raw
  modified_base (192)..(192): a, c, t, g, unknown or other
  misc_feature (192)..(192): n is a, c, g, or t
  modified_base (217)..(217): a, c, t, g, unknown or other
  misc_feature (217)..(217): n is a, c, g, or t
tcagactagcagtacacgaccggtgctcgatttagagtatacatattgggtttggggagtctcggtcaggacacagcatggacatgagggtccccgctcagctcctggggatcctgctactctggctccgaggtgccagatgtgacatcgagctgacccagtctccatcctccctgtctgcaaccgtggganacagtgtcaccatcacttgccgggnaagtcgaacatgacacctattaaatgtatcaacatagaccaggacggccctaagctctaatctatgctgcatccagtttgcaaagtgggtcccagtcgaggttcagtggcagtggatcgtgggacagtatttcactctcaccatcagtaactctgcaacgtgaagtattttgactaacgttattactgtacaactagtaattacaagttgtttacgactaagggactaacgtaacttaacaaattaaacgaatgtgactagactaccgtattctcgttcttactacttccttacccgactacttctgtaacg

SEQ ID NO: 137545 - DNA, 536 bp, Homo sapiens
  misc_feature: GYAE6OF01CLSCC.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacactatttaaatggtatcaacatagacaggacgccctagctcctaatctatgactgcatccagtttgcaaagtgggtacccatcgaggttcagtggcagtgatcgtgggacagatttcactctcacatactagtaatctgacctaagtgaaagtattttagtaaactttattactgttacaaacagtaattactaattggtttacgacaagggtcaacgtaactaacaaagtttaaacaacttgtacggtatcgacacctatcctagttccttacaagttccttcccgactatctgtacttacg

SEQ ID NO: 137546 - DNA, 523 bp, Homo sapiens
  misc_feature: GYAE6OF01B3JG5.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacggccctaagctcctaatctatgctgcatccagtttgcaaagtggggtcccatcgaggttcagtggcagtggatctgggacagatttcactctcaccatcagtaatctgcaacgtgaaagtattttgacaactttattaactgtcaacagaaattacaaattgttttacgcctaaagggactaaccgaacttaacaaattaaacgaactgtagctagcaccgatctgtcttacacttccttcccacctatctgtaac

SEQ ID NO: 137547 - DNA, 508 bp, Homo sapiens
  misc_feature: GYAE6OF01E3GJP.46.67.G01.1.454.CMB.1.raw
  modified_base (504)..(504): a, c, t, g, unknown or other
  misc_feature (504)..(504): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatccgagctgacccagtcgtccatcctccctgtctgcaaccgtgggagacagtgtcaccatcacttgccgggcaagtcggaacattgacacctatttaaattggtatcaacatagaccaggacggccctaagctcctaatctatgctgcatccagtttgcaaagtgggtcccatcgaggttcagtgcagtggatctgggacagatttcactctcaccatcagtaatctgcaacgtgaagtattttgctaacttattactgttcaacagaattacaattgttttcggaccaagggtacacgaactaacaaattaaacgaactgtggctagcactatctgtcttcatcttcccgccatcngtac

SEQ ID NO: 137548 - DNA, 511 bp, Homo sapiens
  misc_feature: GYAE6OF01BZPR8.46.67.G01.1.454.CMB.1.raw
  modified_base (486)..(486): a, c, t, g, unknown or other
  misc_feature (486)..(486): n is a, c, g, or t
  modified_base (504)..(504): a, c, t, g, unknown or other
  misc_feature (504)..(504): n is a, c, g, or t
  modified_base (507)..(507): a, c, t, g, unknown or other
  misc_feature (507)..(507): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccaggacgccctaagctcctaatctatgctgcatccagtttgcaaagtcggggtcccatcgaggttcagtggcagtgatcgtgggacagtatttcactctcacatcagtatctgacaacgtgaagtattttagactaacttattactgtacaatagtaattactaattgtttacgacgtaaggacaacgactaactaaattaacgaactgtagctgacacctatctntcttcactcttcccactntcngtac

SEQ ID NO: 137549 - DNA, 521 bp, Homo sapiens
  misc_feature: GYAE6OF01ERYI8.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggccctaagctcctaatctatgctgcatccagtttgcaaagtgggtcccatcgaggttcagtggcagtggatctgggacagatttcactctcacatcagtaatctgacaacgtgaagtatttgctaacttattactgtacaacagtaattactaattacgttttcgaccgtaagggactaacgaactaacaaattaaacgaactgtagtctagactaccatctgtcttcacttccttcccactactctgtaac

SEQ ID NO: 137550 - DNA, 554 bp, Homo sapiens
  misc_feature: GYAE6OF01C57FI.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggaaggggctggaatacattggaagtgtctctcatagtggaggttcctattacagtccgtctctcaagagtcgagtcaccatatctctggacacgtcagcaatcagttttccctgaagatgagttctgtgaccgccgctgacacgggtcgttttattacgtgtgcgagagacggctattatgtatttttggagttggtttattcgactaccctagatcggacggggctcgacccgtggggccagggtatactggtcaccgtctccttacgcctccaccgaacggcccacgtccggtccttcccccgcgtcccacccctcccacccagcgtacccg

SEQ ID NO: 137551 - DNA, 559 bp, Homo sapiens
  misc_feature: GYAE6OF01DC9ZQ.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggaccgccctaagctctaatctatgctgcatcctagtttgactaaaggtcgggtcccagtcgtaggttcagtggcgagtggatcgtgggactagtatttcactctcaccatcaagtatctgctaacgtgtaagtattttgacttaattattattagtacaactagtaaattataagttcgtttacggaaccgtaagggaacctaacgtaacttaactaaattaacgaacgttagtggactagacctacctattcttgttaccttctacttcccttacccgacctacttcctgtac

SEQ ID NO: 137552 - DNA, 552 bp, Homo sapiens
  misc_feature: GYAE6OF01BP42X.46.67.G01.1.454.CMB.1.raw
  modified_base (328)..(328): a, c, t, g, unknown or other
  misc_feature (328)..(328): n is a, c, g, or t
  modified_base (375)..(375): a, c, t, g, unknown or other
  misc_feature (375)..(375): n is a, c, g, or t
  modified_base (380)..(380): a, c, t, g, unknown or other
  misc_feature (380)..(380): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggaaggggctggaatacattggaagtgtctctcatagtggaggttcctattacagtccgtctctcaagngtcgagtcaccatatctctggacacgtccagcaatctagttttcccngaagntgagttctgtcgaccgccgctgacgacgggtctttattactgtgcgagagacggcttattagtgttagttttggagttggtttatttcgactacctagtcgtcggacggggtcctccggccccgtggggacccagggaactcgtcggtccacgtcctccttcgccctacccg

SEQ ID NO: 137553 - DNA, 528 bp, Homo sapiens
  misc_feature: GYAE6OF01EF5PI.46.67.G01.1.454.CMB.1.raw
  modified_base (523)..(523): a, c, t, g, unknown or other
  misc_feature (523)..(523): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacactattaaatgtatcaacatagaccagggacggccctaagctcctaatctatgctgcatccagtttgcaaagtgggtcccatcgagtcagtggcagtggatcgtgggacagtattcactctcaccatcagtaatctgacaacgtgaagtatttagactaacttattactgtacaactagtaatttacaattcgttttacgaccgtaagggactacgaactaactaaattaaacgaactggtacgtctagactaccattctgttaccttcacttcctacccgactacttcngtaac

SEQ ID NO: 137554 - DNA, 561 bp, Homo sapiens
  misc_feature: GYAE6OF01ESJ85.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagacccctgtccctcacctgcgctgtctctggtgcctccatcagtagtggtttcttctggggctgggtccggcagctcccaggggaaggggctggaatacattggaagtgtctctcatagtggaggttcctattacagtccgtctctcaagagtcgagtcaccatatctctggacacgtccagcaatcagttttccctgaacgatgagttctgtgaccgccgctgacacgggtcgtttattactgtgcgagagacggctattatgtattttggagttggttatttcgactaccctagatcgacggggctcgacccgtggggccagggaatacgtgtcaccgtctccttacgcctccaccgaacgggtcccagtccggtccttccccccgtcggtcccaccccgtccctacccaagcgtacccg

SEQ ID NO: 137555 - DNA, 533 bp, Homo sapiens
  misc_feature: GYAE6OF01CQO4I.46.67.G01.1.454.CMB.1.raw
  modified_base (250)..(250): a, c, t, g, unknown or other
  misc_feature (250)..(250): n is a, c, g, or t
  modified_base (327)..(327): a, c, t, g, unknown or other
  misc_feature (327)..(327): n is a, c, g, or t
  modified_base (519)..(519): a, c, t, g, unknown or other
  misc_feature (519)..(519): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctcgtggggctgggtccggnagctccgagggaagggctggaatacgattggaagtgtctctcatagtggagttcctattacagtccgtctctcaagngtcgagtcaccatatctctggacacgtcagcaatctagtttccagaagatgagttctgtcgaccgcgctgacgacgggtcgtttatacgtgtgcgagagacgtctatagtgtagttttggagttgttattcgactacctagatcggacggggctccggacccgtgggccgagggactacgtcggtcaccgtntccttgcctacccg

SEQ ID NO: 137556 - DNA, 534 bp, Homo sapiens
  misc_feature: GYAE6OF01CHYKS.46.67.G01.1.454.CMB.1.raw
  modified_base (373)..(373): a, c, t, g, unknown or other
  misc_feature (373)..(373): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggcctttcggagaccctgtccctcacctgcgctgtctctggtgcctccatcagtagtggtttctctggggctgggtccggcagctccagggaaggggctggaatacattggaagtgtctctcatagtggaggttcctattacagtccgtctctcaagagtcgagtcaccatatctctggacacgtccagcaatcagttttcccngaagatgagttctgtgaccgcgctgacacgggtcgtttattactgtgcgagagacggctattatgtatttttggagttggtttatttcgactacctagatcgacggggctcggacccgtggggccagggaatacgtcggtcaccgtctccttgcctacccg

SEQ ID NO: 137557 - DNA, 652 bp, Homo sapiens
  misc_feature: GYAE6OF01BVQBC.46.67.G01.1.454.CMB.1.raw
  modified_base (212)..(212): a, c, t, g, unknown or other
  misc_feature (212)..(212): n is a, c, g, or t
  modified_base (248)..(248): a, c, t, g, unknown or other
  misc_feature (248)..(248): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtcncctcatcagtagtggtttctctggggctgggtccgnagcctccgagggaagggctggaatacattggaagtgtctctcatagtggaggttctattacagtccgtctctcagagtcgagtcaaccatatctctggacacgtccagctaatctaacgttttcccagtaagtattcgtaagtttccgtagtcggaacccggcccgtacgtgaaccgtacggggttacgttttaacgttaccgtggtacgcggtagtacggtacggtacttaagtttagttagttagttttttggagtttaggtttagtttaccgaacctacccgttaagtacgtccgggacgggggtcctacccgggtaccccggtagggggacccgtaggggtaacttaccggttacggtaccgtacccggttccttaccccgtttacgcccctaaccccgg

SEQ ID NO: 137558 - DNA, 510 bp, Homo sapiens
  misc_feature: GYAE6OF01DTK7T.46.67.G01.1.454.CMB.1.raw
  modified_base (353)..(353): a, c, t, g, unknown or other
  misc_feature (353)..(353): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcgaacattgacacctattaaatgtatcaacatagaccaggacgccctaagctcctaatctatgctgcatccagtttgcaaagtgggtcccatcgagttcagtggcagtggatctgggacagatttcactctnaccatcaagtaatctgcaacgtgaaatattttgactaacttattactgtcaaactagaaattacaatgttttcgacctaaggactacgaactaactaaattaaacgaactgtaggctagacaccatctgtcttacattacttcccgacatctgtaac

SEQ ID NO: 137559 - DNA, 565 bp, Homo sapiens
  misc_feature: GYAE6OF01A8GZ3.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctgggctgggtccggcagctcccaggggaagggctggaatacattggaagtgtctctcatagtggaggttcctattacagtccgtctctcaagagtcgagtcaccatatctctggacacgtccagcaatctagttttcccagaacgatgtagttctgtcgaccgccgctgacacgggtcgtttatactgtgcgagagacggtctattatgtagttttggagttggttatttcgacgtacctagacgtcggacggggctcggacccgtggggccagggtaactacgtggtacaccgtctcctacgcctccgaccgacggcccagtcccggtcccttccccgtcggccctaccctaccctccaacgcgtacccg

SEQ ID NO: 137560 - DNA, 532 bp, Homo sapiens
  misc_feature: GYAE6OF01EGRWR.46.67.G01.1.454.CMB.1.raw
  modified_base (250)..(250): a, c, t, g, unknown or other
  misc_feature (250)..(250): n is a, c, g, or t
  modified_base (327)..(327): a, c, t, g, unknown or other
  misc_feature (327)..(327): n is a, c, g, or t
  modified_base (374)..(374): a, c, t, g, unknown or other
  misc_feature (374)..(374): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtcccctcacctgcgctgtctctggtgcctccatcagtagtggtttctcgtggggctgggtccgnagctcccgagggagggctggaatacattggaagtgtctctcatagtggaggttcctattacagtccgtctctcaagngtcgagtcaccatatctctggacacgtccagcaatctagttttcccngaagtatgagttctgtcgaccgccgcgtgacacgggtcgtttattactgtgcgagagacggctattatgttattttggagttggttatttcgactacctagatcggcgggctcgccccgtgggccagggaactcgtgtcacgtctccgtgcctacccg

SEQ ID NO: 137561 - DNA, 507 bp, Homo sapiens
  misc_feature: GYAE6OF01CWP2H.46.67.G01.1.454.CMB.1.raw
  modified_base (192)..(192): a, c, t, g, unknown or other
  misc_feature (192)..(192): n is a, c, g, or t
  modified_base (254)..(254): a, c, t, g, unknown or other
  misc_feature (254)..(254): n is a, c, g, or t
  modified_base (486)..(486): a, c, t, g, unknown or other
  misc_feature (486)..(486): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccgggcaagtcggaacattgacacctatttaaatggtatcaanatagaccagggacggccctaagctacctaatctatgctgcatccagtttgacaaagtggggtcccagtcgaggttcagtggcagtggatcgtgggacagtatttcactctcacatcagtaatctgctaacgtgaagtatttagactaacttattactgtacaacagtaattacaattgtttacgacaaggacacgactaacaaataacgaactgtgctgacacatctctctntactccttccgctatctgtac

SEQ ID NO: 137562 - DNA, 565 bp, Homo sapiens
  misc_feature: GYAE6OF01DX3GW.46.67.G01.1.454.CMB.1.raw
  modified_base (333)..(333): a, c, t, g, unknown or other
  misc_feature (333)..(333): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccgcagctcccagggaagggctggaatacattggaagtgtctctcatagtggaggttcctattacagtccgtctctcaagagtcgagtcaccatatctctggacacgtccagcaatctagttttcccngaagattgagtttctgtcgaccgccgctgacacgggtctttatactgtgcgagagacggctattatgtattttggagttggttatttcgactacccgtagacgtcggacggggtctccggaccccgtggggaccgagggtactacgtggtccaccgtctccgttagccctaccaccgacggtcccagtccggtcccttcccccgtgtcccacccctccacccaagcgacccg

SEQ ID NO: 137563 - DNA, 534 bp, Homo sapiens
  misc_feature: GYAE6OF01DS2ZH.46.67.G01.1.454.CMB.1.raw
  modified_base (217)..(217): a, c, t, g, unknown or other
  misc_feature (217)..(217): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggnaagtcggaacattgacactatttaaatgtatcaacatagaccaggaccgccctaagctcctaatctatgctgcatccagtttgacaaagtgggtcccatcgaggttcagtggcagtgatcgtgggacagtatttcactctacacatcaagtaatctagacaacgtgtaagtatttcgactaactttatactagtacaactaagtaattactaattgtttacggaccgtaaggactaacgtaactaacgtaaattaacgaacgtgtagactagacacctatactgttcttactacttacttccccgactactctgtac

SEQ ID NO: 137564 - DNA, 565 bp, Homo sapiens
  misc_feature: GYAE6OF01AFYAZ.46.67.G01.1.454.CMB.1.raw
  modified_base (289)..(289): a, c, t, g, unknown or other
  misc_feature (289)..(289): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccaggggaaggggctggaatacattggaagtgtctctcatagtggaggttcctattacagtccgtctctcaagngtcgagtcaccatatctctggacacgtccagcaatcagttttccctgaagatgagttctgtcgaccgccgctgacacgggtcgttttattactgtgcgagagacggtctattatgtattttggagttggttatttcgactacccgtagacgtcggacggggtcctccggtaccccgtggggccaggggaactacgtggtcaccgtctcctacgcctccaccgacggccctacgtccggtcccttcccctcggcccaccctccctccgaagcgtccg

SEQ ID NO: 137565 - DNA, 548 bp, Homo sapiens
  misc_feature: GYAE6OF01A1NGQ.46.67.G01.1.454.CMB.1.raw
  modified_base (289)..(289): a, c, t, g, unknown or other
  misc_feature (289)..(289): n is a, c, g, or t
  modified_base (335)..(335): a, c, t, g, unknown or other
  misc_feature (335)..(335): n is a, c, g, or t
  modified_base (340)..(340): a, c, t, g, unknown or other
  misc_feature (340)..(340): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccaggggaaggggctggaatacattggaagtgtctctcatagtggaggttcctattacagtccgtctctcaagngtcgagtcaccatatctctggacacgtccagcaatcagttttcccngaagntgagttctgtgaccgcgctgacacgggtcgtttattactgtgcgagagacggctattatgtattttggagttggttatttcgactaccgtagactcggacggggctcggacccgtggggccagggaatacgtggtcaccgtctccttagcctaccaccgacggcccagtccgtccttcccccgtggcccaccctcctccaagcgaccg

SEQ ID NO: 137566 - DNA, 605 bp, Homo sapiens
  misc_feature: GYAE6OF01E1XAY.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccgagggagggctggaatacattggaagtgtctctcatagtggaggttcctattacagtccgtctctcaagagtcgagtcaccatactctctggacacgtccagcaatctagttttccctagaagatgagttctgtcgacccgccgctggacacgggtctttatactggtgcgagagacggctattagtgtagttttggagttggttactttcgacctacccgtagagtcggacggggtcctcggaccccgtggggccgaggggaacttacgtcggtacctaccggtccttccgttacgtccctacccgacccgtaacgggtccccgaacgttcccggttacccgttcccccgtcggtccctacccctaccctacccgaacgcgtacccg

SEQ ID NO: 137567 - DNA, 619 bp, Homo sapiens
  misc_feature: GYAE6OF01ERSNP.46.67.G01.1.454.CMB.1.raw
  modified_base (331)..(331): a, c, t, g, unknown or other
  misc_feature (331)..(331): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccgcagctcccgagggagggctggaatacagttggaagtgtctctcatagtggaggttcctattacagtccgtctctcaagagtcgagtcacatatctctgacacgtccagcaatcagttttcccngaagatgagttctgtcgaccgcgctgacacgggtcgtttatactgtgcgagagacgctattatgtagttttggagttggttatttcgacctacccgtagacgtcggacggggtcctccggaccccgtcggggcccgtaaggggtaactacgtcggtaccgacccgttccgttccgttacgtcccctacccgaacccgtaaccgggtacccctacgttcccgggttaccccgtttccccccgtcgggtacccctacccccgttaccctacccaaacggtccgtaccccg

SEQ ID NO: 137568 - DNA, 497 bp, Homo sapiens
  misc_feature: GYAE6OF01E1S6R.46.67.G01.1.454.CMB.1.raw
  modified_base (195)..(195): a, c, t, g, unknown or other
  misc_feature (195)..(195): n is a, c, g, or t
  modified_base (368)..(368): a, c, t, g, unknown or other
  misc_feature (368)..(368): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacngtgtcaccatcacttgccgggcaagtcggaacattgacacctattaaattggtatcaacatagaccagggacggccctaagctcctaatctatgctgcatccagtttgcaaagtgggtcccatcgaggttcagtgcagtgatctgggacagatttcactctcacatcagtaanctgcaacgtgaagtattttgctaacttattactgtcaacagaattacaatgtttcgaccaaggacacgactacaaattaaacgaactgtgctgcaccatctgtcttcactcttcccgactactctgtac

SEQ ID NO: 137569 - DNA, 585 bp, Homo sapiens
  misc_feature: GYAE6OF01DNB6X.46.67.G01.1.454.CMB.1.raw
  modified_base (231)..(231): a, c, t, g, unknown or other
  misc_feature (231)..(231): n is a, c, g, or t
tcagactagcagtacacgaccggtgctcgatttagagtatacatattgggttggggagtctcggtcaggacacagcatggacatgagggtccccgctcagctcctggggctcctgctactctggctccgtaggtgccagattgtgacatcgagctgacccagtctccatcctcctgtctgcaaccggtggggagacagtcgtcaccagtcacttgccggcaagtcggaacnttgacacctatttaagtggtatcaacatagaccaggacgccctaagctacctaatctatagctgcagtcctaggtttgacgtaaaggtcgggtaccctagtcgaaggttcaggtggcaggtggatcgtgggactagtatttcactctcgacctatacagtaactctacgacaacgtagaagtatttgactaacttatactgtacaatagtaattaactagttcgtttacggacaacggactaacgaacttaactaaattaacgaacttagtaggtacgtacggacgaaccgtagttcttacggttacctttcctaaccgtttcgttaccccgacttaccgtccgttggtaaccg

SEQ ID NO: 137570 - DNA, 495 bp, Homo sapiens
  misc_feature: GYAE6OF01EOJ79.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggccctaagctcctaatctatgctgcatccagtttgcaaagtgggtcccatcgaggttcagtggcagtggatctgggacagatttcactctcaccatcagtaatctgcaacgtgaagattttgctaacttattactgtcaacagaattacaatgtttcgccaagggacacgactacaaattaacgaactgtgctgcacatctgtcttcatcttcccgccatctgtac

SEQ ID NO: 137571 - DNA, 506 bp, Homo sapiens
  misc_feature: GYAE6OF01CJAMD.46.67.G01.1.454.CMB.1.raw
  modified_base (483)..(483): a, c, t, g, unknown or other
  misc_feature (483)..(483): n is a, c, g, or t
  modified_base (488)..(488): a, c, t, g, unknown or other
  misc_feature (488)..(488): n is a, c, g, or t
  modified_base (499)..(499): a, c, t, g, unknown or other
  misc_feature (499)..(499): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggccctaagctcctaatctatgctgcatccagtttgcaaagtggggtcccatcgaggttcagtggcagtggatcgtgggacagatttcactcctcaccatcagtaatctgcaacgtgaagtattttgactaacttattactgtcaacagtaattacaattgttttacgacgtaaggacacgaactaacaaattaacgaactgtgctgcacatctntcttnactcttccgcntctgtac

SEQ ID NO: 137572 - DNA, 510 bp, Homo sapiens
  misc_feature: GYAE6OF01ELAUQ.46.67.G01.1.454.CMB.1.raw
  modified_base (490)..(490): a, c, t, g, unknown or other
  misc_feature (490)..(490): n is a, c, g, or t
  modified_base (500)..(500): a, c, t, g, unknown or other
  misc_feature (500)..(500): n is a, c, g, or t
  modified_base (503)..(503): a, c, t, g, unknown or other
  misc_feature (503)..(503): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctattaaattgtatcaacatagaccagggacggccctaagctcctaatctatgctgcatccagtttgcaaagtgggtcccatcgagttcagtggcagtggatcgtgggacagatttcactctcaccatcagtaatctgacaacgtgaagtattttgactaatttattactgtacaacagtaattacaattgttttcggacctaaggactacgaactaacaaattaacgaattgtgactgacacctatctgtcttnacttctcccnctntctgtac

SEQ ID NO: 137573 - DNA, 562 bp, Homo sapiens
  misc_feature: GYAE6OF01BGXRZ.46.67.G01.1.454.CMB.1.raw
tcagactagcagtacacgaccggtgctcgatttagagtatacatattgggtttggggagtctcggtcaggacacagcatggacatgaggatccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctattaaatggtatcaacatagaccagggacggcccctaagctcctaatctatgctgcatcctagtttgactaaaggtcggggtacccagtcgaggttcagtggcagtggatcgtgggactagtatttcactctcaccatcagtatctgcaacgtgaagtatttagactaacttacttactagtacaacaagtaacttaataattcggtttacggacctaaagggtactaacttaactaactaaacgttaaacgtaactaggtagtacgtacgtacctacctacttcgttcgttacttactacttcccttacccgcctattcgtacg

SEQ ID NO: 137574 - DNA, 605 bp, Homo sapiens
  misc_feature: GYAE6OF01AFLFM.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtgggagacagtgtcaccatcacttggccgggcaagtcggaacattgacacttatttaaattggtatcaacatagaccagggacggccctaagctacctaatctatgctgcatcctagtttgactaaggtcgggtcccagtcgaggttcagtggcaggtgatcgtgggactagtatttcactctcacatcaagtactcgtagtacgtaacgtgtaagttatttacgacttaactttattacgtagtacaactaagtaatttaacgtaatttcggtttacggaaccgtaacggggtaactaacgtaaacctaaacgtaaaacgttaaacgtaaacgttggtaggtacgtacgaccgtaacctagttacctcgttaccttactaaccttcccgttacccgaaccttacgttccgtgtaacc

SEQ ID NO: 137575 - DNA, 500 bp, Homo sapiens
  misc_feature: GYAE6OF01ECCX4.46.67.G01.1.454.CMB.1.raw
  modified_base (490)..(490): a, c, t, g, unknown or other
  misc_feature (490)..(490): n is a, c, g, or t
  modified_base (495)..(495): a, c, t, g, unknown or other
  misc_feature (495)..(495): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacggccctaagctcctaatctatgctgcatccagtttgcaaagtgggtcccatcgaggttcagtggcagtggatcgtgggacagatttcactctcaccatcagtaatctgacaacgtgaagtattttgactaacttattactgtacaacagaattacaatgtttcgacaaggacacgactaacaaattaacgaactgtgctgcacatctgtctcactcttacccnctatntgtac

SEQ ID NO: 137576 - DNA, 560 bp, Homo sapiens
  misc_feature: GYAE6OF01DHVKO.46.67.G01.1.454.CMB.1.raw
  modified_base (332)..(332): a, c, t, g, unknown or other
  misc_feature (332)..(332): n is a, c, g, or t
  modified_base (345)..(345): a, c, t, g, unknown or other
  misc_feature (345)..(345): n is a, c, g, or t
  modified_base (524)..(524): a, c, t, g, unknown or other
  misc_feature (524)..(524): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctccggtgcctccatcagtagtggtttcttctggggctgggtccggcagctcccgagggaaggggctggaatacattggaagtgtctctcatagtggaggttcctattacagtccgtctctcaagagtcgagtcacatatctctggacacgtcagcaatcagtttcccngaagatgagttcngtgaccgcgctgacacgggctttatactgtgcgagagacggctattatgtattttggagttggtttatttcgactaccctagagtcggacggggctccgacccgtggggccagggatacgtggtcaccgtctccttacgcctccaccaacggggccctagtccggttcccttcccccgnggtccctacccctcctacccaacgcgccgtacccgg

SEQ ID NO: 137577 - DNA, 712 bp, Homo sapiens
  misc_feature: GYAE6OF01C22CY.46.67.G01.1.454.CMB.1.raw
  modified_base (229)..(229): a, c, t, g, unknown or other
  misc_feature (229)..(229): n is a, c, g, or t
  modified_base (240)..(240): a, c, t, g, unknown or other
  misc_feature (240)..(240): n is a, c, g, or t
tcagactagcagtacacgaccggtgctcgatttagagtatacatagttgggtttgggggagtctcggtcaggacacgagcatggacgatgagggtccccggcctcagctcctggggctcctgctactctggctccggaggtcgccagatgtgacatcgagctgacccagtctccatccctcctgtctgcaaccggtgggagacagtgtccaccatccacttggccgggnaagtcgaactnttgacacttatttaatggtatcaacagtagaccgacgggaccgccctaagctctaatctatgctgcatcctacgttcgacgtaaggtcgggtcccagtcggtaggttcgaggtggcgtaggtcgatcgtacgggactagtactttccaccgttctaccgacctatacgtaagttaactcgtacgtaacctaacggttacgtaaagttacttttacggaaccttaacgtttaacttaccgttacgtaaccgtaaaccgtaacggtttaaactttaaccgttaacgttttccgggttttaaccgggaacccgtaaaggggtaaccctaaaccggtaaaccttaaaaccgtaaaaacgtttaaacccggtaacggttacggttacggaccgttacgaaccctaaccgttatttccgttacgttacctttaccgtaccttccccgttaccccgaccttacgttccgtacgtaaccg

SEQ ID NO: 137578 - DNA, 507 bp, Homo sapiens
  misc_feature: GYAE6OF01C2F1N.46.67.G01.1.454.CMB.1.raw
  modified_base (476)..(476): a, c, t, g, unknown or other
  misc_feature (476)..(476): n is a, c, g, or t
  modified_base (487)..(487): a, c, t, g, unknown or other
  misc_feature (487)..(487): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggatacagtgtcaccatcacttgccgggcaagtcggaacattgacacctatttaaatggtatcaacatagaccagggacgccctaagctcctaatctatgctgcatccagtttgcaaagtgggtcccatcgaggttcagtgcagtgatctgggacagatttcactctcaccatcagtaatctgcaacgtgaagtattttgctaacttattactagtacaactagtaattactaattgttttacggaccgtaagggctaacgactacaaattaacgaactgtgactgcnccatctgtctnatcttacccgctatctgtac

SEQ ID NO: 137579 - DNA, 555 bp, Homo sapiens
  misc_feature: GYAE6OF01BMOEB.46.67.G01.1.454.CMB.1.raw
  modified_base (384)..(384): a, c, t, g, unknown or other
  misc_feature (384)..(384): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacactatttaaatgtatcaacatagaccaggacgaccctaagctctaatctatgctgcatcctagtttgacaaagtcgggtcccagtcgagttcagtggcagtgatcgtgggacagtacttcactctcaccatcagtaatctgactaacgtanaagtatttgactaacttattactagtactaaactagtaatttaacaagtttcgttttacggaccgtaaagggacctaacgtaactaaactaaaacgttaaaccgaacttggtacgactagactaacctatctagttacttaacttacccgttaccacctatctgtataccg

SEQ ID NO: 137580 - DNA, 542 bp, Homo sapiens
  misc_feature: GYAE6OF01C3U4V.46.67.G01.1.454.CMB.1.raw
  modified_base (210)..(210): a, c, t, g, unknown or other
  misc_feature (210)..(210): n is a, c, g, or t
  modified_base (254)..(254): a, c, t, g, unknown or other
  misc_feature (254)..(254): n is a, c, g, or t
  modified_base (495)..(495): a, c, t, g, unknown or other
  misc_feature (495)..(495): n is a, c, g, or t
  modified_base (534)..(534): a, c, t, g, unknown or other
  misc_feature (534)..(534): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccgnagctcccgaggggaagggctggaatacagttggaagtgtctctnagtagtggaggttcctattacagtccgtctctcaagagtcgagtcaccatatctctgacacgtccagcaatcagttttcccagaagatgagttctgtcgaccgcgctgacgtacgggtcgtttaatacctgtgtacgagagacggcttagttatgtattttggagttggttattcgactaccctagacgtcggacggggctcggacccgtggggcccagggaatacgtgtcaccgtctctnccctcacgacggccatccggccttcccgcgccacctccncagctccg

SEQ ID NO: 137581 - DNA, 694 bp, Homo sapiens
  misc_feature: GYAE6OF01A1FEG.46.67.G01.1.454.CMB.1.raw
  modified_base (178)..(178): a, c, t, g, unknown or other
  misc_feature (178)..(178): n is a, c, g, or t
  modified_base (216)..(216): a, c, t, g, unknown or other
  misc_feature (216)..(216): n is a, c, g, or t
  modified_base (270)..(270): a, c, t, g, unknown or other
  misc_feature (270)..(270): n is a, c, g, or t
tcagactagcagtacacgaccggtgctcgatttagagtatacatattggtttgtcctcctgctggtggcagctcccagatgggtcctgtccctggtgcaactgcaggagtcgggcccacgactgggtgagggcccttcgggagacccctggtcccctcacctgccgctgtctctggtncctcatcagtagtggtttctcgtgggcttgggtccgancgtcctccgaggggaacgggctagggaatacgtagttgggaagttgtcttcgtnagttagtggacggtttcctagttaccaggttcccgtctctaccgaaggagttccgagtaccacctatactctcgtggaccacggtccagactaatcttagttttcccagaacgtatgtagttctgtcgacccgtctacgtgaccgtacgggtcttttaagtactggtcgcgagacgtacgtctattatgtagtttggtaggttagtttacttacgtacctaccgttagtaccgtcggtacggggcctaccggcccggttacgggccgaaggggtaaccttcggtacggtccgtaccgtccgttaccgtacctcccgttaccaacccggtaaccgggtccctaccgggttaccccgttcccggtttaaccccccgcgggtacccctacccccgttaccgacccgttaaaccggcccgtaaccccg

SEQ ID NO: 137582 - DNA, 546 bp, Homo sapiens
  misc_feature: GYAE6OF01DRIBB.46.67.G01.1.454.CMB.1.raw
  modified_base (362)..(362): a, c, t, g, unknown or other
  misc_feature (362)..(362): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaaccgtgggagacagtgtcaccatcacttgtcgggcaagtcggaacattgactacttatttaaatgtatacaacatagaccgagggaccggccctaagctactaatctatgctgcatccagtttgacaaggtcgggtccagtcgagttcagtggcagtgatcgtgggacagtatttcactcncacatcaagtatctagactaagtagaatatttagactaactttattactagtacaactagtaattactagtacgtttacgactaagggactaacgtaactaataaacgtaacgaacttaggtacgctagccgtaactattacttgtaccttactacgttccttacccgactactcgtagtaacg

SEQ ID NO: 137583 - DNA, 531 bp, Homo sapiens
  misc_feature: GYAE6OF01B1RTZ.46.67.G01.1.454.CMB.1.raw
  modified_base (192)..(192): a, c, t, g, unknown or other
  misc_feature (192)..(192): n is a, c, g, or t
  modified_base (368)..(368): a, c, t, g, unknown or other
  misc_feature (368)..(368): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttggccgggacaagtcggaacattgacacttattaaatgtatcaacatagacagggacgccctaagctcctaatctatgctgcatcctagtttgactaaaaggtcgggtacccagtcgaggtttcagttggcagtgatcgtgggacaggtatttcactcncacatcaattatctagacaacgtgtaagttatttagacttaattattactgtacaatataattactaatttcgtttacgaccgtaaggactacgaactaactaaattaacgaacgtgtacgctagacactatctgttctatacttcctcccgctatctgtaac

SEQ ID NO: 137584 - DNA, 534 bp, Homo sapiens
  misc_feature: GYAE6OF01B66IV.46.67.G01.1.454.CMB.1.raw
  modified_base (372)..(372): a, c, t, g, unknown or other
  misc_feature (372)..(372): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctcatcagtagtggtttctctggggctgggtccggcagctccgagggaaggggctggaatacattggaagtgtctctcatagtggaggttcctattacagtccgtctctcaagagtcgagtcaccatatctctggacacgtccagcaatcagttttcccngaagatgagttctgtgaccgcgctgactacgggtcgtttatacgtgtgcgagagacggtctattatgtagtttttggagttggttatttcgactacccgtagactcggacggggctcgcccgtggggccagggactacgtgtcaccgtctcctgcctacccg

SEQ ID NO: 137585 - DNA, 581 bp, Homo sapiens
  misc_feature: GYAE6OF01E1CC8.46.67.G01.1.454.CMB.1.raw
  modified_base (336)..(336): a, c, t, g, unknown or other
  misc_feature (336)..(336): n is a, c, g, or t
  modified_base (548)..(548): a, c, t, g, unknown or other
  misc_feature (548)..(548): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccgagggaaggggctggaatacattgggaagtgtctctcatagtggaggttcctattacagtccgtctctcaagagtcgagtcaccatatctctggacacgtccagcaatcagttttcccngaacgatgagttctgtcgaccgccgctgacacgggtcttttagtactgtgcgagagacggctattatgttattttggagttgttagtttcgaactaccctagatcggacggggtctccggacccgtggggccaggggtaactacgtggtccaccgttctccgttacgccctaccaccgaacgggcccacgttcccggtccctttccccccgnggtccctacccctccctacccgaagcgtacccg

SEQ ID NO: 137586 - DNA, 565 bp, Homo sapiens
  misc_feature: GYAE6OF01CSSE8.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagttagttggtttcttcgtggggctggggtccggcagcctccgaggggaaggggctggaatacagttggaagtgtctctcatagtggaggttcctattacagtccgtctctcaagagtcgagtcaccatatctctggacacgtcagcaatcacgttttcccagaagtatgtagttctgtgaccgccgcgtcgacgtacgggtctttattacgtgtgcgagagacggcttattagtgtatttttggagttggttatttcgactaccgtagacgtcggaccggggtctccggacccgtggggccgtagggtactacgtggttccaccgtcttccgttcgccctacccg

SEQ ID NO: 137587 - DNA, 567 bp, Homo sapiens
  misc_feature: GYAE6OF01DBXZK.46.67.G01.1.454.CMB.1.raw
  modified_base (219)..(219): a, c, t, g, unknown or other
  misc_feature (219)..(219): n is a, c, g, or t
  modified_base (507)..(507): a, c, t, g, unknown or other
  misc_feature (507)..(507): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtcctccatccctccctgtctgcaaccgtgggagacagtgtcaccatcacttgccgggnaagtcggaacattgacacctatttaaatgtatcaacatagaccagggacgccctaagctcctaatctatgctgcatccagtttgactaaaggtcgggtcccagtcgaggttcagttggcaggtggatcgtgggacagtatttcactctacacatcagtatctagactaacgtgaagttattttagtaactttatactgtacaacataattacaagttcgtttacggaccaagggtacaacgtaactaaacaaagtttaaacgaacgtggtacgctacgactaaccgtnttacttagttcccttacgtactttcccgttaccccgtctaattccttaagtctttaaccg

SEQ ID NO: 137588 - DNA, 552 bp, Homo sapiens
  misc_feature: GYAE6OF01BLGUG.46.67.G01.1.454.CMB.1.raw
  modified_base (227)..(227): a, c, t, g, unknown or other
  misc_feature (227)..(227): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaacgtgggagacagtgtcaccatcacttgccgggcaagtcggaacnttgactactatttaaatgtatcaacatagaccaggacgccctaagctcctaatctatgctgcatcagtttgcaaagtcgggtcccagtcgtaggttcagtggcagtggatcgtgggacagtatttcgactcgtcaccatcagtaatctgactaacgtgtaaacgtatttagactaactttattactcgtacaaactagtaattaactaagttcgtttaccggaccgtaacgggaactaaccgtaacttaaacaaattaaacgaactaggtagacgtacgacgtacctatactcgttcttactctccttcccgactactctgtaac

SEQ ID NO: 137589 - DNA, 568 bp, Homo sapiens
  misc_feature: GYAE6OF01CU30I.46.67.G01.1.454.CMB.1.raw
  modified_base (171)..(171): a, c, t, g, unknown or other
  misc_feature (171)..(171): n is a, c, g, or t
  modified_base (290)..(290): a, c, t, g, unknown or other
  misc_feature (290)..(290): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtncctccatcagtagttggtttcttcgtggggctgggtccgcagctccgaggggaagggctggaatacattggaagttgtctctcatagtggaggttcctattacagtccgtctctcaagngtcgagtcaccatatctctgacacgtcagcaatcagttttccagaagatgagttctgtcgaccgccgtctagacgtacgggtcttttaagtactgtgcgagagacgctattagtgtattttggtagttgttatttcgactacctagagtcggacggggctccgacccgtgggccgaggtagtacgtggtctacgtcctcttacgcctccaacccgtacggaccctacgtccggttcccttcccccgtcggtcccctaccctccctaccagcgtacccg

SEQ ID NO: 137590 - DNA, 516 bp, Homo sapiens
  misc_feature: GYAE6OF01B9QF9.46.67.G01.1.454.CMB.1.raw
  modified_base (413)..(413): a, c, t, g, unknown or other
  misc_feature (413)..(413): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatgtatcaacatagaccagggacggccctaagctcctaatctatgctgcatccagtttgcaaaggtcggggtcccagtcgaggttcagtggcagtggatcgtgggacagatttcactctcacatcagtaatctgactaacgtgaagtattttcgactaactttattactntacaacagtaattacaattgtttcgaccaagggactacgaactaactaaattaacgaactgtagctagcactatctgtctcacttcctaccgactatctgtac

SEQ ID NO: 137591 - DNA, 538 bp, Homo sapiens
  misc_feature: GYAE6OF01DHIOD.46.67.G01.1.454.CMB.1.raw
  modified_base (217)..(217): a, c, t, g, unknown or other
  misc_feature (217)..(217): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggnaagtcgacattgacacctatttaatgtatcaacatagaccagggacgccctaagctcctaatctatgctgcatccagtttgcaaagtgggtccagtcgagttcagtgcagtgatcgtggacagatttcactctcacatcagtatctgacaacgtagtaagtatttacgactaacttattactagtacaactaagtaattactaattcggttttacgaccgtaaagggaccaacgtaactaactaaacgttaacgtaacgtagtaggactcgactacctatcttcgttacttctacttccttacccgacctacttctgtaac

SEQ ID NO: 137592 - DNA, 556 bp, Homo sapiens
  misc_feature: GYAE6OF01ECNMU.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcgaacattgacactatttaaatgtatcaacatagaccagggacgccctaagctcctaatctatgctgcatccagtttgcaaagtgggtcccagtcgaggttcagtggcagtggatcgtgggacagtattcactctcaccatcaagtaatctgactaacgtgtaagtattttagactaactttattactagtactaaacaagtaatttactaattacgtttacggaccgaaagggactaacgaacttaaacaaacgtttaaacgaacttaggtcgtacctagaccgtaacctattacttcgttacttcacttccttacccgacctatccgtgtaac

SEQ ID NO: 137593 - DNA, 587 bp, Homo sapiens
  misc_feature: GYAE6OF01DJWA3.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtgggagacagtgtcaccatcacttgccgggcaagtcggaacattgacacctatttaaattgtatcaacatagaccagggacgccctaagctctaatctatgctgcatccagtttgactaaaggtcggggtcccagtcgaggttcagtggcagtggatcgtgggacagtatttcacttctacacatcagtaatctgacaacgtgaagttattttgacttaactttattactacgtacaactaagtaaacttaactaagtttcggttttacggaccgtaaagggacctaacggtaacttaaactaaaagttaaccgtaacttaggtacggacttcgacctaacctattcgttcgttaccgttctaactttcccttaccccgtaccctacttccgtggtaacc

SEQ ID NO: 137594 - DNA, 542 bp, Homo sapiens
  misc_feature: GYAE6OF01C0RKA.46.67.G01.1.454.CMB.1.raw
  modified_base (337)..(337): a, c, t, g, unknown or other
  misc_feature (337)..(337): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcgggagaccctgtccctcacctgcgctgtctctggtgcctccatcagtagtggtttcttcgtggggctgggtccggcagctcccaggggaaggggctggaatacattggaagtgtctctcatagtggaggttcctattacagtccgtctctcaagagtcgagtcaccatatctctggacacgtcagcaatctacgtttcccngaagatgtagttctgtcgaccgccgctgacacgggtctttatacgtgtgcgagacgacggtctaattatgttagttttggagttggttattcgactacctagtatcggacgggctcgacccgtgggaccgaggtatacgtgtcacgtctcctagcctcacgacggccacgtcgtccttccccgtcgacctaccctcacagtgccg

SEQ ID NO: 137595 - DNA, 519 bp, Homo sapiens
  misc_feature: GYAE6OF01CA22X.46.67.G01.1.454.CMB.1.raw
  modified_base (380)..(380): a, c, t, g, unknown or other
  misc_feature (380)..(380): n is a, c, g, or t
  modified_base (508)..(508): a, c, t, g, unknown or other
  misc_feature (508)..(508): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccaggacggccctaagctcctaatctatgctgcatccagtttgcaaagtgggtccatcgaggttcagtgcagtgatcgtgggacagatttcactctcaccatcagtaatctgacaacgtnaagtattttgactaacttattactgtacaactagtaattaacaagttgtttaccggacctaagggaactaacgtaataactaaattaacgaactgtagctgacactatctgtcttacactcttacccnctactctgtac

SEQ ID NO: 137596 - DNA, 547 bp, Homo sapiens
  misc_feature: GYAE6OF01C5PSW.46.67.G01.1.454.CMB.1.raw
  modified_base (434)..(434): a, c, t, g, unknown or other
  misc_feature (434)..(434): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggcagctccgagggagggctggaatacattggaagtgtctctcatagtggtagttcctattacagtccgtctctcaagagtcgagtcaccatatctctggacacgtcagcatctagtttccctagaagatgtagttctgtcgaccgcgctagacgtacggtcgtttatacgtgtgtcgagagacgntattatgtattttggagttgttattcgactaccgtagacgtcggaccgggtctccggtacccgtggggcctagggactacgtcggtccaccgttctccgttagccctaacccg

SEQ ID NO: 137597 - DNA, 723 bp, Homo sapiens
  misc_feature: GYAE6OF01D74WW.46.67.G01.1.454.CMB.1.raw
tcagactagcagtacacgaccggtgctcgatttagagtatacatattggggtttggggagtctcggtcaggacacagaatggacatgagggtccccgctcagctcctgggggcctcctgcctactcgtggctccggaggtcgccgagagtgtgacatcgagtctcgaccctagtcctccactccctcctgtctcgaccgaaccgggtgggacgacagtcgtaccacctatcctacgttcgggcccgggactaacggtaccggaactagttacgaacctaaccttaaattttaaagttggtactacaactaagtaacgaccgaacgggacccgaccctaagcctacctaatctatgctgctactacgtagttcgaacgtaagggtccgggtaccctagtacggtagttcgaggtcggacgtaggtggtactcggtacggactagttacttaccactctaccactatacgtaagtactcgacgtacgtaacgtagtaacgtttagtttacgaactttaactttaacttacgtacgtaactaaagtaagttaaacttaacgtaagtttacgggtttaccggaaccgtaacgggaacctaacgtaacttaaacttaaacgttaaacggacgttggtacggtacgtaccgacctaaccgtacttaccgttcgttacccttactacccttaccccgttacccctacttaacttccgttgtaccttaccg

SEQ ID NO: 137598 - DNA, 497 bp, Homo sapiens
  misc_feature: GYAE6OF01EI911.46.67.G01.1.454.CMB.1.raw
  modified_base (404)..(404): a, c, t, g, unknown or other
  misc_feature (404)..(404): n is a, c, g, or t
  modified_base (413)..(413): a, c, t, g, unknown or other
  misc_feature (413)..(413): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccaggacgccctaagctcctaatctatgctgcatccagtttgcaaagtgggtcccatcgagttcagtgcagtgatctgggacagtattcactctcacatcagtatctgcaacgtgaagtatttgactaacttattactgtacaanagtaattanaattgtttacgacctaagggacacgactaacaattaaacgactgtgctagcacctatctgtcttatcttccgacatctgatacg

SEQ ID NO: 137599 - DNA, 558 bp, Homo sapiens
  misc_feature: GYAE6OF01BG0NQ.46.67.G01.1.454.CMB.1.raw
  modified_base (335)..(335): a, c, t, g, unknown or other
  misc_feature (335)..(335): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctggggtccggcagctcccagggaaggggctggaatacattggaagtgtctctcatagtggaggttcctattacagtccgtctctcaagagtcgagtcaccatatctctggacacgtccagcaatcagttttcccngaagatgagttctgtcgaccgccgctgacacgggtcgtttattactgtgcgagagacggctattatgtattttggagtggttatttcgacaccctagatcgacggggctcgacccgtggggccagggatacgtggtcaccgtctccgttagccctccgaccgaacgggcccacgtccggtccttcccccgtcggtccaccccttccctcccaacgcgtacccg

SEQ ID NO: 137600 - DNA, 614 bp, Homo sapiens
  misc_feature: GYAE6OF01C7QGJ.46.67.G01.1.454.CMB.1.raw
  modified_base (172)..(172): a, c, t, g, unknown or other
  misc_feature (172)..(172): n is a, c, g, or t
  modified_base (263)..(263): a, c, t, g, unknown or other
  misc_feature (263)..(263): n is a, c, g, or t
  modified_base (321)..(321): a, c, t, g, unknown or other
  misc_feature (321)..(321): n is a, c, g, or t
  modified_base (354)..(354): a, c, t, g, unknown or other
  misc_feature (354)..(354): n is a, c, g, or t
  modified_base (375)..(375): a, c, t, g, unknown or other
  misc_feature (375)..(375): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcgggagaccctgtccctcacctgcgctgtctctggtncctccatcagtagtggtttctcgtggggctgggtccggcagccgtcccgaggggaaggggctagggaaatacagttggaagttcgtctctnaagtaggtggtaggttcctattacagtccgtctctcaagagtcgagtcacctatatcnctggacacgtccagcaatctagtttccagaatntagacgttctgtgacccgtcncgtgacgtacgggtctttattacgtgtcgacgagagacgtctattatgttattttaggacgttgttattacgacaccgtagactcggacgggctccggacccgtgggccgaagggtactacgtcgtaccaccggtcctacgttacgcccgtaccgtaacccgaaccggcccaacgttcccggttcccgttccccccgtcgggacccctaccccgttccctacccgaagccgtaaccccg

SEQ ID NO: 137601 - DNA, 768 bp, Homo sapiens
  misc_feature: GYAE6OF01EI342.46.67.G01.1.454.CMB.1.raw
tcagactagcagtacacgaccggtgctcgatttagagtatacatattgggggtttgggagtcgtcggtcaggacacagcgatggacatgagggtccccgcgtcagctcctgggtctcctcgctactctggcgtccgaggtggccaggactgtgacactcgagctgacccagtcctccatcctccgtgtctgcaaccgtgggagacagtgtccaccatcacttcggaccggcaagtcggaactattgactaactaatttaaattggtatcaacgtatagaaccaagggtaccgacccgtaagacctaccctaaagtctaatcgacttgcatccgtagttttgactaaaggttcggggttcccaaggttccgtaaggtttcacgttcggactaggtcggtactacgttgggacgaacggtactttaccgaccttcctcgaaccctattaccgtagttaacgttcctacggacgtaacgtaggtaaacgtaagttttacggacttaaacgtttatttaacgttacgtacaaacgtagtaactttaacaagtttacgttttaccgggaaccggtaaacgggaaccgtaaccggtaaccttaaaccgtaaaacgtttaaaaccggttaacggtttaccgggttaacggggtaccggttaaccggtaaccgtaacccgttaacgttacccggttaccggtttacccgtttaccgtaaaccgtttccccgttaaccccggtacccttacccgtttaccccgttcggttaaacccg

SEQ ID NO: 137602 - DNA, 511 bp, Homo sapiens
  misc_feature: GYAE6OF01BE88S.46.67.G01.1.454.CMB.1.raw
  modified_base (501)..(501): a, c, t, g, unknown or other
  misc_feature (501)..(501): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatgtatcaacatagaccagggacgccctaagctcctaatctatgctgcatccagtttgcaaaggtgggtcccatcgagttcagtggcagtggatcgtgggacagtatttcactctcaccatcagtaatctgacaacggtgaagtattttgactaactttattactgtacaactagtaattacaattgtttacggacctaaggactacgaactaacaaattaacgaactgtgctgacactatctgtctactctctcccntactctgtac

SEQ ID NO: 137603 - DNA, 622 bp, Homo sapiens
  misc_feature: GYAE6OF01D9LJA.46.67.G01.1.454.CMB.1.raw
  modified_base (338)..(338): a, c, t, g, unknown or other
  misc_feature (338)..(338): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccggcaagtcgaacattgacactatttaaatgtatcaacatagaccaggacgccctaagctcctaatctatgctgcatccagtttgacaaagtgggtcccatcgaggtttcagtggcagtggatcgnggacagtatttcactctcacatcagttaatcgtagacaacgtagtaaagtattttagactaactttattaccttagtactaaactaagtaaatttaactaagttacggttttaccgggacctaaaggggtaacctaaccgtaaaccttaaactaaaacgttaaaaccggtaaacttaggtacggtacctacggtaacctaacccttaattccgtttacggttaccctttaccgtaaaccgtttccccgttacccccgtaacccttaacttccgtggttaaaccg

SEQ ID NO: 137604 - DNA, 639 bp, Homo sapiens
  misc_feature: GYAE6OF01CPH4F.46.67.G01.1.454.CMB.1.raw
  modified_base (217)..(217): a, c, t, g, unknown or other
  misc_feature (217)..(217): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggnaagtcggaacattgacactatttaaatgtatcaacatagaccagggacgccctaagcctctaatctatgctgcatccagtttgcaaggtgggtcccatcgaggttcagtgcagtggatcgtgggacagtactttcactctacaccatacagtaatctagacaacgtagtaacgtattttgaacttaacttatttaacttacgttacaaacgtaataaacttaacttaagtttacggtttttaccggaccgtaaacggggtaacctaacggtaaaccttaaacgttaaaacgtttaaaccggaacgtttagggttacgggtaccttaggtaccctaaaccctaacgtttaccttaccggttacctttaccctaactttaccccgtttacccccgtacccttaacttcccgttaaggttaaacc

SEQ ID NO: 137605 - DNA, 549 bp, Homo sapiens
  misc_feature: GYAE6OF01A84MW.46.67.G01.1.454.CMB.1.raw
  modified_base (335)..(335): a, c, t, g, unknown or other
  misc_feature (335)..(335): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccaggggaaggggctggaatacattggaagtgtctctcatagtggaggttcctattacagtccgtctctcaagagtcgagtcaccatatctctggacacgtccagcaatcagttttcccngaagatgagttctgtcgaccgccgctgacacgggtctttatactgtgcgagagacggctattatgtatttttggagttggttatttcgactaccctagatcggacggggctcggacccgtggggccagggaatacgtggtcaccgtctccttacgccctccaccgacggcccagtccgtccttcccccgtggcccaccctcctccaagcgcccg

SEQ ID NO: 137606 - DNA, 529 bp, Homo sapiens
  misc_feature: GYAE6OF01AQTMY.46.67.G01.1.454.CMB.1.raw
  modified_base (379)..(379): a, c, t, g, unknown or other
  misc_feature (379)..(379): n is a, c, g, or t
  modified_base (407)..(407): a, c, t, g, unknown or other
  misc_feature (407)..(407): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggccctaagctcctaatctatgctgcatccagtttgcaaagtgggtccatcgaggttcagtgcagtgatctgggacagatttcactctcaccatcagtaatctgcaacgtnaagtattttgactaaacgttattacgtntacaactagaactttacaattcgttttacggaccaagggacctacgtaactaactaaattaaccgaactgtacgactagaccactatcttcgtcttacacttccttcccgacatcgtgtaac

SEQ ID NO: 137607 - DNA, 601 bp, Homo sapiens
  misc_feature: GYAE6OF01E5QYJ.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacactatttaaatgtatcaacatagaccagggaccgccctaagctcctaatctatgctgctatcctaggtttgacgtaaaggtcgggtacccagtcgaggttcaggtggcaggtggatcgtagggacagtatttcactctacaccatacagtaatctagactaagtgtaagttatttagacttaaactttattaactgtacaaactaagtaaatttactaagtttcggtttaccggaaccgtaaagggtacctaaacgtaaactaaacgtaaaacttaaacgaacgttggtacggtactacgacctacctattaccgttcgttaccttacctaccgttcccgttaccccgactacgttcctagttaaccg

SEQ ID NO: 137608 - DNA, 575 bp, Homo sapiens
  misc_feature: GYAE6OF01B4HGN.46.67.G01.1.454.CMB.1.raw
  modified_base (249)..(249): a, c, t, g, unknown or other
  misc_feature (249)..(249): n is a, c, g, or t
  modified_base (318)..(318): a, c, t, g, unknown or other
  misc_feature (318)..(318): n is a, c, g, or t
  modified_base (325)..(325): a, c, t, g, unknown or other
  misc_feature (325)..(325): n is a, c, g, or t
  modified_base (334)..(334): a, c, t, g, unknown or other
  misc_feature (334)..(334): n is a, c, g, or t
  modified_base (386)..(386): a, c, t, g, unknown or other
  misc_feature (386)..(386): n is a, c, g, or t
  modified_base (439)..(439): a, c, t, g, unknown or other
  misc_feature (439)..(439): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtcctggtgcaactgcaggagtcgggcccagactggtgaggccttcggagaccctgtccctcacctgcgctgtctctggtgcctccatcagtagtggtttcttcgtggggctgggtccggnagctcccgagggaaggggctggaatacgattgggaagtgtctctcataggtggaaggttcctatttacngtccgtntctacaagngtcgagtcaccatatctgtggacacgtccagcaatctagttttcccagaagntgtagttctgtgaccgcgctgacgacggcttttatacgtgtgcgagagacggnttatagtgtagttttggagttggttattacggacctaccgtaggactcgggacggggtctccggtcccggttaggggcctaagggaacttccgtacgggttcccaccggttcttaccccgttaggccctaccccgg

SEQ ID NO: 137609 - DNA, 530 bp, Homo sapiens
  misc_feature: GYAE6OF01EC6SZ.46.67.G01.1.454.CMB.1.raw
  modified_base (340)..(340): a, c, t, g, unknown or other
  misc_feature (340)..(340): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacactatttaaatgtatcaacatagaccagggacgccctaagctcctaatctatgctgcatccagtttgcaaagtgggtcccagtcgaggttcagtggcagtggatcgngggacagtattcactctcacatcagtaatctgacaacgtagtaagtattttgacttaactttattactgtactaacaagtaattaactaattgttttaccggacgtaaggactaacgtaactaacaaattaacgaactagtaggtctagcacctatcttgtcttcacttcctacccacctatcgtgtaac

SEQ ID NO: 137610 - DNA, 535 bp, Homo sapiens
  misc_feature: GYAE6OF01D9CJ7.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccgcagctcccagggagggctggaatacattggaagtgtctctcatagtggaggttcctattacagtccgtctctcaagagtcgagtcaccatatctctggacacgtccagcaatctacgttttccctagaagatgtagttctgtcgaccgccgctgacacgggtcgtttattactgtgcgagagacgctattatgtattttggagttggttatttcgactaccgtagagtcggacgggctcgacccgtgggccagggactacgtcggtcaccgtctccttgcctacccg

SEQ ID NO: 137611 - DNA, 602 bp, Homo sapiens
  misc_feature: GYAE6OF01C2D1M.46.67.G01.1.454.CMB.1.raw
  modified_base (218)..(218): a, c, t, g, unknown or other
  misc_feature (218)..(218): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtgggagacagtgtcaccatcacttgccgggnaagtcggaacattgacactatttaatgtatcaacatagacagggacgccctaagctcctaatctatgctgcatccagtttgacaaagtcgggtcccagtcgaggttcagtcggctaggtggagtcgtgggaacagtactttcactctcacctatcagtatcgtgacaagtgaagtattttgactaaactttattacgtacgttcgaaactaagtaaactttaactaatttacgggttttaccggaacccgtaaagggtaacccaaacgtaaaccttaaactaaaacgtttaaaccggaacgttacggtaggacccttagaccctaaccgtaattccgtcgtttacttccacgtttcccttaccccgactaacgttctcggtaac

SEQ ID NO: 137612 - DNA, 591 bp, Homo sapiens
  misc_feature: GYAE6OF01CM9FL.46.67.G01.1.454.CMB.1.raw
  modified_base (217)..(217): a, c, t, g, unknown or other
  misc_feature (217)..(217): n is a, c, g, or t
  modified_base (254)..(254): a, c, t, g, unknown or other
  misc_feature (254)..(254): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggnaagtcggaacattgacacctattttaaatgtatcaanatagaccagggaccgccctaagctcctaatctatgctgcatccagtttgcaaagtgggtcccagtcgaggttcagtggcaggtggatcgtgggacaggtatttcacttctcaccatcagtaatctgacgtaagtgaagtattttgactaactttattactgtacaactagtaacttaactaagtttcgttttaccggacccgaaaggggtacctaacgtaaccttaaaccgtaaaattaaaccgtaaacttggtacgaccttacggacctaaccctattccttcgttaccttaccgttactttccccgttaccccgtacctacttccgttgtaaccg

SEQ ID NO: 137613 - DNA, 544 bp, Homo sapiens
  misc_feature: GYAE6OF01E0P8A.46.67.G01.1.454.CMB.1.raw
  modified_base (334)..(334): a, c, t, g, unknown or other
  misc_feature (334)..(334): n is a, c, g, or t
  modified_base (522)..(522): a, c, t, g, unknown or other
  misc_feature (522)..(522): n is a, c, g, or t
  modified_base (535)..(535): a, c, t, g, unknown or other
  misc_feature (535)..(535): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggaaggggctggaatacattggaagtgtctctcatagtggaggttcctattacagtccgtctctcaagagtcgagtcaccatatctctggacacgtccagcaatcagttttcccngaagatgagttctgtcgaccgccgctgacacgggtcttttatactgtgcgagagacggctattatgtattttggagttggttatttcgactaccctagatcggacggggctcggaccccgtggggccaggggactactggtcaccgtctccttacgcctccaccgacggcccagtccgtccttccccngtcccaccctccnccagcgtcc

SEQ ID NO: 137614 - DNA, 544 bp, Homo sapiens
  misc_feature: GYAE6OF01AV75P.46.67.G01.1.454.CMB.1.raw
  modified_base (290)..(290): a, c, t, g, unknown or other
  misc_feature (290)..(290): n is a, c, g, or t
  modified_base (336)..(336): a, c, t, g, unknown or other
  misc_feature (336)..(336): n is a, c, g, or t
  modified_base (341)..(341): a, c, t, g, unknown or other
  misc_feature (341)..(341): n is a, c, g, or t
  modified_base (520)..(520): a, c, t, g, unknown or other
  misc_feature (520)..(520): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggcagctcccgagggaaggggctggaatacattggaagtgtctctcatagtggaggttcctattacagtccgtctctcaagngtcgagtcaccatatctctggacacgtccagcaatcagttttcccngaagntgagttctgtcgaccgcgctgacacgggtcttttatactgtgacgagagacggctattagtgtagttttggagtttggttatttcgactacctagacgtcggacgggctacgacccgtggggaccagggtatacgtgtcaccgtctctcgcctcacgacggccagtccgtcctccccgnggcctaccctcctccagcgtaccg

SEQ ID NO: 137615 - DNA, 533 bp, Homo sapiens
  misc_feature: GYAE6OF01DYTRT.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacgccctaagctcctaatctatgctgcatccagtttgcaaagtgggtcccatcgaggttcagtggcagtggatcgtgggacagatttcactctcaccatcagtaatctgacaacgtagaagtattttgactaactttattactgtacaacagtaattactaattgttttacggaccgtaagggaccacgtaactaactaaattaacgaactgtaggctagacctaccattctgttccttctacttccttacccgacctactctgtaac

SEQ ID NO: 137616 - DNA, 502 bp, Homo sapiens
  misc_feature: GYAE6OF01AXLJT.46.67.G01.1.454.CMB.1.raw
  modified_base (425)..(425): a, c, t, g, unknown or other
  misc_feature (425)..(425): n is a, c, g, or t
  modified_base (478)..(478): a, c, t, g, unknown or other
  misc_feature (478)..(478): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggccctaagctcctaatctatgctgcatccagtttgcaaagtggggtcccagtcgaggttcagtggcagtggatcgtgggacagatttcactctcaccatcagtaatctgcaacgtgaagtatttgactaacttattactgtacaactagtaattanaattgtttcgacaaggactacgactaacaattaacgatgtagctgcacatctntctctactcttcccgcatctgtac

SEQ ID NO: 137617 - DNA, 587 bp, Homo sapiens
  misc_feature: GYAE6OF01CV8YH.46.67.G01.1.454.CMB.1.raw
  modified_base (217)..(217): a, c, t, g, unknown or other
  misc_feature (217)..(217): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggnaagtcggaacattgactacctatttaaattggtatcaacatagaccagggaccgccctaagctcctaatctatgctgcatccagtttgactaaaggtcgggtcccagtcgaggtttcagtggcaggtcggatcgtggggacagtatttcactctcactatacagtaatctgacaacgtagaagtatttagactaactttattacttagtacaaacgtaagtaattaactaacgtttcggttttaccggaaccgtaaacgggactaacgtaaccgttaacaaaacgtttaacgaacgttgtaggtcctagacctaaccgtattcgtcgtttacgttctacgttacccttacccgactaacgtcgtagtaac

SEQ ID NO: 137618 - DNA, 505 bp, Homo sapiens
  misc_feature: GYAE6OF01DJ5QD.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcgaacattgacacctatttaatgtatcaacatagaccagggacggccctaagctcctaatctatgctgcatccagtttgcaaagtggggtcccagtcgaggttcagtggcagtggatctgggacagatttcactctcaccatcagtaatctgacaacgtgaagtattttagactaactttattactgtcaactagaattactaattgttttcgctaaaggcacgactaacaaattaacgaactgtgctgcaccatctgtcttcatccttacccgcactctgtac

SEQ ID NO: 137619 - DNA, 505 bp, Homo sapiens
  misc_feature: GYAE6OF01B1JD0.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatgtatcaacatagaccaggacgccctaagctcctaatctatgctgcatccagtttgcaaagtgggtcccatcgagttcagtgcagtggatctgggacagatttcactctcaccatcagtaatctgcaacgtgaagtattttgactaactttattactgtacaacagtaattacaattgtttacgactaagggactacgaactaacaaattaacgaactgtagctagcacatctgtactcactccttcccgacactctgtac

SEQ ID NO: 137620 - DNA, 519 bp, Homo sapiens
  misc_feature: GYAE6OF01AYXXP.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggaccggccctaagctcctaatctatgctgcatccagtttgcaaagtggggtcccatcgaggttcagtggcagtgatcgtggacagatttcactctcaccatcagtaatctgacaacgtgaagtattttgactaacttattacttgtacaacagtaattactaattgttttacggacctaaggacaacgaactaactaaattaaacgaactgtgctgctacatctgttctcacttccttcccgactactctgtac

SEQ ID NO: 137621 - DNA, 595 bp, Homo sapiens
  misc_feature: GYAE6OF01A41RT.46.67.G01.1.454.CMB.1.raw
  modified_base (341)..(341): a, c, t, g, unknown or other
  misc_feature (341)..(341): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtgggagacagtgtcaccatcacttggccgggcaagtcggaacattgacactattaatgtatcaacatagaccagggacggccctaagctcctaatctatgctgcatccagtttgcaaagtgggtcccagtcgaggttcagtggcagtggatcgngggacagtatttcgactctacactatcagtaatctgacaacgtgaatatttgactaactttattactgtactaaacagtaaacttactaatttcggtttaccggaccgtaagggacctaacggtaactaaactaaacgttaaacgaaccttagggtacgtaccttaggacctaaccgtatttaccgttcggttacccttttaccgtaacgtttccccgttttacccccgaccctaactttccgtgttaaacccg

SEQ ID NO: 137622 - DNA, 543 bp, Homo sapiens
  misc_feature: GYAE6OF01EXKMM.46.67.G01.1.454.CMB.1.raw
  modified_base (211)..(211): a, c, t, g, unknown or other
  misc_feature (211)..(211): n is a, c, g, or t
  modified_base (375)..(375): a, c, t, g, unknown or other
  misc_feature (375)..(375): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtncctccatcagtagtggtttctctggggctggggtccggcagctcccgagggaaggggctggaatacattggaagtgtctctcatagtggatgttcctattacagtccgtctctcaagagtcgagtcaccatatctctggacacgtccagcaatcagttttcccngaagatgtagttctgtgaccgccgctgacacgggtcgtttattactgtgcgagagacggctattatgtagttttggagttggtttatttcgactacctagactcggacggggctccggacccgtggggccagggactacgtcggtactaccgtcttccgttgtccccg

SEQ ID NO: 137623 - DNA, 609 bp, Homo sapiens
  misc_feature: GYAE6OF01EH3QK.46.67.G01.1.454.CMB.1.raw
  modified_base (174)..(174): a, c, t, g, unknown or other
  misc_feature (174)..(174): n is a, c, g, or t
  modified_base (285)..(285): a, c, t, g, unknown or other
  misc_feature (285)..(285): n is a, c, g, or t
  modified_base (312)..(312): a, c, t, g, unknown or other
  misc_feature (312)..(312): n is a, c, g, or t
  modified_base (537)..(537): a, c, t, g, unknown or other
  misc_feature (537)..(537): n is a, c, g, or t
tcagactagcagtacacgaccggtgctcgatttagagtatacatattgggtttgtcctcctgctggtggcagctcccagatgggtcctgtccctggtgcaactgcaggagtccgggcccacgactggtgaggccttcggacgaccctgtccctcacctgcgctgtctctggtcncctccatcagtagttggtttctcgtggggctgggtccgcagcctccgaggggagggctggaatacagttggaagttgtctctacatgtggaggttcctattacagtccgtntctcaagagtcgagtcaccatatctcnggacacgtccagcaatctacgttttcccagaagatgagtttctgtcgacccgccgctcgacgtaccgggtacttttataccttggtgcgagagacggcttattagttgtagtttttggagttggtttatttcgacctaccgttagacgtcggacgggggtctcggacccccgttggggacccaaggggtaacttaccgtgggtaccaccggttcctaccgttacnccctaccacccggaacggcccaacgtccgtcccttcccccgtcgtccctaccctccctaccagcgtaccccg

SEQ ID NO: 137624 - DNA, 554 bp, Homo sapiens
  misc_feature: GYAE6OF01DI4IX.46.67.G01.1.454.CMB.1.raw
  modified_base (212)..(212): a, c, t, g, unknown or other
  misc_feature (212)..(212): n is a, c, g, or t
  modified_base (251)..(251): a, c, t, g, unknown or other
  misc_feature (251)..(251): n is a, c, g, or t
  modified_base (292)..(292): a, c, t, g, unknown or other
  misc_feature (292)..(292): n is a, c, g, or t
  modified_base (378)..(378): a, c, t, g, unknown or other
  misc_feature (378)..(378): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactagtgaggccttcggagaccctgtccctcacctgcgctgtctctggtcncctccatcagtagtggtttcttcgtggggctgggtccgnagcctccgagggaaggggctggaatacattggaagtgtctntcatagtggaggttcctattacagttccgtctctcaagagtcgagtcaccatactctctggacacgtcagcaatctagttttcccngaagatgtagttctgtcgaccgccgctgacacgggtctttatacgtgttgcgagaggcggcttattagtgttagttttggagttggtttatttcgactacccgtagactcggacggggtctccgacccgtgggccgagggaacttcgtcggttcacgtcttccgtgcccgtacccg

SEQ ID NO: 137625 - DNA, 502 bp, Homo sapiens
  misc_feature: GYAE6OF01BRO56.46.67.G01.1.454.CMB.1.raw
  modified_base (192)..(192): a, c, t, g, unknown or other
  misc_feature (192)..(192): n is a, c, g, or t
  modified_base (402)..(402): a, c, t, g, unknown or other
  misc_feature (402)..(402): n is a, c, g, or t
  modified_base (418)..(418): a, c, t, g, unknown or other
  misc_feature (418)..(418): n is a, c, g, or t
  modified_base (476)..(476): a, c, t, g, unknown or other
  misc_feature (476)..(476): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccgggcaagtcggaacattgacactatttaaatggtatcaacatagaccagggacgccctaagctcctaatctatgctgcatccagtttgcaaaggtgggtcccatcgagttcagtggcagtgatcgtgggacagtattcactctcaccatcagtatctgacaagtgaagtatttgactaactttatactntacaacagtaacttanattgtttacgacgaaggacacgtactaactaaattaacgatgtgctagacactatctntctcactccttcccgactatctgtac

SEQ ID NO: 137626 - DNA, 578 bp, Homo sapiens
  misc_feature: GYAE6OF01BP1F5.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctctgggctgggtccgcagctccgagggaaggggctggaatacattggaagtgtctctcatagtggaggttcctattacagtccgtctctcaagagtcgagtcaccatatctctggacacgtccagcaatcagttttccctgaagtatgagttctgtgaccgccgctgacacgggtcgtttatacgtgtgcgagagacggctattatgtattttggagttggttatttcgactaccctagactcggacggggctcggacccgtggggccgagggtaactacgtggtcaccgtctccgttacgcctaccgacccgaacgggccccacggttcccggtacccttccccccgtcgggtcccaccccttaccctacccgaaacgcgtacccg

SEQ ID NO: 137627 - DNA, 608 bp, Homo sapiens
  misc_feature: GYAE6OF01CNQ3H.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaatgtatcaacatagaccaggacggccctaagctcctaatctatgctgcatccagtttgcaaagtgggtcccatcgagttcagtggcagtggatcgtgggacagatttcactctcacctatacagtaatctgactaacgtgaagtattttgactaacttattactcgtacaactaagtaattaactaatttggttttaccggaaccgtaacgggtaacctaacggtaaccttaaacctaaaagtttaaaccggaacttagggtacggtacctacgtaccgtaaccctaagtttacccgttcgttacctttaccgtaaccgtttcccctttacccccggtaccctaacgtttcccgttaggttaaccc

SEQ ID NO: 137628 - DNA, 594 bp, Homo sapiens
  misc_feature: GYAE6OF01C3FYZ.46.67.G01.1.454.CMB.1.raw
  modified_base (192)..(192): a, c, t, g, unknown or other
  misc_feature (192)..(192): n is a, c, g, or t
  modified_base (216)..(216): a, c, t, g, unknown or other
  misc_feature (216)..(216): n is a, c, g, or t
  modified_base (226)..(226): a, c, t, g, unknown or other
  misc_feature (226)..(226): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccggnaagtcgaacnttgacacttatttaaatgtatcaacatagaccgagggaccgaccctaagctacctaatctatgctgcatcctagtttcgacaaggtcgggtcccagtcgaggttcagtgcagtgatcgtggactagtatttcactcacacatcaagtaatcgtgactaagtgaacgttatttgactaattattactgtacaagtaagtaatttaactaagtttcgtttacggaaccgtaaacgggtacctaaacggtaacttaaacgaaacgtttaaacgaacgttcggttacgaccgttacggacctaaccgtacttcttccgtttactttacctaacgttccccgttacccgaccttaacgttccgtagttaaccg

SEQ ID NO: 137629 - DNA, 549 bp, Homo sapiens
  misc_feature: GYAE6OF01AS19C.46.67.G01.1.454.CMB.1.raw
  modified_base (335)..(335): a, c, t, g, unknown or other
  misc_feature (335)..(335): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctggggtccggcagctcccagggaaggggctggaatacattggaagtgtctctcatagtggaggttcctattacagtccgtctctcaagagtcgagtcaccatatctctggacacgtccagcaatcagttttcccngaagatgagttctgtgaccgccgctgacacgggcgtttatactgtgcgagagacggctattatgtatttttggagttggttatttcgacaccctagatcgacggggctcggaccccgtggggccaggggtaatacgtggtcaccgtctccttagccctccaccgacgggcccagtccggtccttccccctggccaccctcctcccaagcgtccg

SEQ ID NO: 137630 - DNA, 620 bp, Homo sapiens
  misc_feature: GYAE6OF01AW8D8.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctctggggctgggtccgcagctcccgagggaagggctggaatacattggaagtgtctctcatagtggaggttcctattacagtccgtctctcaagagtcgagtcaccatatctctggacacgtccagcaatctacgttttcccagaagtatgtacgttcgtgtaccgaccgcgtcgacgacggtacggtttatttacgtacgtgtcgagagacggtacgtattattagttagttttaggttaggttaggtttagtttacgtaccgtacctacgtagtacggtacggggacggtccgtacccgtccgggtacggacggtaaggtacgttacggtcgtaccgtccgtccgttacgtcctccgtaccgaaccggtccgtacctcggtcccgttccccgtccgccgtcccctaccctcccacgacgcgtacccg

SEQ ID NO: 137631 - DNA, 569 bp, Homo sapiens
  misc_feature: GYAE6OF01A83T9.46.67.G01.1.454.CMB.1.raw
  modified_base (394)..(394): a, c, t, g, unknown or other
  misc_feature (394)..(394): n is a, c, g, or t
  modified_base (421)..(421): a, c, t, g, unknown or other
  misc_feature (421)..(421): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggaggacagtgtcaccatcacttgccgggcaagtcggaacattgacacctatttaaattgtatcaacatagaccaggaccgccctaagctcctaatctatgctgcatccgagtttgctaaaggtcgggtacccagtcgtagttcaggtggcagtgatcgtgggacagtactttcactctcaccatacagtaatctagacaacgtanaagtatttagacttaacttattaactntacaactaagtaacttaacaatttgtttacggactaagggacctaacgtaactaactaaaattaacgaacgttggtaggtacgtacgacaacctattcgtcgttcttacctaacgttcccttaccccgtacctacttccgtgtaaccg

SEQ ID NO: 137632 - DNA, 568 bp, Homo sapiens
  misc_feature: GYAE6OF01CAI5U.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccgaggggaaggggctggaatacattggaagtgtctctcatagtggaggttcctattacagtccgtctctcaagagtcgagtcaccatatctctggacacgtccagcaatctagttttccctgaagatgagttctgtgaccgccgctgacacgggtctttatactgtgcgagagacggctattagtgtattttggagttggtttatttcgtactacccgtagacgtcggacggggtctcggaccccgtggggaccgagggtaatacgtggtcaccgtctcctacgcctccgaccgacggcccacgttccggtcccttccccgtcggcctacccctcctccgaacgcgtacccg

SEQ ID NO: 137633 - DNA, 556 bp, Homo sapiens
  misc_feature: GYAE6OF01A2SX5.46.67.G01.1.454.CMB.1.raw
  modified_base (97)..(97): a, c, t, g, unknown or other
  misc_feature (97)..(97): n is a, c, g, or t
  modified_base (515)..(515): a, c, t, g, unknown or other
  misc_feature (515)..(515): n is a, c, g, or t
tcagactagcagtacacgaccggtgctcgatttagagtatacatagttgggtttgggagtctcggtcaggacacagcatggacatgagggtccccgntcagctcctggggctcctgctactctggctccgaggtgccagatgtgacatcgagctgacccagtctccatcctcctgtctgcaaccgtgggagacagtgtcaccatcacttgcccgggcaagtcggaacctattgactacctatttaaattggtatcaacatagaccagggacgccctaagcctcctaatctatcgctgcatccgagtttgcaaagtcgggtcccagtcgaggttcagtggcagtggactcgtgggacagtatttcactctcaccgatcacgtaatctagacaacgtgtaaatatttagacttaacttattactagtactaacagtaattacaattcgtttcgacctaaggactacgaactaactaaacgttaacgtaactaggtcgacttggactacgtattcgtnttaccttctacttccgttcccgactacgttccgtggtaacg

SEQ ID NO: 137634 - DNA, 577 bp, Homo sapiens
  misc_feature: GYAE6OF01CQQP0.46.67.G01.1.454.CMB.1.raw
  modified_base (192)..(192): a, c, t, g, unknown or other
  misc_feature (192)..(192): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccgggcaagtcgaacattgacactatttaatgtatcaacatagaccagggacgccctaagctctaatctatgctgcatccagtttgcaagtgggtcccatcgagttcagtgcagtgatcgtgggacagatttcactctcaccatcagtaatctgacaacgtgaagtatttagactaactttattactgtacaactagtaattactaattcgttttacggaccgtaaagggacctaacggtaaccttaaacaaaacgtttaaacgaaacttaggttaggaccttaggaccctaacctattaccgttcggttacctttacctaacgtttcccgtttacccccgaccttaacttccgttagttaaaccg

SEQ ID NO: 137635 - DNA, 752 bp, Homo sapiens
  misc_feature: GYAE6OF01CDZEB.46.67.G01.1.454.CMB.1.raw
  modified_base (173)..(173): a, c, t, g, unknown or other
  misc_feature (173)..(173): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactgggtgaggccttcggagaccctgtccctcacctgcgctgtctctggtcncctccatcagtagtggtttctcgtgggctgggtccgcagctccgagggagggctggaatacagttggaagtgtctctcagtgtgaggttcctattacagtccgtctctacaagtagtcgagtcaacctatatctcgtagaccacgtcagacaattctacgttttcccagtaagtactgtacgttctaggtcgaccgtccgctacggaccgtacgggtcgttttaagttaccgtggtacggacgaggtaacgacgggtacttagttacgttagtttaagtttttcggtaaggttttcggtttacttttaccggaaccttaccccgttaaggtacggttaccgggtaccgggggtccttacccgggtacccccgggttacgggggacccgtaagggggtaacttaccggtacggttacccgtacccgttaccgttcccgtttaaccggtaccccgttacccgtaaccccggtaaccgggacccccgttacggtttcccccgggttaccccgttaccccccggttacggtaccccttaccccccttaccccggtaaccctaaaccgggtacccgtaccccgg

SEQ ID NO: 137636 - DNA, 559 bp, Homo sapiens
  misc_feature: GYAE6OF01EUM7N.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacactattaaatgtatcaacatagacaggacgccctaagctcctaatctatgctgcatccagtttgctaaagtcgggtcccatcgaggttcagtggcagtggatcgtgggacagattcactctcactatcagtaatctgacaacgtgaaagtatttagactaacttattactgttacaactagtaattaactaagttgtttacggacctaagggactaacgtacttaaactaaattaaacgaacttgtacggtctagtacctaaccctaattccttacgttactttaccacttcccgttacccccgtataactcccgtagttaaaccg

SEQ ID NO: 137637 - DNA, 525 bp, Homo sapiens
  misc_feature: GYAE6OF01AHACR.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggccctaagctcctaatctatgctgcatccagtttgcaaagtggggtcccatcgaggttcagtggcagtggatcgtgggacagtatttcactctcaccatcagtaatctgacaacgtgaagtattttgactaacttattactgtacaactagtaattactaagttgttttaccggacctaacgggactaacgactaactaaacttaacgaactgtggactgacctaccatctgtcttcattcctcccgcatctgtac

SEQ ID NO: 137638 - DNA, 630 bp, Homo sapiens
  misc_feature: GYAE6OF01AH9O5.46.67.G01.1.454.CMB.1.raw
  modified_base (176)..(176): a, c, t, g, unknown or other
  misc_feature (176)..(176): n is a, c, g, or t
  modified_base (198)..(198): a, c, t, g, unknown or other
  misc_feature (198)..(198): n is a, c, g, or t
  modified_base (359)..(359): a, c, t, g, unknown or other
  misc_feature (359)..(359): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcgggagacccctgtcccctcacctgccgctgtctctggtcncctcatcagtgtggtttctcgnggggctgggacgcagcctccgaggggagggctaggaatacagttggaagttcgtctctcagtaggtgggtacggttcctaattacgacgtccgtctctacaagagtcgagtccactatactctctggacacgtccagacaactctacgttttccagaagtntggtacttcgtgtcgaccgcgcgtgacgtacggtctttataccgtgtcgacgagacgtcggtacttattagtgttagttttggtagtttggttacttacgacctaccgtaggtcgtcgggacggggtcctaccggccccggtagggaccgtaggtacgtcgtcggtacctaccgtcctccgtacgtcccaccgaacccgtaccggtcccctacgttcccggttaccctcccccgtcggtaccctacccctccacccgaacgcgtaccccgg

SEQ ID NO: 137639 - DNA, 512 bp, Homo sapiens
  misc_feature: GYAE6OF01DNR5U.46.67.G01.1.454.CMB.1.raw
  modified_base (227)..(227): a, c, t, g, unknown or other
  misc_feature (227)..(227): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaaccgtgggagacagtgtcaccatcacttgccgggcaagtcggaacnttgacacctatttaaatggtatcaacatagaccaggacggccctaagctctaatctatgctgcatccagtttgcaagtgggtcccatcgaggttcagtgcagtggatctgggacagtatttcactctcaccatcagtaatctgacaacgtgaagtatttagactaacttattactgtacaacagtaattacaattgtttacggactaaagggacctacgaactaacaaattaacgaactgtagctagacacatctgtcttcacttcctacccgcctatctgtaac

SEQ ID NO: 137640 - DNA, 547 bp, Homo sapiens
  misc_feature: GYAE6OF01AMF5H.46.67.G01.1.454.CMB.1.raw
  modified_base (330)..(330): a, c, t, g, unknown or other
  misc_feature (330)..(330): n is a, c, g, or t
  modified_base (354)..(354): a, c, t, g, unknown or other
  misc_feature (354)..(354): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggcagctcccgagggaaggggctggaatacattggaagtgtctctcatagtggaggttcctattacagtccgtctctcaagngtcgagtcaccatatctctggacncgtccagcaatcagttttcccagaacgatgagttctgtgcccgcgctgacgacgggtcgtttattactgtgcgagagcggctattatgtagttttggagttgtttatttcgactaccctagcgtcggacggggtcctccggaccccgtggggccagggactacgtcggtcaccgttctccgttgccctacccg

SEQ ID NO: 137641 - DNA, 543 bp, Homo sapiens
  misc_feature: GYAE6OF01EDJV7.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacatgacacctatttaaattggtatcaacatagaccagggacgccctaagctcctaatctatgctgcatccagtttgacaaaggtcgggtcccagtcgaggttcagtggcagtggatcgtgggacagtatttcactctcaccatcagtaatctagcaacgtgtaagtatttgactaacttattactagtacaactaagtaattaactaattcggtttaccggactaagggacaacgtaacttaactaaacttaaacgaactagtgactgaccacctattctgttccttacacttcccttacccgacctacttctgtac

SEQ ID NO: 137642 - DNA, 554 bp, Homo sapiens
  misc_feature: GYAE6OF01APTG4.46.67.G01.1.454.CMB.1.raw
  modified_base (336)..(336): a, c, t, g, unknown or other
  misc_feature (336)..(336): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggttttctctggggctgggtccggcagctcccgaggggaaggggctggaatacattggaagtgtctctcatagtggaggttcctattacagtccgtctctcaagagtcgagtcaccatatctctggacacgtccagcaatcagttttcccngaagatgagttctgtgaccgccgctgacacgggcgttttattactgtgcgagagacggctattatgtatttttggagttggttatttcgacaccctagactcggacggggctcgaccccgtggggccagggtaactacgtggtccaccgtctccttagccctccaccgacggcccagtccgtccttcccccgtggcccaccctccctccaagcgaccg

SEQ ID NO: 137643 - DNA, 588 bp, Homo sapiens
  misc_feature: GYAE6OF01DMOIY.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacgccctaagcctcctaatctatgctgcactccagttttgacgtaaaggtcggggtacccagtcgaggttcagtggcaggtggatcgtgggactagtatttcactctcacctatcagttaactcgtgactaacgtgtaagttagttttacgactaactttattactagtacgtaaactagtaaatttaactaagtttcggtttcggaaaccgtaagggtacctaacgtaacttaaactaaattaacgaacttgtacgctagacctacctattcctgttccttaccgtaacttcccgttacccgaccttacttcgtgtaaccg

SEQ ID NO: 137644 - DNA, 555 bp, Homo sapiens
  misc_feature: GYAE6OF01B8TC5.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcgaacatgacacctatttaaatgtatcaacatagaccaggacggccctaagctcctaatctatgctgcatccagtttgcaaagtggggtcccagtcgaggttcagtggcagtggatcgtgggacagtatttcactctcacctatacagtaatctgacaagtagtaagtattttgactaactttattacttgtacaactagtaattaactaatttcggttttaccggaccgtaaagggacctaacgtaactaaactaaacgttaaacgtaacgtggtagtacctagacctacctatcttgttacttacacttccttcccgactactcgtagtacg

SEQ ID NO: 137645 - DNA, 568 bp, Homo sapiens
  misc_feature: GYAE6OF01AC12B.46.67.G01.1.454.CMB.1.raw
  modified_base (336)..(336): a, c, t, g, unknown or other
  misc_feature (336)..(336): n is a, c, g, or t
  modified_base (399)..(399): a, c, t, g, unknown or other
  misc_feature (399)..(399): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggcagctcccgaggggaagggctggaatacattggaagtgtctctcatagtggaggttcctattacagtccgtctctcaagagtcgagtcaccatatctctggacacgtccagcaatcagttttcccngaagatgagttctgtcgaccgcgctgacacgggtcgtttatactgtgcgagagacggctattntgtagttttggagttgggtttatttcgactacccgtagactcggacggggcctccggacccgtggggaccagggtaactacgtggtacaccgtctcctagcctccgaccgacgggcccagtccggttcccttcccccgtggtcccaccccttccaccgaagcgtacccg

SEQ ID NO: 137646 - DNA, 573 bp, Homo sapiens
  misc_feature: GYAE6OF01BJFCE.46.67.G01.1.454.CMB.1.raw
  modified_base (211)..(211): a, c, t, g, unknown or other
  misc_feature (211)..(211): n is a, c, g, or t
  modified_base (379)..(379): a, c, t, g, unknown or other
  misc_feature (379)..(379): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtncctccatcagtagtggtttcttcgtggggctgggtccgcagctccaggggggagggctggaatacagttggaagtgtctctcagtagtggaggttcctattacagtccgtctctcaagagtcgagtcaccatactctcgtggacacgtcagacaatctagttttcccngaacgattgagtttctgtcgaccgccgtctagaccgtacgggtcttttaacttacgtggtgacgtaggacgacgggtacttagtttagtgttagtttttaggagtttggttactttcgacctaccgtagagtcggacggggtctaccggcccgtgggccgagggactacgtggtcaccgtctcctgccctaccg

SEQ ID NO: 137647 - DNA, 591 bp, Homo sapiens
  misc_feature: GYAE6OF01CA858.46.67.G01.1.454.CMB.1.raw
  modified_base (292)..(292): a, c, t, g, unknown or other
  misc_feature (292)..(292): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgagggccttcggagaccctgtccctcacctgcgctgtctctggtgcctccatcagtagtggtttcttcgtggggctgggtccggcagctcccgaggggaaggggctggaatacattggaagtgtctctcatagtggaggttcctattacagtccgtctctcaagngtcgagtcaccatatctctggacacgtccagcaatctagttttccagaagtatgagttctgtcgaccgcgctgacgacgggtctttatacgtgtgcgtagagacggtctattatgtagttttggagttggttatttcgactacccgtagacgtcggacggggtcctcggacccgtgggacccgtagggtaactacgtggtacctaccgtcctccgttacgccctaccgaccgtaacgggccctacgtcccggtacccttcccccgtcggtccctacccctccctaccaacgcgtacccg

SEQ ID NO: 137648 - DNA, 583 bp, Homo sapiens
  misc_feature: GYAE6OF01CJURT.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtgggagacagtgtcaccatcacttggccgggcaagtcggaacattgacactatttaaatgtatcaacatagacagggacgccctaagctcctatctatgctgcatccagtttgactaaaggtcgggtacccagtcgaggttcaggtggcagtggatcgtgggacagtattcactctacactatacagtaatctagactaacgtgtaagtatttgactaacttattactagtacaactagtaattaactaagttcgttttacggacgtaacgggtaacctaacgtaaccttaaacgtaaagttaaaccgtaacgttaggtacggtacgtacgtaccgtaacctattacttcgttaccttacctacttcccttacccgacctacttccgtagttaacg

SEQ ID NO: 137649 - DNA, 669 bp, Homo sapiens
  misc_feature: GYAE6OF01CX2PP.46.67.G01.1.454.CMB.1.raw
  modified_base (293)..(293): a, c, t, g, unknown or other
  misc_feature (293)..(293): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctcgtggggctgggtccgcagcctccgaggggaggggctaggaatacgagttggaagttgtctctcagtagtggaggttcctattacagtccgtctctcaagngtcgagtcaccatatctctggacacgtccagcaatctagttttcccagtaagactggtagttctggtacgacccggccgtcgttggaaccgtacggggtaccgtttttaattaccgtggttcggaccggaagtacggtacggtacttaagtttagtaggtttagtttttacgggagtttagggtttacttttacgaacctacccgtagtacgtcgggacggggtcctaccggacccggtggggcccgaagggtaacgtacgtcggtacctaccggttctccgttacgccctaccgaccgaaccgggtcccacggttcccggttcccttcccccgtcggtcccctaccccttacccgtacccaacgtccgtaccccg

SEQ ID NO: 137650 - DNA, 614 bp, Homo sapiens
  misc_feature: GYAE6OF01DYM8J.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattgtatcaacatagaccaggacggccctaagctcctaatctatgctgcatccagtttgcaaagtgggtcccagtcgaggttcagtggcagtggatcgtgggacagatttcactctcaccatacagtaatctgacaacgtagtaagtattttacgactaactttattacttagtactaactacgtaaatttaactaagtttcgttttaccggaccgtaaacgggtacctaacgtaaccgttaaactaaaacgtttaaaccgaaacgttacggttacggtaccttacggtaccgtaaccctaattaccgttacgttacctttacctaaccgtttccctttacccccgacccttaacttccgttaggtaaacc

SEQ ID NO: 137651 - DNA, 618 bp, Homo sapiens
  misc_feature: GYAE6OF01AEMX9.46.67.G01.1.454.CMB.1.raw
tcagactagcagtacacgaccggtgctcgatttagagtatacatattgggtttggggagtctcggtcaggacacagcatggacatgagggtccccactcagctcctggggctcctgctactctggctccgaggtgccagatgtgacatcgagctgacccagtctccatcctccctgtctgcaaccgtgggagacagtgtcaccatcacttgccgggcaagtcggaacattgacacctattaaattggtatcaacatagaccaggacggccctaagctcctaatctatgctgcatccagtttgcaaagtgggtcccatcgagttcagtggcagtgatcgtgggacagtatttcactctcaccatcagtaatctagctaacgtgaaagtatttgactaactttattactagtactaaacagtaattactaagttggttttaccggaccgtaaaggggtacctaacggtaaccttaaacctaaaagttaaaaccggtaaacttaggtacgggtaccgtacggtaaccctaacccgtaatttaccgtttcggttacccttttacctaacgtttaccccctttacccccggtaacccttaacgtttccgttaggttaaacccg

SEQ ID NO: 137652 - DNA, 514 bp, Homo sapiens
  misc_feature: GYAE6OF01AILE4.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagttttgcaaagtggggtcccatcgaggttcagtggcagtggatctgggacagatttcactctcaccatcagtaatctgcaacgtgaagattttgctaacttattactgtcaacagtaattactaattgttttcgacctaagggacacgtactacaaattaacgaactgtaggctagctaccatctgtccttcactccttacccgccatctgtac

SEQ ID NO: 137653 - DNA, 553 bp, Homo sapiens
  misc_feature: GYAE6OF01BULOB.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggaaggggctggaatacattggaagtgtctctcatagtggaggttcctattacagtccgtctctcaagagtcgagtcaccatatctctggacacgtccagcaatcagttttccctgaagatgagttctgtgaccgccgctgacacgggtcgtttattactgtgcgagagacggctattatgtatttttggagttggttatttcgacacctagatcggacggggctcggaccccgtggggccagggaatacgtggtcaccgtctccgttacgcctccaccgacggcccagtccggtccttcccccgtcggccacccctccctcccaagcgtaccc

SEQ ID NO: 137654 - DNA, 508 bp, Homo sapiens
  misc_feature: GYAE6OF01DHIQB.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacacagaccagggacggccctaagctcctaatctatgctgcatccagtttgcaaagtgggtcccatcgaggttcagtggcagtggatcgtgggacagatttcactctcaccatcagtaatctgacaacgtgaagtattttgactaacttattactgtacaacagtaattacaattgtttacgacaagggacacgactaacaaattaacgaactgtgctgacactatctgtcttcacttcttcccgctactctgtac

SEQ ID NO: 137655 - DNA, 550 bp, Homo sapiens
  misc_feature: GYAE6OF01E5BBI.46.67.G01.1.454.CMB.1.raw
  modified_base (335)..(335): a, c, t, g, unknown or other
  misc_feature (335)..(335): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccaggggaaggggctggaatacattggaagtgtctctcatagtggaggttcctattacagtccgtctctcaagagtcgagtcaccatatctctggacacgtccagcaatcagttttcccngaagatgagttctgtgaccgccgctgacacgggcgttttatactgtgcgagagacggctattatgtatttttggagttggttatttcgactaccctagatcggacggggctcggaccccgtggggccagggaactacgtcggtcaccgtctccttagccctccaccgacgggcccatcccggtccttcccccgtggccaccctcctccaagcgcc

SEQ ID NO: 137656 - DNA, 510 bp, Homo sapiens
  misc_feature: GYAE6OF01A28QZ.46.67.G01.1.454.CMB.1.raw
  modified_base (503)..(503): a, c, t, g, unknown or other
  misc_feature (503)..(503): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggccctaagctcctaatctatgctgcatccagtttgcaaagtgggtcccatcgaggttcagtggcagtggatctgggacagatttcactctcaccatcagtaatctgcaacgtgaagtacttttgactaacttattactgtacaacagaattacaattgtttacgaccaaggacacgtactaactaataacgactgtagactgacacctatctgtacttcacttcttcccacctntctgtac

SEQ ID NO: 137657 - DNA, 519 bp, Homo sapiens
  misc_feature: GYAE6OF01B480G.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccggcaagtcggaacattgacactatttaaatggtatcaacatagaccagggacggccctaagctcctaatctatgctgcatccagtttgcaaagtggggtcccagtcgagttcagtggcgagtggatcgtgggacagtatttcactctcacatcagtatctgacaacgtgaagtatttagactaacttattactgtactaacagtaaactttacaatttgtttacggaccgtaagggtactacgaactaacaaacttaacgactgtgctagacactatctgtctcactccttccgacctatctgtac

SEQ ID NO: 137658 - DNA, 514 bp, Homo sapiens
  misc_feature: GYAE6OF01CBLGW.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagacagggacggccctaagctcctaatctatgctgcatccagtttgcaaagtgggtcccatcgagttcagtgcagtgatctgggacagatttcactctcaccatcagtaatctgcaacgtgaagtattttgactaacttattacttgtacaactagtaaattacaattgttttacggacctaagggactacgaactaacaaattaaacgaatgtgactgacacctatctgtcttcacttcctcccgcctatctgtac

SEQ ID NO: 137659 - DNA, 555 bp, Homo sapiens
  misc_feature: GYAE6OF01EZ3J8.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacgccctaagctcctaatctatgctgcatcctagtttgactaaaggtgggtcccatcgaggttcagtggcagtggatcgtgggactagtactttcactcctacacctatacagttaatctagactaacgtagaaagtatttgactaacttattactagtactaaacataaattaactagttacgtttcgaccgaaagggtactaacgtaacttaacgtaaaacgttaacgaacgttggtacgtctagtaccactatctagttcttacacttccttccacctctctgtac

SEQ ID NO: 137660 - DNA, 538 bp, Homo sapiens
  misc_feature: GYAE6OF01CBEVA.46.67.G01.1.454.CMB.1.raw
  modified_base (374)..(374): a, c, t, g, unknown or other
  misc_feature (374)..(374): n is a, c, g, or t
  modified_base (379)..(379): a, c, t, g, unknown or other
  misc_feature (379)..(379): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctctggggctgggtccgcagctcccgagggaaggggctggaatacattggaagtgtctctcatagtggaggttcctattacagtccgtctctcaagagtcgagtcaccatatctctggacacgtccagcaatctagttttcccngaagntgagttctgtgaccgccgctgacgacggtctttattactgtgcgagagacggctattatgtagtttttggagttggttatttcgactacctagtgtcggacgggctcggacccgtgggaccgagggactacgtggtcctacgtctccttgccctacccg

SEQ ID NO: 137661 - DNA, 587 bp, Homo sapiens
  misc_feature: GYAE6OF01EUQVP.46.67.G01.1.454.CMB.1.raw
  modified_base (218)..(218): a, c, t, g, unknown or other
  misc_feature (218)..(218): n is a, c, g, or t
  modified_base (228)..(228): a, c, t, g, unknown or other
  misc_feature (228)..(228): n is a, c, g, or t
  modified_base (581)..(581): a, c, t, g, unknown or other
  misc_feature (581)..(581): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtgggagacagtgtcaccatcacttgccgggnaagtcgaacntgacactattaatgtatacaacatagaccgaggaccgccctaagctacctatctatgctgcactcctagtttgacgtaaggtcgggtaccagtcggtaggttcgaggtggactaggtggatcgtagggaactagtatttcacgtctacacatacaagttatctagacgtaacgtagtaagtatttagacttaactttatacgtagtacaaacgtataactttaactaagtttcggtttacgacgtaacggactaacgtaactaactaaacttaaacgacgttggtacgtactacgacctactattaccgtgtttaccctacgtaccttcccgtttaccccgacttactccgtntaaccg

SEQ ID NO: 137662 - DNA, 669 bp, Homo sapiens
  misc_feature: GYAE6OF01B9FGZ.46.67.G01.1.454.CMB.1.raw
  modified_base (193)..(193): a, c, t, g, unknown or other
  misc_feature (193)..(193): n is a, c, g, or t
  modified_base (253)..(253): a, c, t, g, unknown or other
  misc_feature (253)..(253): n is a, c, g, or t
  modified_base (351)..(351): a, c, t, g, unknown or other
  misc_feature (351)..(351): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtggganacagtgtcacatcacttgccggacaagtcggaacattgacacttattaaagtgtatcaanatagaccaggacgccctaagctactaatctatgctgcatcctagtttcgacaaaggtcgggtaccagtcgtaggttcaggtgctagtgagtcgtgganagtattcactctacactatactaagttaactctagacgaacggttagtaaacgttagtttttacggacttaaacgtttaatttaacgttacgttaactaaacgtaaggtaaacttttaacgtaaagtttcggttttaccggaaccgtaaacggggtacctaaaccggtaaacttaaaacgtaaaacgtttaaacccgaaacgtttaggtaccggtaccttacggtaacccgtaaaccttagtttaccgttacggtttacctttacccgtaacgtttacccctttaccccggaccttaactttccgttaagtaaacccg

SEQ ID NO: 137663 - DNA, 570 bp, Homo sapiens
  misc_feature: GYAE6OF01BYOWM.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacactatttaaatggtatcaacatagacagggacggccctaagctcctaatctatgctgcactcctagtttgacaaaggtggggtacccagtcgaggttcaggtggcaggtggatcgtagggacagtatttcactctcaccatcaagtaatctgacaacgtagaagtattttgactaatttatactagtactaaatagtaaattaactaagtttcggtttacggaaccgtaacgggaacctaaccgtaaacttaaactaaagttaaaccgaacttaggtagacttacgaccaacgtattcgttgtaccttactacttcttccccgacttatcctagtac

SEQ ID NO: 137664 - DNA, 611 bp, Homo sapiens
  misc_feature: GYAE6OF01DRCXG.46.67.G01.1.454.CMB.1.raw
  modified_base (192)..(192): a, c, t, g, unknown or other
  misc_feature (192)..(192): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccgggcaagtcggaacattgacacctatttaaatgtatcaacatagaccagggacgccctaagctctaatctatgctgctatcctagtttgactaaaggtgggtcccagtcgaggttcagtgcagtggatcgtgggacagtatttcactctcaccatcagtaatctgactaacgtagaagttattttagactaactttattacttgtacaactagtaaattactaagtttgttttaccggaccgtaaagggtacctaacgtaaaccttaaaccgtaaaagtttaaacccggaaacgttacggttacggacttacggaccctaacccttaattccgtttcgttacctttcctaacctttccccgtttacccccgaccttaacgttcccgttaggttaaacc

SEQ ID NO: 137665 - DNA, 528 bp, Homo sapiens
  misc_feature: GYAE6OF01A0YV4.46.67.G01.1.454.CMB.1.raw
  modified_base (192)..(192): a, c, t, g, unknown or other
  misc_feature (192)..(192): n is a, c, g, or t
  modified_base (217)..(217): a, c, t, g, unknown or other
  misc_feature (217)..(217): n is a, c, g, or t
  modified_base (425)..(425): a, c, t, g, unknown or other
  misc_feature (425)..(425): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccgggnaagtcggaacattgacacctatttaaattggtatcaacatagaccagggacggccctaagctcctaatctatgctgcatccagtttgcaaagtgggtccatcgaggttcagtggcagtggatcgtgggacagtattcactctcaccatcagtaatctgacaacgtgaagtattttgactaacttattactgtacaactagtaacttanaattgttttacgacctaagggtacacgtaactaactaaattaacgaacgtagtcggactgactacctatctgttcttctacttccttacccgccattctgtac

SEQ ID NO: 137666 - DNA, 558 bp, Homo sapiens
  misc_feature: GYAE6OF01ATKR8.46.67.G01.1.454.CMB.1.raw
  modified_base (373)..(373): a, c, t, g, unknown or other
  misc_feature (373)..(373): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggccctaagctcctaatctatgctgcatccagtttgcaaagtgggtcccatcgagttcagtggcagtggatctgggacagatttcactctcaccatcataatctnacaacgtgaagtattttgactaacttattactagtacctaactagtaattactaagttgttttacggaccgtaacgggaactaaccggaacttaacgtaaaacttaaacgaacttggtacggtactcgaccgtacctatcttcgttccttactacttacccttacccgacctactccgtagtaac

SEQ ID NO: 137667 - DNA, 649 bp, Homo sapiens
  misc_feature: GYAE6OF01CKQD9.46.67.G01.1.454.CMB.1.raw
  modified_base (218)..(218): a, c, t, g, unknown or other
  misc_feature (218)..(218): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccggganaagtcggaacattgacactatttaaatgtatcaacatagacaggacgccctagctcctatctatgctgcatccagtttgactaaaggtcgggtacccagtccggaggtttcaggtggactaggtggatcgtgggacagtatttcgaactctacacctatactagtaactctagactaacggtagtaaagttattttaggaaccttaaacgtttattaaccgttagtaacctaaacgtaaggttaaactttaacgaaacgttttacgggtttttaccggaaccgtaacgggtaaccaaaccggtaaacctaaactaaaacgttaaaaccgaacgttaggttacggaccgttacgaaccgtaacctaacttcgttaccggttactttaaccgtacctttcccgttaccccgacctaacttcccgtggttaacc

SEQ ID NO: 137668 - DNA, 545 bp, Homo sapiens
  misc_feature: GYAE6OF01D0DL7.46.67.G01.1.454.CMB.1.raw
  modified_base (352)..(352): a, c, t, g, unknown or other
  misc_feature (352)..(352): n is a, c, g, or t
  modified_base (380)..(380): a, c, t, g, unknown or other
  misc_feature (380)..(380): n is a, c, g, or t
  modified_base (385)..(385): a, c, t, g, unknown or other
  misc_feature (385)..(385): n is a, c, g, or t
  modified_base (440)..(440): a, c, t, g, unknown or other
  misc_feature (440)..(440): n is a, c, g, or t
tcagactagcagtacacgaccggtgctcgatttagagtatacatattgggtttgggggaactcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtcgcctccatcagtgttggtttcttcgtggggctggggtccggcagcctcccgagggaaggggctggaatacattggaagtgtctctcatagtggaggttcctattacagtccgtctctcaagtagtcgagtcaccatatctntgacacgtccagcaatctagttttcccngaagntgagttctgtcgaccgccgctgacacgggtcgtttattactgtgcgagagacggntattatgtagttttggagttggtttatttcgactccctagactcggacggggcctcgaccccgtggggccgaggatacgtgtccaccgtctccttgccctacccg

SEQ ID NO: 137669 - DNA, 557 bp, Homo sapiens
  misc_feature: GYAE6OF01CR0XM.46.67.G01.1.454.CMB.1.raw
  modified_base (290)..(290): a, c, t, g, unknown or other
  misc_feature (290)..(290): n is a, c, g, or t
  modified_base (335)..(335): a, c, t, g, unknown or other
  misc_feature (335)..(335): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccgaggggaaggggctggaatacattggaagtgtctctcatagtggaggttcctattacagtccgtctctcaagngtcgagtcaccatatctctggacacgtccagcaatcagttttccngaagatgattctgtcgaccgccgctgacacgggtcttttaattactgtgcgagagacggctattatgtattttggagttgttatttcgactaccctagactcggacggggctcggaccccgtggggccgagggaactacgtgtccaccgtcctcttacgcctccaccgacggcccagtccgtccttccccgtcggtccctaccctccctaccaagcgtcccg

SEQ ID NO: 137670 - DNA, 521 bp, Homo sapiens
  misc_feature: GYAE6OF01EPE6O.46.67.G01.1.454.CMB.1.raw
  modified_base (518)..(518): a, c, t, g, unknown or other
  misc_feature (518)..(518): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctattaaattggtatcaacatagaccagggacggccctaagctcctaatctatgctgcatccagtttgcaaagtggggtcccatcgaggttcagtggcagtggatctgggacagtatttcactctcaccatcagtaatctgacaacgtgaagtattttgactaacttattactgtacaacagtaattactaattgttttacggaccaagggactacgaactaacaaattaaacgaactagtggctagacacctatctgttcttcacttccttcccgccatctntac

SEQ ID NO: 137671 - DNA, 556 bp, Homo sapiens
  misc_feature: GYAE6OF01ETGW0.46.67.G01.1.454.CMB.1.raw
  modified_base (281)..(281): a, c, t, g, unknown or other
  misc_feature (281)..(281): n is a, c, g, or t
  modified_base (336)..(336): a, c, t, g, unknown or other
  misc_feature (336)..(336): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccaggggaaggggctggaatacattggaagtgtctctcatagtggaggttcctattacagtccgtntctcaagagtcgagtcaccatatctctggacacgtccagcaatctagttttcccngaagatgagttctgtgaccgccgctgacacggggtcttttattacgtgtgcgagagacggctattatgtagttttggagttggttatttcgactaccctagacgtcggacggggctcggacccgtgggccagggtactacgtggtcaccgtctccttacgcctaccaccgacggcccacgtccgtccttcccccgtggccacccctcctccaagcgcccg

SEQ ID NO: 137672 - DNA, 519 bp, Homo sapiens
  misc_feature: GYAE6OF01E40IX.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggccctaagctcctaatctatgctgcatccagtttgcaaaggtgggtcccatcgaggttcagtggcagtggatcgtgggacagatttcactctcaccatcagtaatctgacaacgtgaagtattttgactaacttattactgtactaacagtaatttacaattgtttcggacctaagggactaacgtaactaactaaattaacgaactgtagactgacactatctgtcttcactcctcccgcactctgtac

SEQ ID NO: 137673 - DNA, 573 bp, Homo sapiens
  misc_feature: GYAE6OF01B3L5O.46.67.G01.1.454.CMB.1.raw
  modified_base (193)..(193): a, c, t, g, unknown or other
  misc_feature (193)..(193): n is a, c, g, or t
  modified_base (218)..(218): a, c, t, g, unknown or other
  misc_feature (218)..(218): n is a, c, g, or t
  modified_base (386)..(386): a, c, t, g, unknown or other
  misc_feature (386)..(386): n is a, c, g, or t
  modified_base (393)..(393): a, c, t, g, unknown or other
  misc_feature (393)..(393): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtggganacagtgtcaccatcacttgccgggnaagtcggaacatgacactatttaaatggtatcaacatagacagggacgccctaagctcctaatctatgctgcactcctagtttcgacgaaaaggtcggggtacccagtcgtaggttcaggtggacagtgatcgtagggacagtatttcactctcacatcagtatcgtnacaagtntaagtatttacgacttaacttattactatacaaataagtaaatttactaactttggtttaccgaaccgtaaagggtacctaacggtaaccttaaactaaaacgttaaacgaacttggtacgacttacgaccaactatcttacgtccttacacttccctccccgaactacttcgttgtaac

SEQ ID NO: 137674 - DNA, 559 bp, Homo sapiens
  misc_feature: GYAE6OF01EJDFA.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgaaccagtctccatcctccctgtctgcaaccgtgggagacagtgtcaccatcacttgccgggcaagtcggaacattgacacctatttaaattggtatcaacatagaccagggacgccctaagctcctaatctatgctgcatccagtttgcaaaggtcgggtcccagtcgaggttcagtggcagtggatcgtgggacagtatttcactctcaccatcagtaactctagactaagtgtaagtatttagactaactttattactagtacaactagtaattgactaagttcgtttaccgaaccgtaagggacaacgtaactaacgaaattaaacgacttagtacggactcgactaacctattccgttacgttccttacctacttcccttacccgaccttagtcgtaacg

SEQ ID NO: 137675 - DNA, 553 bp, Homo sapiens
  misc_feature: GYAE6OF01AJZG4.46.67.G01.1.454.CMB.1.raw
  modified_base (332)..(332): a, c, t, g, unknown or other
  misc_feature (332)..(332): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctctggggctgggtccggcagctcccagggaagggctggaatacattggaagtgtctctcatagtggaggttcctattacagtccgtctctcaagagtcgagtcaccatatctctggacacgtccagcaatcagttttcccngaagatgagttctgtgaccgccgctgacacgggtcgttttatactgtgcgagagacggctattatgtattttggagttggttatttcgactacctagatcggacggggctcggaccccgtggggccaggggactacgtggtcaccgtctccgttagccctccaccgacggccccagtccggtccttcccccgtggccctaccctccctccaagcgtacccg

SEQ ID NO: 137676 - DNA, 499 bp, Homo sapiens
  misc_feature: GYAE6OF01BQU6U.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggccctaagctcctaatctatgctgcatccagtttgcaaagtgggtcccatcgaggttcagtggcagtggatctgggacagatttcactctcaccatcagtaatctgcaacgtgaagattttgactaacttattactgtcaacagaattacaatgttttcgccaagggacacgactacaaattaacgaactgtgactgacaccatctgtcttcatcttcccgcatctgtac

SEQ ID NO: 137677 - DNA, 604 bp, Homo sapiens
  misc_feature: GYAE6OF01ERR2X.46.67.G01.1.454.CMB.1.raw
  modified_base (337)..(337): a, c, t, g, unknown or other
  misc_feature (337)..(337): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccgaggggaaggggctggaatacattggaagtgtctctcatagtggaggttcctattacagtccgtctctcaagagtcgagtcaccatatctctggacacgtccagcaatctacgttttccngaagatgagttctgtcgaccgccgctgacgacgggtcgttttattacgtgtgcgagacgacggtctattatgttagttttggagtttggttatttcgactacccgtagacgtcggacggggtctccggtaccccgtggggacccgaagggtaactacgtcggtaccaccgttccgtccgttacgccccttaccaacccgaacgggccctacggtcccggttcccttcccccgtcggccctacccccgtcctaccgaagccgtacccg

SEQ ID NO: 137678 - DNA, 523 bp, Homo sapiens
  misc_feature: GYAE6OF01DCLCU.46.67.G01.1.454.CMB.1.raw
  modified_base (217)..(217): a, c, t, g, unknown or other
  misc_feature (217)..(217): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggnaagtcgaacattgacacctatttaatgtatcaacatagaccaggacgccctaagctacctaatctatgctgcatccagttgcaaagtcgggtccatcgagttcagtgcagtggatcgtgggacagtatttcactctcacatcagtaatctgacaacgtgaagtatttagactaactttatactgtactaacagtaattacaatttgtttacgaccgtaaagggtacctacgaacttaactaaattaacgaactagtggactagacacctattctgtcttacacgttccttacccgactatctgtac

SEQ ID NO: 137679 - DNA, 701 bp, Homo sapiens
  misc_feature: GYAE6OF01CEBCV.46.67.G01.1.454.CMB.1.raw
  modified_base (211)..(211): a, c, t, g, unknown or other
  misc_feature (211)..(211): n is a, c, g, or t
  modified_base (246)..(246): a, c, t, g, unknown or other
  misc_feature (246)..(246): n is a, c, g, or t
  modified_base (275)..(275): a, c, t, g, unknown or other
  misc_feature (275)..(275): n is a, c, g, or t
  modified_base (405)..(405): a, c, t, g, unknown or other
  misc_feature (405)..(405): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccagactggtgaggccttcggagaccctgtccctcacctgcgctgtctctggtcncctcatcagtgtggtttctcgtggggctgggccgnagcctaccgaggggaagggctggaactanagttggaagtgtctctacagtaggtggagtttcctattacgagttccgtctctacaaagcgtcgagtccaacctattactctcgtaggaccacgtaccaagctaattcgttacgttttcccaggaaagtntgtacgttcgtagtccgacccggtccgtacgtacggaaccgtacggggttacttttaacgttacgtggttacggacggtaagacggtaaccggttattaagtttagttaggtttaagtttttagggaggtttagtttaacttaccgtaacctaacccgtaggtaccggtaccgggtaccgggggtacccttacccggtaccccgggtagggggaacccggtaaggggtaaaccttacggttaccgggtaccctaccggttacccttaacccgtttaccggccccttaacccccggg

SEQ ID NO: 137680 - DNA, 575 bp, Homo sapiens
  misc_feature: GYAE6OF01DLQHQ.46.67.G01.1.454.CMB.1.raw
  modified_base (217)..(217): a, c, t, g, unknown or other
  misc_feature (217)..(217): n is a, c, g, or t
  modified_base (390)..(390): a, c, t, g, unknown or other
  misc_feature (390)..(390): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggnaagtcgaacattgacacctatttaaatggtatcaacatagaccagggacgccctaagctctaatctatgctgcatccagtttgcaagtgggtcccagtcgaggttcagtgcagtcggatcgtgggacagtatttcactctcacctagtctagtaatctgacaacgtgtaagtnttttagactaacttatactgtacaactagtaaattacaagttcgttttaccggacctaaaggggacctaacggtaacttaaacgtaaactttaacggaaacttggttacggacttcggacctaacccgtaattcgttagttccctttacactttacccgttcccgaccctattccctggtaaacc

SEQ ID NO: 137681 - DNA, 576 bp, Homo sapiens
  misc_feature: GYAE6OF01DRTWO.46.67.G01.1.454.CMB.1.raw
  modified_base (171)..(171): a, c, t, g, unknown or other
  misc_feature (171)..(171): n is a, c, g, or t
  modified_base (295)..(295): a, c, t, g, unknown or other
  misc_feature (295)..(295): n is a, c, g, or t
  modified_base (563)..(563): a, c, t, g, unknown or other
  misc_feature (563)..(563): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtncctcatcagtagtggtttcttcgtggggctgggtccggcagcctcccgaggggaaggggctaggaatacgagttggaagtgtctctcagtagtggagttcctattacagtccgtctctacaagngtcgagtcaccatatctctggacacgtccagcaatctacgttttccagaagtatgtagttctgtcgaccgccgctggacgtacgggtctttatactgtgacgagacgacggtcttattagtgttagttttggagttaggttattcgactaccgtagactcgggacgggctaccggcccggtgggccgaaggtactcgtcggtccaccgtcctcgtacgccctaccgaccgtacggcccacgtccgtcccttcccgcgcccaccctccnccgagcgtacccg

SEQ ID NO: 137682 - DNA, 528 bp, Homo sapiens
  misc_feature: GYAE6OF01D5BOV.46.67.G01.1.454.CMB.1.raw
  modified_base (508)..(508): a, c, t, g, unknown or other
  misc_feature (508)..(508): n is a, c, g, or t
  modified_base (524)..(524): a, c, t, g, unknown or other
  misc_feature (524)..(524): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctctggggctgggtccggcagctcccagggaaggggctggaatacattggaagtgtctctcatagtggaggttcctattacagtccgtctctcaagagtcgagtcaccatatctctggacacgtccagcaaatcagttttccctgaagatgagttctgtcgaccgccgctgacgacgggcgtttattactgtgcgagagacggtctattatgtattttggagttggttatttcgacacctagatcgacggggctcgacccgtgggccagggatacgtgtcacgtctccttagcctcaccgacggccatcgtctccccnggccaccctcctcagngccg

SEQ ID NO: 137683 - DNA, 508 bp, Homo sapiens
  misc_feature: GYAE6OF01A92VN.46.67.G01.1.454.CMB.1.raw
  modified_base (505)..(505): a, c, t, g, unknown or other
  misc_feature (505)..(505): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatgtatcaacatagaccagggacggccctaagctcctaatctatgctgcatccagtttgcaaagtgggtcccatcgaggttcagtggcagtggatcgtgggacagtatttcactctcaccatcagtaatctgctaacgtgaagtattttagctaacttattactgtacaacagtaattacaattgtttacgactaagggactacgaactaacaaattaacgaatgtgctgacacatctgttctcacttcttacccgcatctntac

SEQ ID NO: 137684 - DNA, 517 bp, Homo sapiens
  misc_feature: GYAE6OF01EU7L8.46.67.G01.1.454.CMB.1.raw
  modified_base (342)..(342): a, c, t, g, unknown or other
  misc_feature (342)..(342): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattgtatcaacatagaccagggacggccctaagctcctaatctatgctgcatcctagtttgcaagtgggtcccatcgaggttcagtggcagtggatcgngggacagtatttcactctcaccatcagtaatctgcaacgtgaagtatttgactaacttattactgtacaacagtaattacaattgtttcggaccaagggactaacgtactaactaaattaacgaactgtgactgacacctatctgtcttcacttccttcccgacctactctgtac

SEQ ID NO: 137685 - DNA, 511 bp, Homo sapiens
  misc_feature: GYAE6OF01BE27J.46.67.G01.1.454.CMB.1.raw
  modified_base (482)..(482): a, c, t, g, unknown or other
  misc_feature (482)..(482): n is a, c, g, or t
  modified_base (486)..(486): a, c, t, g, unknown or other
  misc_feature (486)..(486): n is a, c, g, or t
  modified_base (504)..(504): a, c, t, g, unknown or other
  misc_feature (504)..(504): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcgaacattgacacctatttaaatggtatcaacatagaccagggacggccctaagctcctaatctatgctgcatccagtttgcaaagtggggtcccatcgaggttcaggtggcagtggatcgtgggacagatttcactctcaccatcagtaatctgcaacgtgaagtattttgctaacttattactgtacaacagtaattacaattgtttcggaccaagggactacgtactaacaaattaaacgaactgtaggctgctaccntctntctctatccttcccgacntctgtac

SEQ ID NO: 137686 - DNA, 581 bp, Homo sapiens
  misc_feature: GYAE6OF01EBE0Q.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacttatttaaattggtatcaacatagaccgagggaccgccctaagcctacctaatctatgctgcatcctagtttgacaaaggtcgggtacccagtcgtaggttcaggtggctaggtggtatcgtgggacagtattcactctcacctatcaatatctgactaacgtagtaagttatttgtactaactttattactatacaactaagtaattaactagttacgtttacgaaccgtaaggaactaacgtaacctaataaacttaaacgaacgttaggtacgtacgtacgtaccgtacctattacttcgttaccttactacgttacccttacccgaccttatccgtgtaacg

SEQ ID NO: 137687 - DNA, 509 bp, Homo sapiens
  misc_feature: GYAE6OF01BNUI3.46.67.G01.1.454.CMB.1.raw
  modified_base (413)..(413): a, c, t, g, unknown or other
  misc_feature (413)..(413): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctattaaatggtatcaacatagaccagggacgccctaagctcctaatctatgctgcatccagtttgcaaagtgggtcccatcgaggttcagtggcagtggatcgtgggacagatttcactctcaccatcagtaatctgacaacgtagaagtattttgactaacttattactgtacaanagtaattactaattgtttacgactaagggacaacgaactaacaaattaacgaactgtagctagcactatctgtcttcattctaccgacatctgtac

SEQ ID NO: 137688 - DNA, 578 bp, Homo sapiens
  misc_feature: GYAE6OF01AHPIF.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacggccctaagctcctaatctatgctgcatccagtttgcaaagtgggtcccatcgaggttcagtggcagtggatcgtgggacagatttcactctcacatcagtaatctagcaacgtgaagtattttgactaacttattacttgtacctaacagtaattactaagttcgttttacggaccgtaagggtacaacgtaacttaactaaaacgttaaaccgaacgttagtacggtacctagacccgtaaccgtattacttcggttacctttaccctaacttccctttacccccggaccctaacgttcctgttaaccg

SEQ ID NO: 137689 - DNA, 526 bp, Homo sapiens
  misc_feature: GYAE6OF01BMGQD.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacgccctaagctcctaatctatgctgcatccagtttgcaaagtcggggtcccatcgaggttcagtggcagtggatctgggacagtatttcactctcaccatcagtaatctagcaacgtgaaagtattttgactaacttattactgtacaacagtaattacaagttgtttacggacctaagggactacgaacttaacaaattaacgaacgtgtacggactggacactatctgtcttcacttccttcccgactactcgtgtac

SEQ ID NO: 137690 - DNA, 505 bp, Homo sapiens
  misc_feature: GYAE6OF01BN8HF.46.67.G01.1.454.CMB.1.raw
  modified_base (496)..(496): a, c, t, g, unknown or other
  misc_feature (496)..(496): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggccctaagctcctaatctatgctgcatccagtttgcaaagtgggtcccatcgagttcagtggcagtggatctgggacagatttcactctcaccatcagtaatctgcaacgtgaagtattttgctaaacttattactgtacaacagtaattacaattgttttacggacctaagggacacgactaacaaattaaacgaactgtagctgcaccatctgtcttcatctccncatctgtac

SEQ ID NO: 137691 - DNA, 500 bp, Homo sapiens
  misc_feature: GYAE6OF01BMY1V.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaaattggtatcaacatagaccagggacggccctaagctcctaatctatgctgcatccagtttgcaaagtgggtcccatcgaggttcagtggcagtggatctgggacagatttcactctcaccatcagtaatctgcaacgtgaagattttgcaacttattactgtcaacagaattacaatgttttcgccaaggacacgactaacaaattaaacgaactgtggctgcaccatctgtcttcatcttcccgccatctgtaac

SEQ ID NO: 137692 - DNA, 553 bp, Homo sapiens
  misc_feature: GYAE6OF01A6J3B.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggaaggggctggaatacattggaagtgtctctcatagtggaggttcctattacagtccgtctctcaagagtcgagtcaccatatctctggacacgtccagcaatcagttttccctgaagatgagttctgtgaccgccgctgacacgggctttatactgtgcgagagacggctattatgtattttggagttggttatttcgacacctagatcggacggggctcgacccgtgggccgagggatacgtggtcaccgtctccgttagccctccaccgaacgggcccctagtccggttcccttcccccgtcggcccacccctccctcccaagcgtcccg

SEQ ID NO: 137693 - DNA, 526 bp, Homo sapiens
  misc_feature: GYAE6OF01BS3VK.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggccctaagctcctaatctatgctgcatccagtttgcaaagtgggtcccatcgagttcagtgcagtgatctgggacagtatttcactctcaccatcagtaatctgacaacgtgaagtattttagactaactttattactgtacaacagtaaattacaatttgtttacggaccaagggactaacgaacttaacaaattaaacgaacttgtagctgactacctatctgtcttacacttccttacccgactactctgtaac

SEQ ID NO: 137694 - DNA, 519 bp, Homo sapiens
  misc_feature: GYAE6OF01D7RD0.46.67.G01.1.454.CMB.1.raw
  modified_base (307)..(307): a, c, t, g, unknown or other
  misc_feature (307)..(307): n is a, c, g, or t
  modified_base (344)..(344): a, c, t, g, unknown or other
  misc_feature (344)..(344): n is a, c, g, or t
tcagactagcagtacacgaccggtgctcgatttagagtatacatattgggtttgggggagtctcggtcaggacacagcatggacatgagggtccccgctcagctcctggggctcctgctactctggctccgaggtgccagatgtgacatcgtagctgacccagtctccatcctccctgtctgcaaccgtgggagacagtggtcaccatcacgttggccggcaagtcggaacattgacacctattaaatggtatcaacatagaccagggacggccctaagctcctaatctatgctgcatccgagtttncaaagtgggtcccatcgagttcagtgcagtggatcgnggacagtatttcactctcaccatacagtaatctagactaacgtgaaagtatttcgactaactttattaactgtacaactagtaattacaattgtttacgaccaaggacacgaactacaaattaaccgaatgtgactgactacatctgtcttcacttcttacccgactatctgtac

SEQ ID NO: 137695 - DNA, 506 bp, Homo sapiens
  misc_feature: GYAE6OF01BEM85.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggccctaagctcctaatctatgctgcatccagtttgcaaagtggggtcccatcgaggttcagtggcagtggatctgggacagatttcactctcaccatcagtaatctgcaacgtgaagtattttgctaactttattactgtcaacagtaattacaattgttttcggacctaagggacacgactaacaattaacgaactgtgctgacaccatctgtcttcatcttcccgcactctgtac

SEQ ID NO: 137696 - DNA, 516 bp, Homo sapiens
  misc_feature: GYAE6OF01EUOJG.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacgccctaagctcctaatctatgctgcatccagtttgcaaagtgggtcccatcgaggttcagtggcagtggatcgtgggacagtatttcactctcaccatcagtatctgcaacgtgaagtatttgcttacttattactgtcaacagtaattacaattgttttcggacctaagggactacgtaactaactaaattaaacgaactgtaggctagacactatctgtcttcacttcttcccacctactctgtac

SEQ ID NO: 137697 - DNA, 573 bp, Homo sapiens
  misc_feature: GYAE6OF01EQ845.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacgccctaagctcctatctatgctgcatccagtttgcaaggtgggtcccatcgagttcagtggcagtggatcgtgggacagtatttcactctcaccatcagtaatctgactaacgtgtaagtatttgactaacttatttactagttacaaactaagtaaatttaactaagtttcgttttaccggaccgtaaacgggtacctaacgtaacttaaacctaaaattaaacgaacttggttacggctacgacctaaccctattacttcgttacctttacaccttcccttaccccgacctacttctggtaac

SEQ ID NO: 137698 - DNA, 532 bp, Homo sapiens
  misc_feature: GYAE6OF01D12BB.46.67.G01.1.454.CMB.1.raw
  modified_base (212)..(212): a, c, t, g, unknown or other
  misc_feature (212)..(212): n is a, c, g, or t
  modified_base (248)..(248): a, c, t, g, unknown or other
  misc_feature (248)..(248): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggcctttcggagaccctgtccctcacctgcgctgtctctggtncctcatcagtagtggtttctctggggctgggtccgnagctccagggaagggctggaatacattggaagtgtctctcatagtggaggttcctattacagtccgtctctcaagagtcgagtcaccatatctctggacacgtccagcaatcagttttccctgaagatgagttctgtgaccgcgctgacacgggtcgtttattactgtgcgagagacggctattatgtagttttggagttggtttatttcgactacctagatcggacggggctcgacccgtggggccagggaatacgtggtctaccgtctccgtagcctacccg

SEQ ID NO: 137699 - DNA, 514 bp, Homo sapiens
  misc_feature: GYAE6OF01CMNFT.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtgggagacagtgtcaccatcacttgccgggcaagtcggaacattgacactatttaaattggtatcaacatagaccagggaccggccctaagctcctaatctatgctgcatcccagttttgcaaagtggggtcccatcggaggttcagtggcaggtggatcgtgggacagattttcactctcaccatcagtaatctgcaacgtgaagtattttgactaacttattactgtacaacagtaattactaattgtttcgacaggacacgaactaacaaattaacgaactgtgactgcacatctgtcttcacttccttacccgctatctgtac

SEQ ID NO: 137700 - DNA, 630 bp, Homo sapiens
  misc_feature: GYAE6OF01B3I06.46.67.G01.1.454.CMB.1.raw
  modified_base (296)..(296): a, c, t, g, unknown or other
  misc_feature (296)..(296): n is a, c, g, or t
  modified_base (350)..(350): a, c, t, g, unknown or other
  misc_feature (350)..(350): n is a, c, g, or t
  modified_base (359)..(359): a, c, t, g, unknown or other
  misc_feature (359)..(359): n is a, c, g, or t
  modified_base (385)..(385): a, c, t, g, unknown or other
  misc_feature (385)..(385): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctcgtggggctgggtccgcagcctcccgaggggaaggggctagggaatacagttgggaagttgtctctcagtagtggaggttcctattacagtccgtctctcaagngtcgagtcaccatactctctggacacgtccagcaatctacgttttccagaagtntgtagttcngtcgaccgtccgctgacgtacgggtnttttagttactggtcgacgtagacggacggtcttattagtgtttagtttttgggagtttaggtttactttccgtaacgtacccgttagtacgtcgggtaacggggtccctacccggtaccccggttggggaccgaagggtaactacgtcggtcctacccgtcttccgtacgtccctaccgaccgacggtcccacgttccgtacccttcccccgacgccctaccctacccaccgagtccgtacccg

SEQ ID NO: 137701 - DNA, 563 bp, Homo sapiens
  misc_feature: GYAE6OF01BG8GS.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccggcaagtcggaacattgacacctatttaaatggtatcaacatagaccagggacgccctaagctcctaatctatgctgcatccagtttgcaaagtgggtcccagtcgaggttcagtggctagtggatcgtggacagtattcactctcaccatcagtaatctagactaacgtgaagtatttgactaactttattactgtactaactagtaattacaagttcgtttacggaccgtaagggacctaacgaacttaacgtaaacttaaaccgaacttaggtacggactacgaccgtaacctattacgttcgttaccttactaacgttccttaccccgtacctacttccgtgtaac

SEQ ID NO: 137702 - DNA, 586 bp, Homo sapiens
  misc_feature: GYAE6OF01AQ1Z3.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacggccctaagctcctaatctatgctgcatccagtttgcaaagtgggtcccatcgaggttcagtgacagtgatcgtggactagatttcactctcaccatcagtatctgacaacgtgaagtatttagctaacttattactagtactaacaagtaactttaacaactttcgttttccggaaccgtaagggacctaacgtaacttaacgtaaactttaaacgaacgttggttacgggtacttacgacccgtaaccgtattccgttcgttacctttacctacgtttaccccgttaccccggtaccctaacttcgtacgttaaccg

SEQ ID NO: 137703 - DNA, 658 bp, Homo sapiens
  misc_feature: GYAE6OF01DDDFK.46.67.G01.1.454.CMB.1.raw
  modified_base (219)..(219): a, c, t, g, unknown or other
  misc_feature (219)..(219): n is a, c, g, or t
  modified_base (428)..(428): a, c, t, g, unknown or other
  misc_feature (428)..(428): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatccctccctgtctgcaaccggtgggagacagtgtcaccatcacttgccgggnaagtcgaacattgacacttatttaaattggtatacaacatagaccagggaccgccctaagcctactaatctatgctgcactccgtagtttgacgtaaaggtcgggtcccagtcgaggttcagtggcgtaggtggatcgtagggaactaggtactttcaccttctaccacctatacctaagttaactctacgactaacggtagtaagttntttacgaacttaactttacttaactacgtaacaaacgtaagttaaactttaacgtaagtttcggttttaaccggaaccgtaacgggtaacctaacggtaaaccttaaacgtaaaacgttaaaccgtaacgttaggtacggtaccgttacgaaccgtaacctagtttacttccgttacctttaccgtaaccttcccgtttaccccgtacttacttcccgttaggttaaacc

SEQ ID NO: 137704 - DNA, 504 bp, Homo sapiens
  misc_feature: GYAE6OF01EZMFN.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaaattggtatcaacatagaccagggacggccctaagctcctaatctatgctgcaatccagtttgcaaagtgggtcccatcgaggttcagtggcagtggatctgggacagatttcactctcaccatcagtaatctgcaacgtgtaagattttgactaacttattactgtcaactagaattacaatgtttcggactaagggactagactacaaattaacgaactgtgctgacaccatctgtcttcactcttcccgcatctgtac

SEQ ID NO: 137705 - DNA, 535 bp, Homo sapiens
  misc_feature: GYAE6OF01CRIJN.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaaccgtgggagacagtgtcaccatcacttgccgggcaagtcggaacattgacacctatttaaatgtatcaacatagaccagggacgccctaagctcctaatctatgctgcatccagtttgacaaagtgggtcccatcgagttcagtgcagtgatcgtggacagatttcactctcaccatcagtaatctagactaacgtgtaaagtatttagactaacttattaactagtacaactaagtaattaactaattcgttttacgacctaagggactaacgtaactaacaaattaacgaactagtagacgtagactaacctatactcgttcttactacttccttaccgctactctgtaac

SEQ ID NO: 137706 - DNA, 560 bp, Homo sapiens
  misc_feature: GYAE6OF01CS3OH.46.67.G01.1.454.CMB.1.raw
  modified_base (212)..(212): a, c, t, g, unknown or other
  misc_feature (212)..(212): n is a, c, g, or t
  modified_base (382)..(382): a, c, t, g, unknown or other
  misc_feature (382)..(382): n is a, c, g, or t
  modified_base (458)..(458): a, c, t, g, unknown or other
  misc_feature (458)..(458): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtcncctccatcagttagttggtttctcgtggggctggggtccggcagcctccgagggagggctggaatacagttggaagtgtctctcagtagtggtagttcctattacagtccgtctctcaagagtcgagtcaccatactctctggacacgtcagcatctacgtttccagaanatgtgttctgtcgaccgccgctgacgtacggtcgtttactcgtgtgcgagagacggtctattagtgttagttttgngttagttattcgtactaccgtagtacgtcgggacgggtctaccggacccgtgggaccgtagggactacgtcgtaccgtaccgttctccgtcgtccctacccg

SEQ ID NO: 137707 - DNA, 623 bp, Homo sapiens
  misc_feature: GYAE6OF01A9YBK.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacactatttaaatggtatcaacatagaccgagggaccgaccctaagctcctaatctatgctgctactcctagtttcgactaaggtcgggtccctagtcggtagttcaggtgacaggtgatcgtaggacagtattcactctacacctatacgagtaactctagactaacgtagtaattagttttagaacttaacttagtttactcgttactaaacgaagttaactttaactaagtttcgtttacggaaccgtaaacgggtaactaaaccgtaacttaaacctaaaacgttaaaccgtaaacgttcggtacggtacctacggacctaaccgtatttaccgtacgttacctttacaccgtttacccttacccccgactacttccgtacggtaacc

SEQ ID NO: 137708 - DNA, 603 bp, Homo sapiens
  misc_feature: GYAE6OF01CVVPV.46.67.G01.1.454.CMB.1.raw
  modified_base (250)..(250): a, c, t, g, unknown or other
  misc_feature (250)..(250): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagttggtttctcgtggggctgggtccgnagcctccgagggaagggctggaatacattggaagtgtctcgtcagtagtggtagttcctattacgagttccgtctctacaagagtcgagtcaccatactctcgtggacacgtccagcaatcgtaacgttttccgagaacgtatagtagttcgtgtcgacccgtccgtatgacgacgggtactttattacgtggttacgacgaagacggtacggtcttaagttacgttgtaagttttttgggaagttggtttaacttcgaacctaccgtagacgttcggaccggggtcttccggaccccggtgggaccaggggtaactacgtcggtacctacgtcctccgttacgccgtacccg

SEQ ID NO: 137709 - DNA, 516 bp, Homo sapiens
  misc_feature: GYAE6OF01BGWUV.46.67.G01.1.454.CMB.1.raw
  modified_base (511)..(511): a, c, t, g, unknown or other
  misc_feature (511)..(511): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctattaaattggtatcaacatagaccagggacggccctaagctcctatctatgctgcatccagtttgcaaagtgggtcccatcgaggttcagtggcagtggatcgtggacagatttcactctcaccatcagtaatctgctaacgtgaagtatttcgactaacttattactgtacaatagtaattacaattgtttacggacctaagggacaacgtactaactaaattaacgaacgtgtacgctagcgtacctatctgtaccttcacttctctcgctntctag

SEQ ID NO: 137710 - DNA, 534 bp, Homo sapiens
  misc_feature: GYAE6OF01AT2EH.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggacatgacacctatttaaattgtatcaacatagaccagggacgccctaagctcctaatctatgctgcatccagtttgctaaaggtgggtccagtcgaggttcaggtggcaggtggatcgtgggacagtattcactctcactatcagtatctgactaacgtgaatagtttagactaacttatttactagtacaactagtaattcgataagtttcggtttaccgaccgaagggtaccacgtaactaacaaattaaccgaatgtgactgactacctatctcgttacttacgtacttccttacccgcctgtctag

SEQ ID NO: 137711 - DNA, 504 bp, Homo sapiens
  misc_feature: GYAE6OF01BHY3M.46.67.G01.1.454.CMB.1.raw
  modified_base (380)..(380): a, c, t, g, unknown or other
  misc_feature (380)..(380): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacactatttaaatggtatcaacatagaccagggacgccctaagctcctaatctatgctgcatccagtttgcaaaggtgggtcccatcgaggttcagtggcagtgatcgtgggacagtattcactctcacatcagtaatctagcaacgtnaagtatttgactaacttattactgtacaacagaattacaattgtttacgacgaaggacacgactaacaaattaacgaactgtagctagcacatctgtcttcacttccttacccgcactctgtac

SEQ ID NO: 137712 - DNA, 511 bp, Homo sapiens
  misc_feature: GYAE6OF01A7R7N.46.67.G01.1.454.CMB.1.raw
  modified_base (491)..(491): a, c, t, g, unknown or other
  misc_feature (491)..(491): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacgccctaagctcctaatctatgctgcatccagtttgcaaagtggggtcccatcgaggttcagtggcagtggatcgtgggacaggtatttcactctcaccatcagtaatctagcaacgtgaagtattttgactaacttattactgtacaacagtaaattacaattgttttcgacctaagggacacgtaactaacaaattaacgactgtgctgcactatctgtctnacttcctcccgcatctgtac

SEQ ID NO: 137713 - DNA, 551 bp, Homo sapiens
  misc_feature: GYAE6OF01B2RJX.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctctggggctgggtccggcagctcccgaggaaggggctggaatacattggaagtgtctctcatagtggaggttcctattacagtccgtctctcaagagtcgagtcaccatatctctggacacgtccagcaatcagttttccctgaaacgatgagttctgtgaccgccgctgacacgggcgtttattactgtgcgagagacggctattatgtatttttggagtttggttattttcgtactaccctagacttcggacgggggtctccggaccccgtggggcccacgggaatacgtcggtcacccgtctccttcgccctacccg

SEQ ID NO: 137714 - DNA, 574 bp, Homo sapiens
  misc_feature: GYAE6OF01EKXD7.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacactattaaatgtatcaacatagaccaggacgccctaagctcctaatctatgctgcatccagtttgcaaagtgggtcccatcgaggttcagtggcagtggatcgtgggacagatttcactctcacatcagtaatctgcaacgtgaagtatttgctaactttattactgtacaactagtaattaactaagttcggttttacggaacctaagggtaacctaacgtaaccttaaacgtaaacttaaaccggaacttacggtacggtaccttaggacctaacctattaccttggttaccctttacctaacgtttcccttacccccgacctacttccgtgttaaccg

SEQ ID NO: 137715 - DNA, 622 bp, Homo sapiens
  misc_feature: GYAE6OF01BKZOW.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtcgtcaccatcacttgccgggcaagtcggaacattgacacttatttaatgtatcaacatagaccagggaccgccctaagctacctaatctatgctgcactcctagtttacgactaaaggtcggggtaccccagttccggtaggtttcaaggttcggctaagggtggatcggtagggacagtatttcaactcctctaacctatacgaacgtattcgtagtacgtaacggtagtaagttattttacggacttaaacgtttacttaactcgttaccaaataagtaaacttactaaagttcggtttacgaaccgtaacgggtaactaacgtaacttaaacgtaaattaaaccggtaactgtacggactcgaaccctactagttcttcgttccttactaccgttcccttacccggattactcctagtaacc

SEQ ID NO: 137716 - DNA, 747 bp, Homo sapiens
  misc_feature: GYAE6OF01B4E3U.46.67.G01.1.454.CMB.1.raw
  modified_base (193)..(193): a, c, t, g, unknown or other
  misc_feature (193)..(193): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtggganacagtgtcaccatcacttgccgggacaagtcgaacattgacactatttaaatgtatcaacatagacagggaccgccctaagctactaatctatgctgcatcctagtttacgacgaaaggttcggggtacccctagttaccggtaggtttaccgaaggttcgggaccgtagggttagggtaacgttccggttagggggaaacctaacgggttaactttttccgaaccctttaccgtaccgaaacccgtaacttaccgtaagtttaaacttccgtacggtaaccgtaaacggttaggtaaaagtttacgtttttacggaacctttaaacgttttaacgtttaacgttacgttaactaaacgtaaggttaaaacttttaacgtaaacgttttcggttttaaccggaaccgtaaacggggtacctaaaccgtaacttaaacgtaaaacgtttaaaccgaaccgttagggtacgtaccgttacgacctaaccgtattacgttcgttaccttacctaaccgtttcccttacccccggtacttaacgttccgtagttaacg

SEQ ID NO: 137717 - DNA, 552 bp, Homo sapiens
  misc_feature: GYAE6OF01DIB4D.46.67.G01.1.454.CMB.1.raw
  modified_base (332)..(332): a, c, t, g, unknown or other
  misc_feature (332)..(332): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctcgtggggctgggtccgcagctcccgaggggagggctggaatacattggaagtgtctctcatagtggaggttcctattacagtccgtctctcaagagtcgagtcaccatatctctggacacgtcagcaatcagttttcccngaagatgagttctgtgaccgccgctgacacgggtcgtttattactgtgcgagagacggctattatgtattttggagttgttatttcgactaccctagtatcggacggggctcgaccccgtggggccagggatactggtcaccgtctccttagcctccaccgaacgggcccagtccggtccttcccccgtcggtccctaccctccctaccaagcgtacccg

SEQ ID NO: 137718 - DNA, 589 bp, Homo sapiens
  misc_feature: GYAE6OF01EMKMK.46.67.G01.1.454.CMB.1.raw
  modified_base (222)..(222): a, c, t, g, unknown or other
  misc_feature (222)..(222): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggagacagtgtcacatcactgcggcaagtcgaacntgacactattaaatgtatcaacatagaccagggaccgccctaagctcctaatctatgctgcactcctagtttcgacgtaaaggtcgggtcccagtacgaggttcagtggcagtggatcgtggacagtattcactctcaccatactagtaatctacgactaacgtagaagttatttacgacttaaactttattaacttcgtaacaaactagtaaatttaactaagttcgtttaccggaccgtaaaggacctaacgtaaccttaaactaaattaaacgtaacgtaggtacggtctacgtaccgacctattacgtcttaccttactaccgttaccctttaccccgtacccgttaactcgtcgttaaaccg

SEQ ID NO: 137719 - DNA, 556 bp, Homo sapiens
  misc_feature: GYAE6OF01DKBY3.46.67.G01.1.454.CMB.1.raw
  modified_base (364)..(364): a, c, t, g, unknown or other
  misc_feature (364)..(364): n is a, c, g, or t
  modified_base (484)..(484): a, c, t, g, unknown or other
  misc_feature (484)..(484): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctctggggctgggtccggcagctcccgaggggaaggggctggaatacattggaagtgtctctcatagtggaggttcctattacagtccgtctctcaagagtcgagtcaccatatctctggacacgtccagcaatcagttttccctgaagatgagttctgtgaccgccgctgacncgggtcgtttattactgtgcgagagacggctattatgtatttttggagttggtttatttcgactaccctagtatcggacggggtctcggaccccgtggggaccagggaactacgtggtcnccgtctccttagccctccaccgacggcccagtccgtccttccccctcggccacccctcctccagcgtacccg

SEQ ID NO: 137720 - DNA, 513 bp, Homo sapiens
  misc_feature: GYAE6OF01AWT7H.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacgccctaagctcctaatctatgctgcatccagtttgcaaagtggggtcccatcgaggttcagtggcagtggatctgggacagatttcactctcaccatcagtaatctgcaacgtgaagtattttgactaacttattactgtcaacagtaattgactaattgttttacggacctaagggtacacgactaacaaattaaacgactgtgctagcacatctgttcttctactccttcccgcctatctacg

SEQ ID NO: 137721 - DNA, 669 bp, Homo sapiens
  misc_feature: GYAE6OF01D7QF3.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgagggccttcgggagaccctgtccctcacctgcgctgtctctggtcgcctccatcagtagttcggtttcttcgtggggcctgggtccggcagcctcccgaggggaagggctggaatacagttggaagtgtctctcagtagtggtaggttcctattacagtccgtctctcaagagtcgagtcaccatatctctggaccacgtccagcaatctacgttttcccagaagatgtacgttctgtcgaccgccgtctcgacgtacgggtcttttaatcgtggtcgacgagacggacggtacttagttagtgttagttttgggaggtttggtttacttcgacctacccgtagtacgtccgggtacggggtcctccgggaccccgtgggggacccgtaaggggtaacttacggttcggtaccgtaccgttccttaccgttaccgtacccttacccgaacccggaacccgggtccctaaccggttcccggttaccccttccccccggtcggtacccctacccccgttaccctaccgaaccgcggtaccccg

SEQ ID NO: 137722 - DNA, 603 bp, Homo sapiens
  misc_feature: GYAE6OF01DPH90.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcgaacattgacacctatttaatggtatcaacatagaccagggacgccctaagctcctaatctatgctgcatccagtttgacaaagtgggtcccagtcgaggttcagtggcagtggatcgtgggacagtatttcactctacaccatacagtaatcgtgacaacgtgaagtatttagactaactttattactagtacaactaagtaaacttaactaagttcggttttaccggaccgtaaaggggtaacctaacgtaaaccttaaacgtaaaacgttaaacgtaaacgttaggttacggaccgtacggacctaaccgtaattcgtttcgttacctttacctaacctttcccgtttacccccgaccttaacttccgttagtaaccg

SEQ ID NO: 137723 - DNA, 719 bp, Homo sapiens
  misc_feature: GYAE6OF01CTR8R.46.67.G01.1.454.CMB.1.raw
  modified_base (194)..(194): a, c, t, g, unknown or other
  misc_feature (194)..(194): n is a, c, g, or t
  modified_base (221)..(221): a, c, t, g, unknown or other
  misc_feature (221)..(221): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgacaaccggtggganacagtgtcaccatcacttggccggganaaggtcggaacattgacctaactatttaaatggtatacaacatagaccgagggaccggccctaagctacctaatctatcgctgctactccgtagtttacgagtaaacggtcgggtacccctaagtccggtaaggtttcgaggtcggtacgtaagggttggtaactcggtaggggaacctaggtaactttaccaaccgttcctaccgtaactaactacgtaagttaacgtcgttacgaccgtaacgtagtaaacggtttattttacggaacctttaaactttacttacgttaagtaaccaaataacgttaaactttaacgtaacgttttcggtttaacccgggaaccgtaacgggtaacctaacccggtaaactaaaccgttaaaaacgttaaccgtaacgttacggttacggccttacgacccgtaaacctacttacgttaccgttaccttaccgtaactttcccccgtacccgtaccttaactccgttacgtaaccg

SEQ ID NO: 137724 - DNA, 642 bp, Homo sapiens
  misc_feature: GYAE6OF01BU7N0.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccgcagctccgagggaagggctggaatacagttggaagtgtctctcatagtggaggttcctattacagtccgtctctcaagagtcgagtcaccatatctctggacacgtccagcaatctacgttttcccagaagatgagttctggtcgaccgcgctgacgacgggtcttttatacgtgtgcgagagacggtctagttatgttagttttagggagttaggtttactttcggaacctaccgttagacgtcgggtacgggggtccttaccggaccccgtgggggaccctaaggggtaacttaccggtcgggtacctaccccggttcttcccgttacgttcccgtacccgaaccgtaacggggtcccctaaggttccccgggttaccctttccccccgtacggtcccctaccccttccgtaacccgaacggtcgtacccg

SEQ ID NO: 137725 - DNA, 552 bp, Homo sapiens
  misc_feature: GYAE6OF01AR5G3.46.67.G01.1.454.CMB.1.raw
  modified_base (192)..(192): a, c, t, g, unknown or other
  misc_feature (192)..(192): n is a, c, g, or t
  modified_base (328)..(328): a, c, t, g, unknown or other
  misc_feature (328)..(328): n is a, c, g, or t
  modified_base (374)..(374): a, c, t, g, unknown or other
  misc_feature (374)..(374): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctnacctgcgctgtctctggtgcctccatcagtagtggtttctctggggctgggtccggcagctcccgagggaaggggctggaatacattggaagtgtctctcatagtggaggttcctattacagtccgtctctcaagntcgagtcaccatatctctggacacgtccagcaatctagttttcccngaagatgagttctgtcgaccgcgctgacgacgggtcgtttatactgtgcgagagacggtctattatgtatttttggagttggtttatttcgactacccgtagcgtcggacggggtctccggaccccgttggggccgtagggaactacgtcggtcacccgtctcccttgtccctacccg

SEQ ID NO: 137726 - DNA, 529 bp, Homo sapiens
  misc_feature: GYAE6OF01D9SKW.46.67.G01.1.454.CMB.1.raw
  modified_base (217)..(217): a, c, t, g, unknown or other
  misc_feature (217)..(217): n is a, c, g, or t
  modified_base (387)..(387): a, c, t, g, unknown or other
  misc_feature (387)..(387): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggnaagtcggaacattgacacctatttaaattggtatcaacatagaccagggacggccctaagctcctaatctatgctgcatccagtttgctaaagtgggtcccatcgaggttcagtggcagtgatcgtggacagatttcactctcaccatcagtatctgacaacgtgaagtntttagactaacttattactgtacaacagtaattactaattgtttacgacgtaagggactacgtaactaactaaacgttaaacgaacgtgtcggctgacctaccattctgttccttctacttcccttcccacctctctgtaac

SEQ ID NO: 137727 - DNA, 652 bp, Homo sapiens
  misc_feature: GYAE6OF01AKUYA.46.67.G01.1.454.CMB.1.raw
  modified_base (171)..(171): a, c, t, g, unknown or other
  misc_feature (171)..(171): n is a, c, g, or t
  modified_base (285)..(285): a, c, t, g, unknown or other
  misc_feature (285)..(285): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtncctcatcagtagtggtttctctggggctgggtccgcagctccgaggggaagggctggaatacattggaagtgtctctcatagtggaggttcctattacagtccgtctctcaagngtcgagtcaccatactctctggacacgtccagacaatctacgttttccagaacgtatgtagttctgtacgacccgcgtctggacgtacgggtcgttttacttacgtggtgcggagacggtacggcttagttatgttagtttttggaggttaggtttactttaccgactacccgttagacgtcgggtaccgggggtcctcccggaccccggttcggggacccgtaaggggtaacgttacgttcgggtccctacccggtttccgtacccgttaccgccctacccacccggtaacgggtcccctaacggttcccgttccccttcccccgtcggtcccctacccccttcccacccgaacgtccgtaccccg

SEQ ID NO: 137728 - DNA, 501 bp, Homo sapiens
  misc_feature: GYAE6OF01B6J72.46.67.G01.1.454.CMB.1.raw
  modified_base (476)..(476): a, c, t, g, unknown or other
  misc_feature (476)..(476): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccaggacggccctaagctcctaatctatgctgcatccagtttgcaaagtgggtcccagtcgaggttcagtgcagtgatctgggacagattcactctcacatcagtaatctagacaacgtgaagtattttgctaacttattactgtacaacagtaattacaattgtttcgacaaggactacgactaacaaattaacgaactgtagctgacacatctntcttcactcttcccgcactctgtac

SEQ ID NO: 137729 - DNA, 608 bp, Homo sapiens
  misc_feature: GYAE6OF01BZF1G.46.67.G01.1.454.CMB.1.raw
  modified_base (190)..(190): a, c, t, g, unknown or other
  misc_feature (190)..(190): n is a, c, g, or t
  modified_base (213)..(213): a, c, t, g, unknown or other
  misc_feature (213)..(213): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaaccgtgganacagtgtcacatcacttgccggnaagtcggaacattgacacctatttaaatggtatcaacatagaccagggacgccctaagctcctaatctatgctgcatccagtttgactaaagtcgggtacccagtcgaggttcagtggcagtggatcgtgggactaggtatttcgactctacaccatacagttaactctagcctaacgtagtaagtatttgactaacttattacttgtactaactagtaactttacaacgtttcgttttaccggaccgtaagggtacctaacggtaacttaaaccgaaagtttaaaccggaacgttcggttaacggtaccgtacggtacccgtaacctagttacccgttcgttaccctttacgtactttcccgttaccccgtacctacgttccgtacgttaaccg

SEQ ID NO: 137730 - DNA, 559 bp, Homo sapiens
  misc_feature: GYAE6OF01A7LNW.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattgtatcaacatagaccagggacggccctaagctcctaatctatgctgcatccagtttgcaaagtgggtcccatcgaggttcagtggcagtggatcgtgggacagtatttcactctcaccatcagtatctgcaacgtgaagtatttgactaacttattactgtactaactagtaattactaatttcgttttaccggaccgtaagggtacctaacgtaacttaactaaaacgttaaaccgaaacgttgtaggtacctaggacctaccgtatctcgttaccttactaccttcctttcccgacctacttctgtaaccg

SEQ ID NO: 137731 - DNA, 706 bp, Homo sapiens
  misc_feature: GYAE6OF01BWQJO.46.67.G01.1.454.CMB.1.raw
  modified_base (317)..(317): a, c, t, g, unknown or other
  misc_feature (317)..(317): n is a, c, g, or t
  modified_base (339)..(339): a, c, t, g, unknown or other
  misc_feature (339)..(339): n is a, c, g, or t
tcagactagcagtacacgaccggtgctcgatttagagtatacataagttaggggtttgtcctcctgcgtggtcggcacgcgtccctagagtgggttcctgttcccgtggtagcgaactgacaggagtcgggacccacgactggtgaggtccgttcggagaccctgtcccgtcttaccttgcgctgttactctgtgcctccagtcagtagtgtttctcgtggggctggggtccgctaggctcccgagggagggggcctggaatacattcggaagtgtctacgtccagtaggtggacggttccttagttacagtccgtntcgtcaagtgtcgagtcgaccntagtctcgtgggacgacgtccgagcgtaactctagttttccctgtaacgatggtagttcgtgtcgaccgccgtctgacacgggtctttagtacgtggtcggcgtagacgacggtctagttagtagtaagttttggaacgttaggttactttcgaactacccgtagactacggtacggggacctccggacccgttggggacccgaaggggtaaccgtacgtacggtacccgtaccggttaccttccgttaaccgtcccgtacccgtaaccgtaaccgggtccccgtaacggtcccgggttacccgttacccccggttacgggtaccccttaccccgttacccgtacccgtaacggtccggtaccccgg

SEQ ID NO: 137732 - DNA, 515 bp, Homo sapiens
  misc_feature: GYAE6OF01D8G8Y.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacaatgtcaccatcacttgccgggcaagtcggaacattgacacctatttaaattggtatcaacatagaccagggacggccctaagctcctaatctatgctgcatccagtttgcaagtgggtcccatcgaggttcagtggcagtgatcgtgggacagtattcactctcaccatcagtaatctgcaacgtgaagtattttgctaactttattactgtacaactagtaattacaattcgtttacggaccgtaagggtacacgtaactaacaaattaacgaactgtagctgcactatctgtcttcactccttacccgctatctgtac

SEQ ID NO: 137733 - DNA, 569 bp, Homo sapiens
  misc_feature: GYAE6OF01ERSQH.46.67.G01.1.454.CMB.1.raw
  modified_base (318)..(318): a, c, t, g, unknown or other
  misc_feature (318)..(318): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctccgagggagggctggaatacattggaagtgtctctcatagtggaggttcctattacagtccgtntctcaagagtcgagtcaccatatctctggacacgtcagcaatctacgttttccctgaagtatgagtttctgtcgaccgccgcgtgacgacgggtcgtttattactgtgcgagagacgctattagtgtatttggagttggtttactttcgacctaccgtagacgttacggaccggggtctcccggtaccccgtggggacccgaacgggtaacgtacgttcggtaccaccgttcctccgttacgccctacccg

SEQ ID NO: 137734 - DNA, 590 bp, Homo sapiens
  misc_feature: GYAE6OF01EI58H.46.67.G01.1.454.CMB.1.raw
tcagactagcagtacacgaccggtgctcgatttagagtatacatattgggtttggggagtctcggtcaggacacagcataggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatgtatcaacatagaccagggacgccctaagctcctaatctatgctgcatccagtttgcaagtgggtcccatcgagttcagtgcagtgatcgtgggacagtatttcactctcacctatacagtaactctagactaacgtgaagtagtttagactaactttattactgtacaactaagtaatttaactaagttcggttttacggaccgtaagggtaacctaacgtaacttaaactaaaacgttaaaccgaacgttcgtacggtacctagtaccgtaacccgtattaccgttgtttacctttacctaacgtttcccgtttaccccgaccttacttccgtacgttaacg

SEQ ID NO: 137735 - DNA, 569 bp, Homo sapiens
  misc_feature: GYAE6OF01AHDHW.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccaggggaaggggctggaatacattggaagtgtctctcatagtggaggttcctattacagtccgtctctcaagagtcgagtcaccatatctctggacacgtccagcaatctagttttccctgaagatgagttctgtgacccgccgctgacacgggtcgtttattactgtgcgagagacggctattatgtattttggagttggttatttcgactaccctagactcggacggggctccgaccccgtggggccagggtaatacgtggtcaccgtctcctacgccctccaccgacgggccccagttcccggtcccttcccccgtcggtccctacccctccctcccgaagccgtacccg

SEQ ID NO: 137736 - DNA, 577 bp, Homo sapiens
  misc_feature: GYAE6OF01B9741.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattgtatcaacatagaccagggacggccctaagctcctaatctatgctgcatccagtttgacaaagtcggggtcccatcgaggttcagtggcagtggatcgtgggacagatttcactctcacatcagtaatctgcaacgtgaagtatttgactaacttattactgtacaactagtaaacttactaattggttttaccggaccgtaaagggtacctaacggtaacttaaactaaaacgtttaaacgaaacttaggtaggaccttaggacctaaccctattccttcggttaccttctaactttcccttacccccgaccttacttccgtggttaacc

SEQ ID NO: 137737 - DNA, 525 bp, Homo sapiens
  misc_feature: GYAE6OF01AYZ9T.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattgtatcaacatagaccagggacggccctaagctcctaatctatgctgcatccagtttgcaaagtggggtcccagtcgaggttcagtggcagtggatctgggacagtatttcactctcaccatcagtaatctgacaacgtgtaagtatttgactaacttattactgtacaactagtaattaacaattgtttacgacgtaagggactaacgaactaacaaattaacgaactgtacgactagcacctatctgtacttctacttccttcccgactctcgtgtac

SEQ ID NO: 137738 - DNA, 639 bp, Homo sapiens
  misc_feature: GYAE6OF01CU8SK.46.67.G01.1.454.CMB.1.raw
  modified_base (192)..(192): a, c, t, g, unknown or other
  misc_feature (192)..(192): n is a, c, g, or t
  modified_base (216)..(216): a, c, t, g, unknown or other
  misc_feature (216)..(216): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccggnaagtcgaacattgacacctatttaaatgtatcaacatagaccagggaccgccctaagctacctaatctatgctgcatccagtttgacaaagtcgggtcccatcgaggttcagtgcagtggatcgtggacagtatttcactctcacctatacagtaatctgactaacgtgaagtatttagactaacttataacttgtactaactagtaaacttactaaagtttcgttttaacggaccgtaaacggggtaacctaaccggtaaacttaaacgtaaaacgtttaaacggaaaccgttagggttacggtaccgttacggaacccgttaacccgtaatttaccggttaacggtttcccgtttaaccctaaccgttttaccccgttttacccccgtacccgttaaaccttcccgttaaggttaaacccg

SEQ ID NO: 137739 - DNA, 512 bp, Homo sapiens
  misc_feature: GYAE6OF01BLOQJ.46.67.G01.1.454.CMB.1.raw
  modified_base (486)..(486): a, c, t, g, unknown or other
  misc_feature (486)..(486): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggccctaagctcctaatctatgctgcatccagtttgcaagtgggtcccatcgaggttcagtggcagtgatcgtgggacagtatttcactctcaccatcagttaactctgacaacgtgaagtattttgactaaacttattactgtacaacagtaattactaattgtttcgaccgaaggacacgactaacaaattaacgaatggtgctgacacctatctntcttcacttccgtccactatctgtac

SEQ ID NO: 137740 - DNA, 632 bp, Homo sapiens
  misc_feature: GYAE6OF01BZ3BO.46.67.G01.1.454.CMB.1.raw
  modified_base (192)..(192): a, c, t, g, unknown or other
  misc_feature (192)..(192): n is a, c, g, or t
  modified_base (377)..(377): a, c, t, g, unknown or other
  misc_feature (377)..(377): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccgggcaagtcggacattgacacctattaaattgtatcaacatagaccagggacggccctaagctcctaatctatgctgcatccagtttgctaaaggtgggtcccatcgaggttcagtggcagtggatcgtagggacagtatttcactctcaccatcaagtatctnactaacgtgaagtattttagactaacttattactgtacctaaacagtaaactttaacaaagttcgttttaccgggaacctaaacggggaacctaaacggtaaaccttaaactaaaaacgtttaaaaccggtaacgttacggtacgggtaccctttaggaccgtaaccctaatttacccttcgggtttaaccttttaccaaacccttttccccgtttacccccggtaccctaacgtttcccgttagggttaaaccc

SEQ ID NO: 137741 - DNA, 562 bp, Homo sapiens
  misc_feature: GYAE6OF01A6KMG.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggccctaagctcctaatctatgctgcatccagtttgcaaaggtggggtcccatcgaggttcagtggcagtggatcgtgggacagatttcactctcaccatcagtaatctgacaacgtgaagattttgactaacttattactgttacaactaagtaatttaacaatttcggtttttacggacccgtaaagggaacctacggaaccttaaacgaaattaaaccgaacttacggtaggtactaggacctaacctagtcctgttccttactacttccttacccgcctactcttgtaac

SEQ ID NO: 137742 - DNA, 585 bp, Homo sapiens
  misc_feature: GYAE6OF01DRK6U.46.67.G01.1.454.CMB.1.raw
  modified_base (214)..(214): a, c, t, g, unknown or other
  misc_feature (214)..(214): n is a, c, g, or t
  modified_base (326)..(326): a, c, t, g, unknown or other
  misc_feature (326)..(326): n is a, c, g, or t
  modified_base (444)..(444): a, c, t, g, unknown or other
  misc_feature (444)..(444): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagacccctgtcccctcacctgcgctgtctctggtcncctcatcagtgtggtttcttcgtggggctgggtccgcagcctccgagggaagggctggaatacattggaagtgtctctcatagtggtaggttcctattacagtccgtctctnaagagtcgagtcaaccatatctctggtacacgtcagcaatctacgttttcccagaagatgtagttctgtgacccgcgcgtgacgacgggtcgtttacttacgtgtgcgagagacggtnttaagttatgttattttggagtttaggttactttcgacctaccgtagtacgtccggaccggggtctccggtaccccgtggggacccgtaaggggtactaacgtcggtacctaccgttacctccgttcgtcccgtaaccccg

SEQ ID NO: 137743 - DNA, 558 bp, Homo sapiens
  misc_feature: GYAE6OF01B7M1F.46.67.G01.1.454.CMB.1.raw
  modified_base (334)..(334): a, c, t, g, unknown or other
  misc_feature (334)..(334): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctctggggctgggtccggcagctcccgaggggaagggctggaatacattggaagtgtctctcatagtggaggttcctattacagtccgtctctcaagagtcgagtcaccatatctctggacacgtccagcaatcagttttcccngaacgatgagttctgtgaccgccgctgacacgggcttttatactgtgcgagagacggctattatgtatttttggagttggttatttcgactaccctagatcggacggggctcggaccccgtggggccaggggtaatacgtggtcaccgtctccttacgccctccaccgagggccccagtcccggttcttcccccgtggcccacccctcctcccaagcgtacccg

SEQ ID NO: 137744 - DNA, 524 bp, Homo sapiens
  misc_feature: GYAE6OF01EUT1T.46.67.G01.1.454.CMB.1.raw
  modified_base (421)..(421): a, c, t, g, unknown or other
  misc_feature (421)..(421): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacactatttaaattggtatcaacatagaccagggacgccctaagctacctaatctatgctgcatcctagtttgcaaagtcggggtcccagtcgaggttcagtggcagtggactgtgggacagtatttcactctcaccatcagttaatctgactaacgtgtaatatttagactaatttattactgtacaanagtaattactattgtttacggactaaggactaacgactaacaaacttaacgatgtacgtctagacctactatctgtacttcacttccttcccactatctgtac

SEQ ID NO: 137745 - DNA, 582 bp, Homo sapiens
  misc_feature: GYAE6OF01B0DC0.46.67.G01.1.454.CMB.1.raw
  modified_base (288)..(288): a, c, t, g, unknown or other
  misc_feature (288)..(288): n is a, c, g, or t
  modified_base (335)..(335): a, c, t, g, unknown or other
  misc_feature (335)..(335): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctcgtggggctgggtccgcagctcccgagggaaggggctggaatacattggaagtgtctctcatagtggaggttcctattacagtccgtctctcaagngtcgagtcaccatatctctggacacgtccagcaatctagttttcccngaagatgagttctgtcgaccgccgtctgacgtacgggtcgtttaattacgtgtgcgagagacggctattatgtagttttggagttggttatttcgactacccgtagtacgtcggacggggcctcggaccccgtcggggaccgagggtaactacgtggtcctaccgtcttccgttacgcctaccgacccgaacgggcccagtcccgtccttcccccgtgtccctaccctaccctccaacgcgtacccg

SEQ ID NO: 137746 - DNA, 521 bp, Homo sapiens
  misc_feature: GYAE6OF01DKLWH.46.67.G01.1.454.CMB.1.raw
  modified_base (516)..(516): a, c, t, g, unknown or other
  misc_feature (516)..(516): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccaggacggccctaagctctaatctatgctgcatccagtttgcaaagtgggtccatcgaggttcagtgcagtggatctgggacagatttcactctcaccatcagtaatctgcaacgtagaagtattttagtaaactttattaactgttacaacagtaatttacaattgttttacgcaagggacacgtaactaacaaattaaacgactatggctgcaccgaattctgttcttactactccttcccgacctatctgtntaacg

SEQ ID NO: 137747 - DNA, 561 bp, Homo sapiens
  misc_feature: GYAE6OF01A1IWG.46.67.G01.1.454.CMB.1.raw
  modified_base (335)..(335): a, c, t, g, unknown or other
  misc_feature (335)..(335): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggaaggggctggaatacattggaagtgtctctcatagtggaggttcctattacagtccgtctctcaagagtcgagtcaccatatctctggacacgtccagcaatctagttttcccngaagatgagttctgtgaccgccgctgacacgggtctttatactgtgcgagagacggctattatgtagttttggagttggttatttcgtactaccctagacgtcggacggggtcctccgaccccgtggggccagggtaactacgtcggtcaccgtctccttagcctccgaccgacggcccagtccggtccttcccccgtggtccctaccctcctccaagcgtacccg

SEQ ID NO: 137748 - DNA, 636 bp, Homo sapiens
  misc_feature: GYAE6OF01CP0W5.46.67.G01.1.454.CMB.1.raw
  modified_base (192)..(192): a, c, t, g, unknown or other
  misc_feature (192)..(192): n is a, c, g, or t
  modified_base (217)..(217): a, c, t, g, unknown or other
  misc_feature (217)..(217): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccgggnaagtcggaacattgacactatttaatggtatacaacatagaccagggaccgccctagcctctaatctatgctgcatcctagtttcgacgaaggtcgggtacccagtcggaggtttacaggtcggcgaggtcggatcgttagggaactagtacttttcacttctacaccctatactaagttaactcgtacgactaacgtagtaaagttacttttagaccttaactttacttacgttagtaccaaactaagttaaactttaactaagtttcggtttaccggaaccgtaacgggacctaacgtaaacttaaactaaaagttaaccgacttagggtacgtacgttaggacctaccgtattccgttacgttacctttaacctaccgtttcccctttaccccgaccttacttccgtagttaaacc

SEQ ID NO: 137749 - DNA, 570 bp, Homo sapiens
  misc_feature: GYAE6OF01B92UI.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacgccctaagctacctaatctatgctgcatccagtttgcaaagtggggtcccatcgaggttcagtggcaggtggatcgtgggacagtatttcactctcaccatcagtaatctgacaacgtgtaagtattttgactaactttattaactgtaccaaataagtaaactttactaatttcggttttaccggaccgtaaagggtacctaacggtaacttaaactaaattaaaaccgaacgttagtaggactagacctacctattcgttgttaccttacacttccttaccccgacctactcttaggtaac

SEQ ID NO: 137750 - DNA, 507 bp, Homo sapiens
  misc_feature: GYAE6OF01EZR2C.46.67.G01.1.454.CMB.1.raw
  modified_base (471)..(471): a, c, t, g, unknown or other
  misc_feature (471)..(471): n is a, c, g, or t
  modified_base (496)..(496): a, c, t, g, unknown or other
  misc_feature (496)..(496): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacgccctaagctcctaatctatgctgcatccagtttgacaaagtggggtcccatcgaggttcagtggcagtgatcgtgggacagatttcactctcacatcagtaatctgcaacgtgaagtattttgactaacttattactgtacaacagtaattacaattgtttacggacctaaggacacgactaacaaattaacgatgtgctancgactatctgtctcacttcctaccnctactctgtac

SEQ ID NO: 137751 - DNA, 506 bp, Homo sapiens
  misc_feature: GYAE6OF01A666T.46.67.G01.1.454.CMB.1.raw
  modified_base (496)..(496): a, c, t, g, unknown or other
  misc_feature (496)..(496): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggccctaagctcctaatctatgctgcatccagtttgcaaagtgggtcccatcgaggttcagtggcagtggatctgggacagatttcactctcacatcagtaatctgcaacgtgaagtatttgctaacttattactgtacaacagtaattacaattgtttacgaccaagggactaacgactaacaaattaacgaactgtgctgacacatctgtcttcattccttacccnctatctgtac

SEQ ID NO: 137752 - DNA, 530 bp, Homo sapiens
  misc_feature: GYAE6OF01EBG6F.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacggccctaagctcctaatctatgctgcatccagtttgcaaagtggggtcccatcgaggttcagtggcagtggatctgggacagatttcactctcaccatcagtaatctgcaacgtgaaagattttagactaactttaattaactgtcaaacagaaattaacaatgttttacggccaaagggacaacgaacttaacaaattaaacgaactgtaggctagcaacccattctgttacttcaacttcttaccccgccattctgtaaac

SEQ ID NO: 137753 - DNA, 563 bp, Homo sapiens
  misc_feature: GYAE6OF01ETAC8.46.67.G01.1.454.CMB.1.raw
  modified_base (323)..(323): a, c, t, g, unknown or other
  misc_feature (323)..(323): n is a, c, g, or t
  modified_base (340)..(340): a, c, t, g, unknown or other
  misc_feature (340)..(340): n is a, c, g, or t
  modified_base (388)..(388): a, c, t, g, unknown or other
  misc_feature (388)..(388): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtcccctcacctgcgctgtctctggtgcctccatcagtagtggttttcttcgtgggggctggggtccggcagcctcccgaggggaaggggctggaatacagttggaagtgtctctcattagtggaggttcctattacnggttccgtctctcaagngtcgagtcaccatatctctggacacgtccagcaatctacgttttcccngaagtatgtagttctgtcgaccgccgctgacgacgggtcttttattacgtggtgcgagaggacgtcttattatgttagttttggagttggttattcgactacctagactcggacggggtcctaccggcccgtggggacccagggactcgtcgtcaccgtctccttgccctacccg

SEQ ID NO: 137754 - DNA, 582 bp, Homo sapiens
  misc_feature: GYAE6OF01EG5GM.46.67.G01.1.454.CMB.1.raw
  modified_base (337)..(337): a, c, t, g, unknown or other
  misc_feature (337)..(337): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggcagctcccgaggggaaggggctggaatacattggaagtgtctctcatagtggaggttcctattacagtccgtctctcaagagtcgagtcaccatatctctggacacgtccagcaatcagttttcccngaagatgagttctgttaccgcgctgacacgggtctttattctgtgcgagagacggctattatgtagtttttggagttggtttatttcgactaccctagagtcggacggggtctccgacccgtgggaccgaggaagtacgtggtcaccgtctccttacgccctccgaaccgaacgggccctaagttcccggttcccttccccccgtggcccctaccccttccctacccgaagtccgcctaccccgg

SEQ ID NO: 137755 - DNA, 550 bp, Homo sapiens
  misc_feature: GYAE6OF01BCJJM.46.67.G01.1.454.CMB.1.raw
  modified_base (334)..(334): a, c, t, g, unknown or other
  misc_feature (334)..(334): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggaaggggctggaatacattggaagtgtctctcatagtggaggttcctattacagtccgtctctcaagagtcgagtcaccatatctctggacacgtccagcaatcagttttcccngaagatgagttctgtgaccgccgctgacacgggtcgtttattactgtgcgagagacggctattatgtattttggagttggttatttcgactaccctagatcggacggggctcgacccgtggggccagggatacgtgtcaccgtctcctacgcctccaccgaacgggcccacgtccggtccttcccccgtcggtcccaccctccctccaagcgcccg

SEQ ID NO: 137756 - DNA, 581 bp, Homo sapiens
  misc_feature: GYAE6OF01CMU86.46.67.G01.1.454.CMB.1.raw
  modified_base (334)..(334): a, c, t, g, unknown or other
  misc_feature (334)..(334): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctcgtggggctgggtccgcagctcccgagggaaggggctggaatacagttggaagtgtctctcatagtggaggttcctattacagtccgtctctcaagagtcgagtcaccatatctctggacacgtcagcaatcagttttcccngaagatgagttctgtcgaccgcgctgacacgggtctttatacgtgtgcgagagacgctatatgtagttttggagttggttattcgactaccctagtacgtcggacggggctcggacccgtggggaccgaagggtaactacgtggtaccaccgtcctccgttacgccctccaacccgaacggcccctacgtccggtcccttccccccgtcggtccctacccccgttaccctacccgaaagcgtacccg

SEQ ID NO: 137757 - DNA, 544 bp, Homo sapiens
  misc_feature: GYAE6OF01A5GYE.46.67.G01.1.454.CMB.1.raw
  modified_base (323)..(323): a, c, t, g, unknown or other
  misc_feature (323)..(323): n is a, c, g, or t
  modified_base (371)..(371): a, c, t, g, unknown or other
  misc_feature (371)..(371): n is a, c, g, or t
tcagactagcagtacacgaccggtgctcgatttagagtatacatattgggtttgggggacctcctgtgcaagaacatgaagcacctatggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctctggggctgggtccgcagctccagggagggctggaatacattggaagtgtctctcatagtggaggttcctattacagtccgtctctcaagngtcgagtcaccatatctctggacacgtccagcaatctacgttttcccngaagatgagttctgtcgaccgccgctgacgtacgggtctttatactgtgcgagagacggctattatgtattttggagttgttatttcgactacctagactcggaccggggtctccggcccgttggggcccgagggtactacgtcggtcctaccggtctccgttgccctacccg

SEQ ID NO: 137758 - DNA, 526 bp, Homo sapiens
  misc_feature: GYAE6OF01EHC0O.46.67.G01.1.454.CMB.1.raw
  modified_base (419)..(419): a, c, t, g, unknown or other
  misc_feature (419)..(419): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacactatttaaatggtatcaacatagaccagggacgccctaagctcctaatctatgctgcatccagtttgcaaaggtgggtcccatcgaggttcaggtggcagtggatcgtgggacagtatttcactctcaaccatcagtaatctgacaacgtgaagtattttagactaaactttattactgtacaanagtaattacaattcgtttacgacgtaaggactaacgaacttaacaaattaacgaactgtagctgacacctattctcgtacttcacttccttcccgactatctgtaac

SEQ ID NO: 137759 - DNA, 614 bp, Homo sapiens
  misc_feature: GYAE6OF01CDGC5.46.67.G01.1.454.CMB.1.raw
  modified_base (216)..(216): a, c, t, g, unknown or other
  misc_feature (216)..(216): n is a, c, g, or t
  modified_base (372)..(372): a, c, t, g, unknown or other
  misc_feature (372)..(372): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccggnaagtcggaacattgacactatttaaatgtatcaacatagaccagggacggaccctaagctcctaatctatgctgcactccagttttgactaaaaggtcggggtccccaatcgtaaggtttcagttggcaggtggatctgggacagtatttcactcncaccatcaagttaatctgactaacgtagaagtatttgactaacttattactagtacaatagtaattaactaagttgttttaccggaaccaacggggtaacctaacggtaaccttaaacgaaaagtttaaacggaaaccgttggtacgggtactacggacctaaccgtaattaccgtttcgttaccgtttacctacgttttacccctttacccccggacccttaattcccgtttagttaaacc

SEQ ID NO: 137760 - DNA, 512 bp, Homo sapiens
  misc_feature: GYAE6OF01B3E9C.46.67.G01.1.454.CMB.1.raw
  modified_base (503)..(503): a, c, t, g, unknown or other
  misc_feature (503)..(503): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggccctaagctcctaatctatgctgcatccagtttgcaaagtgggtcccatcgaggttcagtggcagtggatctgggacagatttcactctcaccatcagtaatctgcaacgtgaagtattttgactaactttattactgtacaactagaatttacaattgttttcgacaaggacacgactaacaaattaacgaactgtaggctgacaccatcgtgtccttctactccttacccncatctgtac

SEQ ID NO: 137761 - DNA, 549 bp, Homo sapiens
  misc_feature: GYAE6OF01CFH9O.46.67.G01.1.454.CMB.1.raw
  modified_base (191)..(191): a, c, t, g, unknown or other
  misc_feature (191)..(191): n is a, c, g, or t
  modified_base (252)..(252): a, c, t, g, unknown or other
  misc_feature (252)..(252): n is a, c, g, or t
  modified_base (371)..(371): a, c, t, g, unknown or other
  misc_feature (371)..(371): n is a, c, g, or t
tcagactagcagtacacgaccggtgctcgatttagagtatacatagttggggttgggagtctcggtcaggacacagcatggacatgagggtcccgctcagctcctggggctcctgctactctggctccgaggtgccagactgtgacatcgagctgacccagtctccatcctccctgtctgcaaccgtgganacagtgtcaccatcacttgccggcggaatcggaacattgacactatttaaatgtatacaanatagaccaggacgccctaagctcctaatctatgctgcatcatttgactaaagtcgggtaccagtcgagttcagtggcagtgatcgtggacagtattcactctacacatcagtaatctanactaacgtgtaagtatttacgtaaactttattactagttacaactagtaacttacaatttcgtttaacggaccaacgggtacacggtaacttaacgaaagttaacggacttaggtgactagaacctacgtacgtctggttccttacgacttccctaccgacctattcctgtacttacg

SEQ ID NO: 137762 - DNA, 534 bp, Homo sapiens
  misc_feature: GYAE6OF01BGTRA.46.67.G01.1.454.CMB.1.raw
  modified_base (513)..(513): a, c, t, g, unknown or other
  misc_feature (513)..(513): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtgtcaacatagaccagggacggccctaagctcctaatctatgctgcatccagtttgacaaaggtgggtcccatcgaggttcagtggcagtggatcgtgggacagtatttcactctcacatcagtaatctagactaacgtagaagtattttgactaaactttattactagtacaaactagtaactttacaatttggtttacgaccaagggtactaacgaacttaactaaattaacgactgtagactagacacctatctgttccttnacttcctcccgctatctgtac

SEQ ID NO: 137763 - DNA, 566 bp, Homo sapiens
  misc_feature: GYAE6OF01CRGAA.46.67.G01.1.454.CMB.1.raw
  modified_base (228)..(228): a, c, t, g, unknown or other
  misc_feature (228)..(228): n is a, c, g, or t
  modified_base (254)..(254): a, c, t, g, unknown or other
  misc_feature (254)..(254): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacnttgacacctatttaaatggtatcaanatagaccagggaccgccctaagctacctaatctatgctgcactcctagtttcgacgtaaaggtcggggtacccagtcggaggttcaggtggctagtggatcgtagggacagtatttcactctcacctatcaagtaatctgactaacgtagtaagtatttgactaacttattactagtacaactagtaattactaagttcggtttacgaccgtaaggtacctaacgtaactaactaaattaacgaacgtgtacgtactcgacctacgtattctcgttccttactaccttcccttaccctacctactctgtaac

SEQ ID NO: 137764 - DNA, 558 bp, Homo sapiens
  misc_feature: GYAE6OF01CC8SW.46.67.G01.1.454.CMB.1.raw
  modified_base (330)..(330): a, c, t, g, unknown or other
  misc_feature (330)..(330): n is a, c, g, or t
  modified_base (477)..(477): a, c, t, g, unknown or other
  misc_feature (477)..(477): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctcgtggggctgggtccgcagcctccgagggaagggctggaatacagttggaagtgtctctcatagtggtaggttcctattacagtccgtctctcgaagngtcgagtcacatatctcgtgacacgtccagctaatctagttttccctagaagtatgtagttcgtgtcgaccgcgtcgtgacgtacggtcgtttattacgtgtgcgagagacgcttattagtgttagtttggagttggttattcgacncctagagtcggacgggtctccggcccgtggggccgtaggtacgtacgtcggtcctccgttactccgtacgtcccgtacccg

SEQ ID NO: 137765 - DNA, 519 bp, Homo sapiens
  misc_feature: GYAE6OF01BB9OB.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggccctaagctcctaatctatgctgcatccagtttgcaaagtggggtcccatcgaggttcagtggcagtggatcgtgggacagatttcactctcaccatcagtaatctgcaacgtgaagtattttgactaacttattactgtacaacagtaattacaattgttttacggactaagggacacgtactaacaaattaaacgaactgtagctgacacctatctgtcttcacttccttacccgactactctgtac

SEQ ID NO: 137766 - DNA, 555 bp, Homo sapiens
  misc_feature: GYAE6OF01AYS5N.46.67.G01.1.454.CMB.1.raw
  modified_base (375)..(375): a, c, t, g, unknown or other
  misc_feature (375)..(375): n is a, c, g, or t
  modified_base (407)..(407): a, c, t, g, unknown or other
  misc_feature (407)..(407): n is a, c, g, or t
  modified_base (442)..(442): a, c, t, g, unknown or other
  misc_feature (442)..(442): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctcgtggggctgggtccggcagctccgagggaagggctggaatacattggaagtgtctctcatagtggaggttcctattacagtccgtctctcaagagtcgagtcaccatactctctggacacgtccagcaatctagttttcccngaagtatgtagttctgtcgaccgccgctgacncgggtcgtttattactgtgcgagagcggtctattntgtagttttggagttgtttattcgactaccgtagacgtcggacgggtctccggtcccgtcgggcggtcggaacgtacgtacggtcgtaccgtaccgtcctcgtccgtaccccg

SEQ ID NO: 137767 - DNA, 502 bp, Homo sapiens
  misc_feature: GYAE6OF01B1SCB.46.67.G01.1.454.CMB.1.raw
  modified_base (479)..(479): a, c, t, g, unknown or other
  misc_feature (479)..(479): n is a, c, g, or t
  modified_base (483)..(483): a, c, t, g, unknown or other
  misc_feature (483)..(483): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacactatttaaatgtatcaacatagaccagggacggccctaagctcctaatctatgctgcatccagtttgcaaagtgggtcccatcgaggttcagtggcagtgatctgggacagatttcactctcaccatcagtaatctgcaacgtgaagtattttgactaacttattactgtacaactagaaattacaattgttttcgactaaggacacgaactaacaaattaacgaactgtagctagcactatctntctnactctccgactatctgtac

SEQ ID NO: 137768 - DNA, 504 bp, Homo sapiens
  misc_feature: GYAE6OF01A54MX.46.67.G01.1.454.CMB.1.raw
tcagactagcagtacacgaccggtgctcgatttagagtatacatattgggtttggggagtctcggtcaggacacagcatggacatgagggtcccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacgccctaagctcctaatctatgctgcatccagtttgcaaagtgggtcccatcgaggttcagtggcagtgatctgggacagatttcactctcaccatcagtaatctgcaacgtgaatatttgactaacttattactgtacaatagaaattacaattgtttcgaccaagggacaacgaactaacaaattaacgaatgagtactgacactatctgtcttcattccttacccactatctgtac

SEQ ID NO: 137769 - DNA, 551 bp, Homo sapiens
  misc_feature: GYAE6OF01B0QY8.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatgtatcaacatagaccagggacgccctaagctcctaatctatgctgcatccagtttgcaaagtgggtcccatcgagttcagtggcagtggatcgtgggacagtatttcactctcaccatcagtaatctgcaagtgaagtattttgactaactttattactgtacaactagtaaatttacaattcgtttacggaccgtaagggactacgaacttaactaaattaaaccgtaacgtgtacggtactagacctaacctattcgtgttccttactaccttcccttaccccgacctacttccgtgtaacccg

SEQ ID NO: 137770 - DNA, 557 bp, Homo sapiens
  misc_feature: GYAE6OF01A7NTR.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggccctaagctcctaatctatgctgcatccagtttgcaaagtgggtcccatcgagttcagtggcagtggatctgggactaggatttcactctcaccatcagtaatctgcaacgtgaatatttgctaaactttattactgtacaaactagtaatttaacaagttgttttacggacctaaagggtacctacgtaacttaacaaagttaaaccgaactcgtaggtactggaccacctaattcttagttacctttacaacttccttacccgtaccctaacttcttaggtaacc

SEQ ID NO: 137771 - DNA, 532 bp, Homo sapiens
  misc_feature: GYAE6OF01CKFWH.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacggccctaagctcctaatctatgctgcatccagtttgcaagtgggtccatcgagttcagtggcagtggatcgtgggacagatttcactctcaccatcagtaatctgcaacgtgaagtattttagactaactttattactgtacaactagtaattactaattcgttttacgaccgaagggtacctaacgaactaaacaaattaacgaactgtaggactgacgtacatactgttaccttacacttccttacccgactactcgtgtaac

SEQ ID NO: 137772 - DNA, 564 bp, Homo sapiens
  misc_feature: GYAE6OF01CJKDX.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggcagctcccgaggggaaggggctggaatacattggaagtgtctctcatagtggaggttcctattacagtccgtctctcaagagtcgagtcaccatatctctggacacgtccagcaatctagttttcccagaagatgagttctgtcgaccgccgctgacacgggtctttattactgtgcgagagacggctattatgtattttggagttggttatttcgactacccgtagacgtcggacggggtctcgacccgtgggccagggtatacgtggtcaccgtctccgtacgccctccaccgacggcccacgtccggtcccttcccccgtcggtcccacccctcctacccaagcgtacccg

SEQ ID NO: 137773 - DNA, 524 bp, Homo sapiens
  misc_feature: GYAE6OF01BETRN.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctattaaattggtatcaacatagaccagggacggccctaagctctaatctatgctgcatccagtttgcaagtgggtcccatcgaggttcagtggcagtggatcgtgggacagtatttcactctcaccatcagtaatctgcaacgtgtaagtatttgactaactttattactgtacaactagtaaatttacaagttgtttacggaccgtaagggacctacgaacttaacaaattaacgaactgtagctgacacctatctcttcttcacttccttcccgaccattctgtac

SEQ ID NO: 137774 - DNA, 606 bp, Homo sapiens
  misc_feature: GYAE6OF01CNN33.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacaccttattttaaatggtatcaacatagaccagggacgaccctaagcctcctaatctatgctgcatcctagtttgacaaaggtcggggtacccagtcgaggttcaggtggcaggtggatctagggacagatttcactctcaccatcagtatctgactaagtagtaaagtattttacgaactaactttatacttacgtactaactaagtaaatttaactaagttcgttttacggaccgtaaacgggtaaccaaccgtaacgttaaactaaaacgtttaaaacggaaacttaggtacggaccttcgtaaccgtaccctaatccgtttagttacctttcgtaacttcccttaccccgaccttaacttcgtagtaacg

SEQ ID NO: 137775 - DNA, 595 bp, Homo sapiens
  misc_feature: GYAE6OF01BK0CB.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggagacagtgtcaccatcacttgccgggcaagtcgaacattgacacctatttaaatggtatcaacatagaccagggacgccctaagctacctaatctatgctgcatccagtttgctaaagtgggtcccatcgagttcagtggcagtggatcgtgggacagtattcactctcaccatcagtaatctagcaacgtgtaagtatttgactaactttattactgtacaaactagtaaacttaactaatttggttttaccggactaaacgggtacctaacggtaacttaaacgtaaaacttaaaccgtaacgttaggtacggtacctacggaccctaaaccctagttaccttacggttacctttacctaacgtttccctttacccccgtacctaacgttcccgtaggttaaac

SEQ ID NO: 137776 - DNA, 655 bp, Homo sapiens
  misc_feature: GYAE6OF01DAJYW.46.67.G01.1.454.CMB.1.raw
  modified_base (338)..(338): a, c, t, g, unknown or other
  misc_feature (338)..(338): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctcatcagtagtggtttctcgtgggctgggtccggcagcctccgagggagggctaggaatcgattggaagtgtctctcatagtggaggttcctattacagtccgtctctcaagagtcgagtcacatatctctggacacgtccagacaatctacgtttcctgaacgntgtagttctgtcgaccgcgtctcgacgtacgggtcgtttaacttacgtgtgcgagagtacggacttagttatgttagttttggtagttggtttagtttacgtactacccgtagtacgtacgggtacggggtctaccggtaccccggtcgggggtacccgtaaggggtaacttacggtcgggttaccgtacccggttccttacccgttacgccccgtacccgaacccgtaaaccgggtacccctaacggttcccggttccccgttcccccgtcggtcccctaaccccctacccgtacccgtaaacggccgtaaccccg

SEQ ID NO: 137777 - DNA, 719 bp, Homo sapiens
  misc_feature: GYAE6OF01AVGMH.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggatccggaggtgccagatgtgacatcgagctgacccagtctccatcctcctgtctgcaaccgtgggagacagtgtcaccatcacttcggccggacaagtcgaacattgactacttatttaaatggtatcaacatacgaccgagggaccgaccctaagctacctaatctatgctgctactccgtagtttacgacgtaaacggtcgggtaccctagtcggtaggtttcaggtcggacgtaggtggacgtcgtagggactaggttactttcgacttcctacaaccgtattacgaacgttaactcgttacgacgtaaacgttaggtaaacgttagttttacgaactttaaaccgtttaacgtttaacgttacgtaacctaaacgtaacgttaaactttaactaacgtttcgggtttaaccggaaccgtaaacgggtaacctaaaccgtaaaccgttaaacgtaaaacgtttaaaccgtaacgttacgggttacggtaccgttaacgaaccttaacccgttaatttaccgttaccgttacccttaccttaccgtttaccccttaccccgtaaccgttacgttacccgttaagttaacccg

SEQ ID NO: 137778 - DNA, 670 bp, Homo sapiens
  misc_feature: GYAE6OF01EUXYH.46.67.G01.1.454.CMB.1.raw
  modified_base (86)..(86): a, c, t, g, unknown or other
  misc_feature (86)..(86): n is a, c, g, or t
  modified_base (199)..(199): a, c, t, g, unknown or other
  misc_feature (199)..(199): n is a, c, g, or t
  modified_base (261)..(261): a, c, t, g, unknown or other
  misc_feature (261)..(261): n is a, c, g, or t
tcagactagcagtacacgaccggtgctcgatttagagtatacatattgggtttgggggacctcctgtggcaaggaacactgaacgnacctgtcggtttggttccttccctgtcgtggtggcagctcccagatgggtcctgtccctggtgcaacgtgtcgaggagtcgggccctacggtactggtgaggtcctttacggngaccctgtccctcacctgcgctgtcgtcgtggtgccgtccatcagtagtcggtttcgttccnggggctgggttccggctagctccccgagggaacgggtcgtgggaatacgagtttaggtaagtgtttctctcctagttaggtcggtaggttccttagttaccggagttcccgtgtcgtcgtaagtgtcgtagttacaccatacgtctctggactacgtccagcaactctacgttttccctgaagtagtcgtaggtttctgttcgaccgtccgactaggaaccacgggtacttttaagttaccctggttgcgtaagaggacggacttagtaatacggttattttaggagttaggtttactttcgacctaccgtagagttcggacggggtcttaccggtacccgtaggggtaccaaggggaacgtaccgtagggtacctaccgttacgttcccggttgcccgttaaccccgg

SEQ ID NO: 137779 - DNA, 572 bp, Homo sapiens
  misc_feature: GYAE6OF01B2QRJ.46.67.G01.1.454.CMB.1.raw
  modified_base (546)..(546): a, c, t, g, unknown or other
  misc_feature (546)..(546): n is a, c, g, or t
  modified_base (559)..(559): a, c, t, g, unknown or other
  misc_feature (559)..(559): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctcgtggggctgggtccgcagctcccgaggggaaggggctggaatacagttggaagtgtctctcatagtggaggttcctattacagtccgtctctcaagagtcgagtcaccatatctctggacacgtcagcaatctagttttcccagaagtatgtagttctggtcgaccgccgctgacgtacgggtcttttaatactgtgcgagagacggctattatgtagttttggagttggtttatttcgactaccctagacgtcggacggggctcggaccccgtggggaccgagggtaactacgtcggtactaccgtctccttacgccctaccgaccgacggcccacgtccgtccttccccgngtcccaccctccnccaagcgtacccg

SEQ ID NO: 137780 - DNA, 584 bp, Homo sapiens
  misc_feature: GYAE6OF01C1LU5.46.67.G01.1.454.CMB.1.raw
  modified_base (254)..(254): a, c, t, g, unknown or other
  misc_feature (254)..(254): n is a, c, g, or t
  modified_base (306)..(306): a, c, t, g, unknown or other
  misc_feature (306)..(306): n is a, c, g, or t
  modified_base (312)..(312): a, c, t, g, unknown or other
  misc_feature (312)..(312): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggcagctcccgagggaagggctggaatacagttggaagtgtctctnatagtggagttcctatacagtccgtctctcaagagtcgagtcaccatatctntggacncgtccagacaatctagttttccagaacgatgagttctgtcgaccgccgtcgtgacgacgggtcgtttattacgtgtgacgtagagacggtctattatgtattttggagttgttattcgtactacctagacgtcggacggggctccgacccgtgggaccgagggtactacgtgtaccaccgtctccgttacgcccttaccaccgtaacggccctacgttcccggttccccttccccccgtggcccctacccctcccgaccgtaagcgtacccg

SEQ ID NO: 137781 - DNA, 740 bp, Homo sapiens
  misc_feature: GYAE6OF01C55QS.46.67.G01.1.454.CMB.1.raw
  modified_base (171)..(171): a, c, t, g, unknown or other
  misc_feature (171)..(171): n is a, c, g, or t
  modified_base (252)..(252): a, c, t, g, unknown or other
  misc_feature (252)..(252): n is a, c, g, or t
  modified_base (292)..(292): a, c, t, g, unknown or other
  misc_feature (292)..(292): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtncctccatcagtagtggtttctcgtggggctgggtccgcagcctccgaggggagggctaggaatcagttggaagtgtctctnagtaggtggaggtttcctattacagtccgttctctcaagngtcgagtccaaccattactctcgtacggacctacgtccagacaaatctacgttttacccaggaacgtatagtagtttcgtaggtcgacccgccgtcgtaggaaccggtacgggttaccgtttttaattaccggttggtacggaccgtaaggtaacggacggtacgtttaagtttagttagtttagtttttagggtaaggtttaggttttacgtttaccggtaaccgtaacccgtaagtacggtacccgggtacgggggtccctaccgggtaaccccggttggggacccgtaaggggtaactacgttcggtacctacccggttaccttaccgttacgacccctaccgaacccggtaacgggcccctaaccggttccccggttccccgttccccccgtacgggtaccccctacccccttacccttaccccgaaacgtcccggtaaccccg

SEQ ID NO: 137782 - DNA, 580 bp, Homo sapiens
  misc_feature: GYAE6OF01CI7TR.46.67.G01.1.454.CMB.1.raw
  modified_base (420)..(420): a, c, t, g, unknown or other
  misc_feature (420)..(420): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacgccctaagctcctaatctatgctgcatccagtttgctaaaggtggggtcccagtcgaggttcagtggcagtggatcgtgggacagtatttcactctcaccatcagtaatctagcaacgtgaagtattttgactaactttattactgtacaanagtaaattactaagttcgttttacgaccgtaagggacctaacgtaacttaactaaagttaaccgtaaacgttcggtaggactaggaccctaacctattccttcggttacctttacctacgtttccctttaccccgtacccgtaacttccgtagttaaccg

SEQ ID NO: 137783 - DNA, 535 bp, Homo sapiens
  misc_feature: GYAE6OF01C6V0I.46.67.G01.1.454.CMB.1.raw
  modified_base (251)..(251): a, c, t, g, unknown or other
  misc_feature (251)..(251): n is a, c, g, or t
  modified_base (376)..(376): a, c, t, g, unknown or other
  misc_feature (376)..(376): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctcgtggggctggggtccggnagctcccgagggaaggggctggaatacattggaagtgtctctcatagtggaggttcctattacagtccgtctctcaagagtcgagtcaccatatctctggacacgtccagcaatcagttttcccngaagatgagttctgtgaccgccgctgacacgggtcgtttattactgtgcgagagacggctattatgtatttttggagttggttatttcgactaccctagatcgacggggctcgaccccgtggggccagggatagtggtcaccgtctccttgccctaccg

SEQ ID NO: 137784 - DNA, 516 bp, Homo sapiens
  misc_feature: GYAE6OF01C0KTW.46.67.G01.1.454.CMB.1.raw
tcagactagcagtacacgaccggtgctcgatttagagtatacatattgggtttggggagtctcggtcaggacacagaatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaaagctcctaatctatgctgcatccagtttgcaaagtggggtcccatcgaggttcagtggcagtggatctgggacagatttcactctcaccatcagtatctagcaacgtgaagatttttgactaaactttattactgtcaaactagaatttaacaattgttttcggaccaagggacacgactaacaaattaaacgatagtgctgcacgatctgtcttcatccttcccgaccatctgatacg

SEQ ID NO: 137785 - DNA, 544 bp, Homo sapiens
  misc_feature: GYAE6OF01D2EM2.46.67.G01.1.454.CMB.1.raw
  modified_base (332)..(332): a, c, t, g, unknown or other
  misc_feature (332)..(332): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggagggctggaatacattggaagtgtctctcatagtggaggttcctattacagtccgtctctcaagagtcgagtcaccatatctctggacacgtccagcaatcagttttcccngaagatgagttctgtgaccgcgctgacacgggtcgtttattactgtgcgagagacgctattatgtattttggagttggttatttcgacacctagatcgacggggctcgacccgtgggccagggatacgtgtcaccgtctcctagccctaccaccgaacgggcccatccggtccttcccccgtcggccctacccctcctaccaagcgtacccg

SEQ ID NO: 137786 - DNA, 690 bp, Homo sapiens
  misc_feature: GYAE6OF01AYXLJ.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccgcagctcccgaggggaaggggctggaatacagttggaagtgtctctcagtagtggagttcctattacagtccgtctctacaagagtcgagtcaccatatctctggacacgtccagcaattctagttttccctagaagtatgtagttctggtcgacccgccgctaggaccgtacgggtaccgttttaattacgtggtgacggaggacggacggtacttaagtttattaggttagtttttagggtaaggtttggttttacgtttaccgtaacctacccgttaaggacgttaccgggaaccgggggtccttcccgggaaccccggtcgggggacccgtaaggggtaacttaccgttcgggtccctacccggttccttcccgttacgtccccttacccgacccggaaccgggtcccctacgttcccggttaccccttcccccgtccggacccctacccccttaccccaccgaacggcccgtacccg

SEQ ID NO: 137787 - DNA, 610 bp, Homo sapiens
  misc_feature: GYAE6OF01DUXS6.46.67.G01.1.454.CMB.1.raw
  modified_base (217)..(217): a, c, t, g, unknown or other
  misc_feature (217)..(217): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggnaagtcggaacattgacacctatttaaatgtatcaacatagaccagggacggccctaagctactaatctatgctgcatcctagtttgacgtaaaggtcgggtcccagtcgaggttcagtggcagtggatcgtagggactagtatttcactctacacatacagtaatctagactaagtgtaagttatttagactaactttattactagtactaaactaagtaaacttaactaagtttcggttttaccggaaccgtaagggtaacctaaccgtaaacgttaaactaaaactttaaacgaaacttaggtacgtaccgtacgaaccgtaacctaagttcttcgttacccttctaaccctttcccgttaccccacccttaacgttccgttaggtaaacc

SEQ ID NO: 137788 - DNA, 517 bp, Homo sapiens
  misc_feature: GYAE6OF01DN0T2.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatgtatcaacatagaccagggacgccctaagctctaatctatgctgcatccagtttgcaaaggtgggtcccagtcgagttcagtggcagtggatcgtgggacagatttcactctcaccatacagtaatctgacaacgtgaagtatttagactaacttattactgtacaacagaattacaattgtttacgacaagggacacgactaactaaattaacgaactagtggacttgacctacattctgtcttcacttccttcccgacctatcctgtaac

SEQ ID NO: 137789 - DNA, 513 bp, Homo sapiens
  misc_feature: GYAE6OF01EABJS.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggccctaagctcctaatctatgctgcatccagtttgcaaagtgggtccatcgaggttcagtggcagtggatctgggacagatttcactctcaccatcagtaatctgcaacgtgaagtatttgctaacttattactgtacaacagtaattaacaattgttttacgaccgtaagggactaacgtaactaactaaattaacgaactgtagctagcacctatctgtcttcactcttcccacatctgtac

SEQ ID NO: 137790 - DNA, 533 bp, Homo sapiens
  misc_feature: GYAE6OF01AZ267.46.67.G01.1.454.CMB.1.raw
  modified_base (376)..(376): a, c, t, g, unknown or other
  misc_feature (376)..(376): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggcagctcccgagggaaggggctggaatacattggaagtgtctctcatagtggaggttcctattacagtccgtctctcaagagtcgagtcaccatatctctggacacgtccagcaatcagttttcccngaacgatgagttctgtgaccgcgctgacacgggcgtttatactgtgcgagagacgctattatgtattttggagttgttatttcgactaccctagatcggacgggctcgaccccgtggggacctagggatcgtggtcaccgtctccttagcctacccg

SEQ ID NO: 137791 - DNA, 691 bp, Homo sapiens
  misc_feature: GYAE6OF01CK298.46.67.G01.1.454.CMB.1.raw
  modified_base (220)..(220): a, c, t, g, unknown or other
  misc_feature (220)..(220): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtcctccatcctccctgtctgcaaccggtgggagacagtgtcaccatcacttggccgggnaagtcggaacattgacacttatttaaatggtatacaacatacgacgagggaccgccctaagctacctaatctatgctgcatccagtttgacgaaaggtcgggtacccagtcgaggttcaggtggctaggtgatcgtgggactagtatttcactctacacctatacaagttaactctagaacctaacggtagtaagttattttacgaactttaaacgtttacttaacgttacgtaacctaaacgtaaggtttaaaactttaacgttaaacgttttacgggtttttaacccgggaacccggtaaaacggggtaaaccctaaaccggttaaacccgtttaaaaacgttaaaaacgtttaaaacccggtaaacgttacgggttacgggaccttacggaccctaaccgtaactttccttacggttaccctttactacctttccccgttacccgtacctacgttcgtacggttaacc

SEQ ID NO: 137792 - DNA, 841 bp, Homo sapiens
  misc_feature: GYAE6OF01DS3OJ.46.67.G01.1.454.CMB.1.raw
tcagactagcagtacacgaccggtgctcgatttagagtatacatattgggttggggaggtctccggtcaggacacaagcgagtggtaccattggagggtccccgctcagctcctaggggactccgtggccttactcctggcgtccggtagggtgccgagtagtttcgtgtacacttcgtaagcgtgacccagtctcatcctcctagtcgtgcgaccggtggggagactaggtcgtcaccagtcgtacttcggaccgggacaacggttccggaacctagtttacggacctaaccgttacttttaaaacgtttcgggttaactaccgtaaactaacgttaaggacccgtaacgggggaacccgtaccccgttaaggcccttaccgttaaacggttccttaaacgtacggtccgttaggacctaacggttaccgttagggttttcggacgtaaacgggtcggggttacccctagttccggtaacgggtttccgtaagggttcggggactaaggggtttcgggttaacgttaccggttaaggggtaacgttacggttaacgttttacccggaccgtttacgttaaccgaacccgtactacgtaacgtaacttcgtacgtaccgtaaacggttacgtaaacgttactttacgaacgttaacctttaagttacttacgttaactaacgtaacgtaaacgttaactaacgtttacggtttaccggacgtaaagggaccgtacgtaacgttaactaaacgtttaacgacgttaggtacgggacgttacggaccgtacgtacgtcgtcgttacttacgtacgttcgtacccgtagtacgtcgtagtaccg

SEQ ID NO: 137793 - DNA, 559 bp, Homo sapiens
  misc_feature: GYAE6OF01EGW9D.46.67.G01.1.454.CMB.1.raw
  modified_base (227)..(227): a, c, t, g, unknown or other
  misc_feature (227)..(227): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcgaacnttgacactatttaaatggtatcaacatagaccagggacggccctaagctacctaatctatgctgcatcctagtttgactaaaggtcggggtacccagtcggtaggtttcaggtggctaggtggatcgtgggacagtatttcactctcaccatcagtaatctagactaacgtgaagtattttgactaactttattactgtacaatagtaattaactattcggttttaccggaccgaaggtaccaacgtaactaactaaagttaacgaacgtgtagctagaccacctatctcgttaccttactaccttccttacccgacctacttcgtagtaac

SEQ ID NO: 137794 - DNA, 790 bp, Homo sapiens
  misc_feature: GYAE6OF01A58NS.46.67.G01.1.454.CMB.1.raw
  modified_base (433)..(433): a, c, t, g, unknown or other
  misc_feature (433)..(433): n is a, c, g, or t
tcagactagcagtacacgaccggtgctcgatttagagtatacatagttggggtttggggagtctcggtcaggacacagcatggacatgacgggtccccgctcagcctccgtggggctcctgctctctggctccggaggtgccagatgagacagtcgacgctacgacctctcctccactccctccgtcgtcgacgaccgtacggtggacacgtcgtctaccactactaccgtacgtcgggaccggactaacggtacgtaactacgttactaaccttaactttaagtttaacgttacggtaactaaccgaacgtaacggtaccggaaccggtacgggtacccctacctaataccctaactacgtctacgtcgtacgtacacttacgtcgttacgtacggaaccggtggggtccctacgtaggtacggtggtacgngggtacgtacgtaggtaacgtcgtacgggtactatacttccacctactacctactattaacgtagtaacgttctacggtactaacggttacgtaacttactttacgttaactaacttacttaacgtacgtaaacgtaactaaacggtaagtttacgtaacggttaccgggttttaaccggaaccgtaaaaccggtaacgtaaaccgttaaaaccggttaaacttaaacggttaaccgttacgtcggttcggtacctacccggttacaaccccgtttaggttaccttacccggttcttaaaccccttacttacccccgggtaccttaccgtaagttccttaacggcggtttaacccgg

SEQ ID NO: 137795 - DNA, 549 bp, Homo sapiens
  misc_feature: GYAE6OF01AHP51.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggccctaagctcctaatctatgctgcatccagtttgcaagtggggtcccatcgaggttcagtggcagtggatcgtgggacagatttcactctcaccatcagtaactctgcaacgtgaagtattttgactaacttattactagtacaactagtaacttacaattgtttaccggaccgtaagggactaacgtaacttaacaaacttaaacgaacttggtacgcgtagaccgtaccattacctggttaccttactacttccttaccccgacctacttctagtac

SEQ ID NO: 137796 - DNA, 540 bp, Homo sapiens
  misc_feature: GYAE6OF01EU671.46.67.G01.1.454.CMB.1.raw
tcagactagcagtacacgaccggtgctcgatttagagtatacatattgggtttgggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggccctaagctacctaatctatgctgcatccagtttgcaaaggtgggtcccatcgaggttcagtggcagtggatcgtgggacagtattcactctcaccatacaagtaatctagacaacgtagaagtatttgactaacttattactgtacaacagtaattacaattgtttacggaccgaagggacaacgaacttaaacaaacttaaacgaactagtaggactgacacctatcttgttaccttacacttcccttacccgaccacttctgtaac

SEQ ID NO: 137797 - DNA, 548 bp, Homo sapiens
  misc_feature: GYAE6OF01CVBYH.46.67.G01.1.454.CMB.1.raw
  modified_base (333)..(333): a, c, t, g, unknown or other
  misc_feature (333)..(333): n is a, c, g, or t
  modified_base (538)..(538): a, c, t, g, unknown or other
  misc_feature (538)..(538): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccgaggggaaggggctggaatacattggaagtgtctctcatagtggaggttctattacagtccgtctctcaagagtcgagtcaccatatctctggacacgtcagcaatcagttttccngaagatgagttctgtgaccgcgctgacacgggtctttattactgtgcgagacgacggctattatgttattttggagttggttattcgtacaccctagagtcggacggggttccgacccgtgggacagggatacgtggtcacgtctcctagcctcgaccaaggccctatccggtccttccccgtcggcctacccctccaccaacgngcctacccgg

SEQ ID NO: 137798 - DNA, 521 bp, Homo sapiens
  misc_feature: GYAE6OF01BGY9Y.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacactatttaaatgtatcaacatagaccagggacgccctaagctcctaatctatgctgcatccagtttgcaaagtgggtcccatcgagttcagtggcagtggatcgtgggacagtattcactctcacatcagtaatctgcaacgtgaagtatttgactaattattactgtacaactagtaacttactaattcgttttacggactaagggacacgtaactaaactaaattaaacgaacgtagtagtctagtacacctatctgtcttcacttctacccgactactctgtaac

SEQ ID NO: 137799 - DNA, 545 bp, Homo sapiens
  misc_feature: GYAE6OF01A4L4C.46.67.G01.1.454.CMB.1.raw
  modified_base (282)..(282): a, c, t, g, unknown or other
  misc_feature (282)..(282): n is a, c, g, or t
  modified_base (333)..(333): a, c, t, g, unknown or other
  misc_feature (333)..(333): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctcatcagtgtggtttctcgtgggctgggtccgcagctccgagggagggctggaatacattggaagtgtctctcatagtggaggttcctattacagtccgtctctcaagngtcgagtcaccatatctctggacacgtccagcaatctagttttcccagaanatgagttctgtgaccgcgctgacacgggtctttatactgtcgcgagagacgctattatgtagttttggagttggttatttcgacacctagactcggacgggctcggacccgtgggccagggactacgtggtcctaccgtctcctcgccctccaccgacggcccagtcccggtccttcccctcggccctaccccgtcccacgacgcgtacccg

SEQ ID NO: 137800 - DNA, 518 bp, Homo sapiens
  misc_feature: GYAE6OF01DXEHB.46.67.G01.1.454.CMB.1.raw
  modified_base (408)..(408): a, c, t, g, unknown or other
  misc_feature (408)..(408): n is a, c, g, or t
  modified_base (417)..(417): a, c, t, g, unknown or other
  misc_feature (417)..(417): n is a, c, g, or t
  modified_base (512)..(512): a, c, t, g, unknown or other
  misc_feature (512)..(512): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctattaaatggtatcaacatagaccaggacggccctaagctcctaatctatgctgcatccagtttgacaagtcgggtcccatcgaggttcagtggcagtgatcgtgggacagattcactctcacatcagtaatctgcaacgtgaagtatttgactaacttattactgtacaanagtaattanaattgtttcgacgaaggtacaacgaacttaactaaattaacgaactgtacggctagacctacattactgtacttcacttccttacccgactactntgtaac

SEQ ID NO: 137801 - DNA, 550 bp, Homo sapiens
  misc_feature: GYAE6OF01A7R40.46.67.G01.1.454.CMB.1.raw
  modified_base (327)..(327): a, c, t, g, unknown or other
  misc_feature (327)..(327): n is a, c, g, or t
  modified_base (373)..(373): a, c, t, g, unknown or other
  misc_feature (373)..(373): n is a, c, g, or t
  modified_base (378)..(378): a, c, t, g, unknown or other
  misc_feature (378)..(378): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccgagggagggctggaatacattggaagtgtctctcatagtggaggttcctattacagtccgtctctcaagngtcgagtcacatatctctggacacgtccagcaatctagttttcccngaagntgagttctggtcgaccgccgcgtgacgacgggtcgtttattactggtgcgagagacggtctattagtgtagttttggagttgttatttcgactacctagagtcggacggggtctccggacccgtgggccgagggtaactacgtcggtccaccgtcctccttagccctacccg

SEQ ID NO: 137802 - DNA, 509 bp, Homo sapiens
  misc_feature: GYAE6OF01ET28I.46.67.G01.1.454.CMB.1.raw
  modified_base (413)..(413): a, c, t, g, unknown or other
  misc_feature (413)..(413): n is a, c, g, or t
  modified_base (489)..(489): a, c, t, g, unknown or other
  misc_feature (489)..(489): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacactattaaattggtatcaacatagaccagggacggccctaagctcctaatctatgctgcatccagtttgacaaagtgggtcccatcgaggttcagtgcagtggatcgtgggacagatttcactctcaccatcaagtaatctagcaacgtgaagtatttgactaacttattactgtacaanagaattacaattcgtttcgacgaaggacacgtactaacaaagtaaacgaactgtacgactagacactatctgtctntactcctaccacatgtgtac

SEQ ID NO: 137803 - DNA, 564 bp, Homo sapiens
  misc_feature: GYAE6OF01DP4YV.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaaccggtgggagacagtgtcaccatcacttgccgggcaagtcgaacattgacactatttaatgtatcaacatagaccaggacggccctaagctctaatctatgctgcatccagtttgctaaaggtgggtcccagtcgaggttcagtgcaggtggatcgtgggacagtatttacacttctcaccatacagtaatctgactaacgtagaagtattttagactaactttattacttgtacaactaagtaattactaagttcgttttacggaccgtaaagggtactaacgtaactaaactaaattaaccgaactacgtaggtcctaggacctaacctattcttacgttactttacacttcccgttacccgcctaattccgtaggtaac

SEQ ID NO: 137804 - DNA, 552 bp, Homo sapiens
  misc_feature: GYAE6OF01DV0ZZ.46.67.G01.1.454.CMB.1.raw
  modified_base (191)..(191): a, c, t, g, unknown or other
  misc_feature (191)..(191): n is a, c, g, or t
  modified_base (226)..(226): a, c, t, g, unknown or other
  misc_feature (226)..(226): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaaccgtggganacagtgtcaccatcacttgccggcaagtcgaactntgacacttattaatgtatcaacatagaccaggacgccctaagctctaatctatgctgcatccagtttgacgaagtcgggtcccagtcgagttcagtgcagtgatctgggacagtatttcactctacaccatacagtaatctgacagtgaagtatttgactaacttattactgtacaatagtaatttacaatttggttttacgaccgtaaagggtacctaacgtaacttaactaaaacgttaaaccgtaactacggtaggtcctagtacctaaccgtattacgttgttaccttcaacctttccttaccccgacctactcgtagtaac

SEQ ID NO: 137805 - DNA, 611 bp, Homo sapiens
  misc_feature: GYAE6OF01C2S9A.46.67.G01.1.454.CMB.1.raw
  modified_base (217)..(217): a, c, t, g, unknown or other
  misc_feature (217)..(217): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggnaagtcggaacattgacactatttaaattggtatcaacatagacagggacggccctaagctcctaatctatgctgcatccagtttgcaaagtcgggtcccatcgaggttcagtggcagtggatcgtgggacagtactttcacttctacacctatctaagtaatctgacaacgtagaagttatttgactaactttattactgtacaactaagtaaatttactaagttcggttttaccggaaccgtaaaggggaacctaaaccggtaaccttaaactaaaacgtttaaaacggaaccttagggtacggtacgtacggtacctaaccgtattacgttcggttaccctttacctacttacccctttaccccggacccttaacgttccgttagttaaacg

SEQ ID NO: 137806 - DNA, 608 bp, Homo sapiens
  misc_feature: GYAE6OF01EO3ZD.46.67.G01.1.454.CMB.1.raw
  modified_base (566)..(566): a, c, t, g, unknown or other
  misc_feature (566)..(566): n is a, c, g, or t
  modified_base (597)..(597): a, c, t, g, unknown or other
  misc_feature (597)..(597): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtcgcctcatcagtagtggttctcgtgggctgggtccgcagcctccgaggggagggctaggaatacgagttggaagtgtctctcagtagtggtagttcctattacacgtccgtctctacaagtacgtcgacgtcaacctatactctctacggacctaccgtccaagctaaattcctacgttttcccagaagtatgtacgttctcggtcgaccgtccgtctacggacgtacgggtctttactacgtgtggacgaggacgtacgtattattagttgttattttgggtagttaggttacttacgtactacccgtagtacgtcgggtacgggtcctccgaccgtcgggaccgaggtactcgtacggtcctaccgtctcgtcgtcctaccgacgaccggtccncgtccgtccctcccgtcgtcccaccctaccncacgctacccg

SEQ ID NO: 137807 - DNA, 555 bp, Homo sapiens
  misc_feature: GYAE6OF01EQTKV.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacactatttaaatggtatcaacatagaccagggacggccctaagctacctaatctatgctgcatcctagtttgacgaaagtggggtacccagtcgtaggttcagtggcagtggatcgtgggactagtactttcactctcacctatacagtatctgacaacgtgaagtatttagacttaacttattactgtacaactagtaacttacaattcggtttcgacgtaaggacctacgtaactaacaaattaacgaacgtgtaggtactagaccgaccgtattacgttcttaccttctacttaccgttacccgacctattccgtgtaac

SEQ ID NO: 137808 - DNA, 545 bp, Homo sapiens
  misc_feature: GYAE6OF01DR4KV.46.67.G01.1.454.CMB.1.raw
  modified_base (217)..(217): a, c, t, g, unknown or other
  misc_feature (217)..(217): n is a, c, g, or t
  modified_base (409)..(409): a, c, t, g, unknown or other
  misc_feature (409)..(409): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggnaagtcggaacattgacacctatttaaatgtatcaacatagaccaggacggccctaagctacctaatctatgctgcatccagtttgcaaaggtcgggtcccatcgaggttcagtggcagtggatcgtgggacagtactttcactctcaccatcagtatctgcaacgtagaagtatttgactaacttattactntacaactaagtaattactaattgtttacggaccgtaagggaacctaacgtaactaaactaaagtttaaacgaacttgtacgactgacctacctattcttagtccttacacttccttacccacctactcgtcgtaac

SEQ ID NO: 137809 - DNA, 608 bp, Homo sapiens
  misc_feature: GYAE6OF01CRG3I.46.67.G01.1.454.CMB.1.raw
  modified_base (192)..(192): a, c, t, g, unknown or other
  misc_feature (192)..(192): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccgggcaagtcggaacattgacacctatttaaattggtatcaacatagaccagggaccggccctaagctcctaatctatgctgcatccagtttgactaaaggtcggggtcccagtcggaggttcagtggcaggtggatcgtagggactagtatttcactctacacctatacagttaactctagactaacgtagaacgtatttcgactaactttattacttgtacaactaagtaacttaactaagttcgttttaccggaccgtaagggaacctaacggtaacttaaacgttaaaacgttaaaccgaacgttaggtacggaccgttacgacctacccgtagttccttcggttaccctttctaacgttcccgttaccccgaccttacgtccttagtaacc

SEQ ID NO: 137810 - DNA, 940 bp, Homo sapiens
  misc_feature: GYAE6OF01EHCQR.46.67.G01.1.454.CMB.1.raw
tcagactagcagtacacgaccggtgctcgatttagagtatacatattgggtttgggggacctcctgtgcaagaacatgaagcacctgtggtttgtcctcctagctggtggcagctcccagagtcggtctcgtccgtggtgactaacgtgcgagggtacggtcccgggaccccaacgtacggttgggtaggacgggtcccgtttacgggaaccgtacccccgttccggtccccctacctaccgtcggcccgtcgttccggttccttccggttcggggtccgtcccccttaccctaacgttaccggtaagggtttacgggttttcgggttttttcccgtttccgggggtcggggggtccgggtttccggggggtccccggacgtaccggtccccgttaccccggggaaggggggaacgggggtccgttaagggtaaacctaacgttaggttaagggtaacggttcgttccttaccgtacgtaagtttaggggtaggggttaccggtttacctttaacgttacggtaccggttcccgttctactacgaaaggtcgtacgtacgtaccaacctatactccgttcggtacgacccgtaccgtaccgacgtaacttaactacgttttacccgttttcccgtaaggaaacgttacgttacggttacggtttcgttacgggttaccggaccccggtccggtacgttaccggaaccgggtacccgggtttacttttaacgttcggtggtcggacggtaagggtaccggtacggttactttagttagttgttttaaggttttcgggtagtttacggttttaacgttacccgtaaccttaccggtagtaccggtccggggtaccgggtccctacccgggcccgggtacgggacggtacgggtactcggtcggtacccgtacccgttccttaccgtccgcccgtaaccccgg

SEQ ID NO: 137811 - DNA, 548 bp, Homo sapiens
  misc_feature: GYAE6OF01CAXY3.46.67.G01.1.454.CMB.1.raw
  modified_base (334)..(334): a, c, t, g, unknown or other
  misc_feature (334)..(334): n is a, c, g, or t
tcagactagcagtacacgaccggtgctcgatttagagtatacatattgtgtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggaaggggctggaatacattggaagtgtctctcatagtggaggttcctattacagtccgtctctcaagagtcgagtcaccatatctctggacacgtccagcaatcagttttcccngaagatgagttctgtgaccgccgctgacacgggtctttatactgtgcgagagacggctattatgtattttggagttgttatttcgactaccctagatcgacggggctcgacccgtgggccgaggaatacgtggtacacgttctccttacgcctccgaccgaaggccctacgtccggtccttcccccgtggacccaccctccctccgaagtaccg

SEQ ID NO: 137812 - DNA, 615 bp, Homo sapiens
  misc_feature: GYAE6OF01CB9C9.46.67.G01.1.454.CMB.1.raw
  modified_base (335)..(335): a, c, t, g, unknown or other
  misc_feature (335)..(335): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccgagggaaggggctggaatacattggaagtgtctctcatagtggaggttcctattacagtccgtctctcaagagtcgagtcaccatatctctggacacgtcagcaatctagttttcccngaagtatgtagttctgtcgaccgccgctgacgacgggtctttatactgtgcgagagacggtctattatgtagttttggtagttggttatttcgaactacccgtagtacgtcggacggggtcctccggaccccgtggggacccgaggggtaactacgttcggtaccgtaccgttcctccgttacgccctacccgaacccgtaaccgggcccctacggttcccggttccccttccccccgtcggtcccctacccccttcccgtacccgaacgccgtaccccg

SEQ ID NO: 137813 - DNA, 528 bp, Homo sapiens
  misc_feature: GYAE6OF01EV9MR.46.67.G01.1.454.CMB.1.raw
  modified_base (228)..(228): a, c, t, g, unknown or other
  misc_feature (228)..(228): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacnttgacacctatttaaattggtatcaacatagaccagggacgccctaagctcctaatctatgctgcatccagtttgcaaaggtgggtcccagtcgaggttcagtggcagtgatctgggacagtatttcactctcaccatcagtaatctgacaacgtgtaagtatttgactaactttattactgtacaatagtaattactaattgtttacgaccgtaagggacaacgtactaactaaagttaacgaactgtacgctagctactattctgtaccttcactccttacccgactacttcgtgtac

SEQ ID NO: 137814 - DNA, 501 bp, Homo sapiens
  misc_feature: GYAE6OF01E4LUO.46.67.G01.1.454.CMB.1.raw
  modified_base (476)..(476): a, c, t, g, unknown or other
  misc_feature (476)..(476): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggccctaagctcctaatctatgctgcatccagtttgcaaagtgggtcccatcgaggttcagtggcagtggatctgggacagatttcactctcaccatcagtaatctgcaacgtgaagtattttgctaacttattactgtacaacagaattacaattgtttcggacaaggacacgactaacaaattaacgaactgtgctgcaccatctntcttcactcttccgctactctgtac

SEQ ID NO: 137815 - DNA, 566 bp, Homo sapiens
  misc_feature: GYAE6OF01ED1NS.46.67.G01.1.454.CMB.1.raw
  modified_base (435)..(435): a, c, t, g, unknown or other
  misc_feature (435)..(435): n is a, c, g, or t
tcagactagcagtacacgaccggtgctcgatttagagtatacatagttgggtttgggggagtctcggtcaggacacagcatggacatgagggtcccgctcagctcctggggctcctgctactctggctccggaggtgccagatgtgacatcgagctgacccagtctccatcctccctgtctgcaaccgtgggagacagtgtcaccatcacttggccgggcaagtcgaacattgacacttatttaaattgtatcaacatagaccaggacggccctaagctcctaatctatgctgcatccaagtttgaccaaaagttcggggcccaagtcgaggtttcagtggcagttggatctgggacaggatttcactctcactatcagtaactcttgcaacgtgaacgtatttacgctaaatttattacctggtactaaaacgngtaaacttataaattcggttttaacgaccgtaagggacgtaacgaacgtaactaaagttaacggaactgtacggctggacctaccgaattctggtccttacgacttaccttcccgactacttcgtcgtaac

SEQ ID NO: 137816 - DNA, 664 bp, Homo sapiens
  misc_feature: GYAE6OF01DJNR9.46.67.G01.1.454.CMB.1.raw
  modified_base (605)..(605): a, c, t, g, unknown or other
  misc_feature (605)..(605): n is a, c, g, or t
  modified_base (658)..(658): a, c, t, g, unknown or other
  misc_feature (658)..(658): n is a, c, g, or t
tcagactagcagtacacgaccggtgctcgatttagagtatacatattgggtttggggagtctcggtcaggacacagcatggacatgagggtccccgctcagctcctgggggctcctgctactctggctccgaggtgccagatgtgacatcgagctgacccagtctccatcctccctgtctgcaaccggtgggagactagtgtaccacctatctacgttcggccgggactaaggtacggaactattacgaaccttaacttaaattttaaagttggtataaccaaactagtaaccggaaccgacggggacccgtaccctaagccttacctaatcttatcgctcgtactacgttaaccgttggtttacgaacggtaaaggttccggggtaccctaaggttcggtaggtttacgagggtcggtacgtaggtagggtacttcgggtagggaactagttacctttacaacctctccaaacgtctacggtaaatactcgtacaacgttgtaagtaattttagtcactttaactacttagtactaaactataattacttaactagtttacggtacaacggtacgacgtaaactaacgtaaataacgtaacgtntaggtactcacgtacctacttattcgtcttacacctcttcccactattctgtnttaacg

SEQ ID NO: 137817 - DNA, 562 bp, Homo sapiens
  misc_feature: GYAE6OF01EPK0E.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggaagggctggaatacattggaagtgtctctcatagtggaggttcctattacagtccgtctctcaagagtcgagtcaccatatctctggacacgtccagcaatcagttttccctgaagatgagttctgtgaccgccgctgacgacgggcgttttaatactgtgcgagagacggctattagtgtattttggagttggttatttcgactacctagatcggacgggggctccgacccgtggggccgagggaatacgtggtcaccgtctccttagccctccaccgacgggtcccacgttccggtccttcccccgtcggtccctacccctccctccaacgcgtacccg

SEQ ID NO: 137818 - DNA, 573 bp, Homo sapiens
  misc_feature: GYAE6OF01ATNQO.46.67.G01.1.454.CMB.1.raw
  modified_base (331)..(331): a, c, t, g, unknown or other
  misc_feature (331)..(331): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctctggggctgggtccgcagctcccagggaggggctggaatacattggaagtgtctctcatagtggaggttcctattacagtccgtctctcaagagtcgagtcaccatatctctggacacgtccagcaatcagttttcccngaacgtatgagttctgtcgaccgcgctgaccgacgggtcgtttattacgtgtgcgagagacggctattatgtagttttggagttggttatttcgactacccgtagacgtcggacggggctccggacccgtggggaccgagggtatacgtggtaccacgtcctcgtacgcctaccgaccgacgggtccctacgtcccggtcccttcccccgtcggtccctacccctccctccaacgcgtaccc

SEQ ID NO: 137819 - DNA, 573 bp, Homo sapiens
  misc_feature: GYAE6OF01EGYB2.46.67.G01.1.454.CMB.1.raw
  modified_base (335)..(335): a, c, t, g, unknown or other
  misc_feature (335)..(335): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccaggggaaggggctggaatacattggaagtgtctctcatagtggaggttcctattacagtccgtctctcaagagtcgagtcaccatatctctggacacgtccagcaatcagttttcccngaagatgagttctgtcgaccgccgctgacacgggtcgttttattacgtgtgcgagagacggctattatgttatttttggagttggtttatttcgactaccctagactcggacggggctcgaccccgtggggccgagggtactacgtgtcaccgtctccgttagccctccgaccgaacgggcccagttcccggttcccttcccccgtgggccctacccctccctaccaacgcgtacccg

SEQ ID NO: 137820 - DNA, 548 bp, Homo sapiens
  misc_feature: GYAE6OF01BLBYV.46.67.G01.1.454.CMB.1.raw
  modified_base (212)..(212): a, c, t, g, unknown or other
  misc_feature (212)..(212): n is a, c, g, or t
  modified_base (372)..(372): a, c, t, g, unknown or other
  misc_feature (372)..(372): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtcccctcacctgcgctgtctctggtncctccatcagtagtggtttctcgtggggctgggtccgcagctccgagggagggctggaatacattggaagtgtctctcatagtggaggttcctattacagtccgtctctcaagagtcgagtcaccatatctctggacacgtcagcaatctagttttcccngaagatgtagttctgtcgaccgccgctagacgtacgggtcgtttatacgtgtgcgagagacggtctattatgtagttttggagttggttatttcgactacctagacgtcggtacgggctccggacccgtggggccaagggactacgtggtccaccgttctaccttcgccctacccg

SEQ ID NO: 137821 - DNA, 522 bp, Homo sapiens
  misc_feature: GYAE6OF01DS1OW.46.67.G01.1.454.CMB.1.raw
  modified_base (192)..(192): a, c, t, g, unknown or other
  misc_feature (192)..(192): n is a, c, g, or t
  modified_base (227)..(227): a, c, t, g, unknown or other
  misc_feature (227)..(227): n is a, c, g, or t
  modified_base (350)..(350): a, c, t, g, unknown or other
  misc_feature (350)..(350): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccgggcaagtcgaacnttgacactatttaaatggtatcaacatagaccagggacgccctaagctctaatctatgctgcatcagtttgcaaagtgggtcccatcgagtcagtgcagtgatcgtgggacagatttcactcncacatcagtatctgacaagtgaagtatttgactaactttattactagtacaacaagtaatttacaatttcgttttacggacctaagggactacgtaactaactaaattaaacgaacttagtggtcctagcaacctatcttgtcttcactccttacccgcctactcgtgtaac

SEQ ID NO: 137822 - DNA, 750 bp, Homo sapiens
  misc_feature: GYAE6OF01EBUIO.46.67.G01.1.454.CMB.1.raw
  modified_base (171)..(171): a, c, t, g, unknown or other
  misc_feature (171)..(171): n is a, c, g, or t
  modified_base (288)..(288): a, c, t, g, unknown or other
  misc_feature (288)..(288): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtncctcatcagtagtgtttctcgtgggctgggtccgcagcctccgagggagggctaggaatacagttggaatgtctctcagtagtggtacggttcctattacacgtccgtctctcaagngtcgagtcacatactctcgtgacacgtccagcaactctacgtttccagaagtatgtacgttctggtcgtaccgccgtcgtacgacgtacggggttacttttaacgtaccgttggtacggacgtaaggtacggtaccggtactttaagttagttagttaacgtttttgggtagtttaggtttacgtttccgtaacctaacccgttaagtacggtaccgggtaaccgggggtccgttacccggtaaccccggttcgggggacccgtaaggggtaaaccgttaccggttacgggtacccgttacccggttacccgtttacccgttaaccggtccccgtaaccccgtaacccggtaaacccgggtaccccgttaaccgggttaccccggttccccctttaaccccccggtccggtacccccgttacccccgttaccccgtaacccgtaaacggcccgtaaccccgg

SEQ ID NO: 137823 - DNA, 583 bp, Homo sapiens
  misc_feature: GYAE6OF01BTJ51.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctattaaattggtatcaacatagaccagggacgccctaagctcctaatctatgctgcatccagtttgcaaagtgggtcccagtcgaggttcagtggcagtggatctgggacagatttcactctcaccatcagtaatctgcaacgtgaagtatttgactaacgtttattactgtctaaactagtaaatttacgtaattggtttttaccggaccgtaaagggtaaccaacggtaactaacgtaaacttaaacgaaccttagttacgggtacttacggtaccaaccgtaacttcgtcgtttacctttacctaacgtttccctttacccccgccctacttccttggtaaacc

SEQ ID NO: 137824 - DNA, 575 bp, Homo sapiens
  misc_feature: GYAE6OF01DH2CG.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaaccgtgggagacagtgtcaccatcacttgccgggcaagtcggaacattgacacctatttaaatggtatcaacatagaccagggacgccctaagctctaatctatgctgcatccagtttgcaagtgggtcccatcgagttcagtgcagtgatcgtgggacagtatttcactctacaccatcagtaatctgactaacgtgaagtattttagactaacttattacttgtacaactaagtaacttaactaagttgttttaccggacctaaacgggtaccaacggtaacttaactaaaactttaaacgaacttaggtacgggctaggtaccaacctattccttggttaccctttacgtaaccttcccttaccccggcccttaacgttccttgttaaacg

SEQ ID NO: 137825 - DNA, 640 bp, Homo sapiens
  misc_feature: GYAE6OF01DXMXX.46.67.G01.1.454.CMB.1.raw
  modified_base (213)..(213): a, c, t, g, unknown or other
  misc_feature (213)..(213): n is a, c, g, or t
  modified_base (235)..(235): a, c, t, g, unknown or other
  misc_feature (235)..(235): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctcgtggtcncctcatcagtagtgtttctcgnggggctgggtccgcagcctccgaggggaagggctaggaatacgagttggaagtgtctctcagtggtggtacggttcctattacgacgttccgtctctacgaagtacgtcgagtaccactatactctcgtaggacctacgtcagactaattcgttaacgttttcccagaagtactggtacgttcgtggtacgacccgcgtcgtaggtaaccgtacgggttactttagttacgtggtacgcggtaagacggtacggtacttaagttagttagtttagttttgggagtttagtttactttccgaactacccgtaggtacgtcgggaccggggtccttacccggacccgggtgggaccgaacggtactaccggtacgtcgtacccgtccgttcctccgccctaacccgg

SEQ ID NO: 137826 - DNA, 522 bp, Homo sapiens
  misc_feature: GYAE6OF01EI4YH.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcgaacattgacactatttaaatgtatcaacatagacaggacggccctaagctcctaatctatgctgcatccagtttgcaaagtgggtccatcgagttcagtgcagtgatcgtgggacagattcactctcacatcagtaatctgacaacgtgaagtattttgactaacgtttattactagtacaaactagtaattaactaattgtttacgacctaagggactaacgaactaacaaattaaacgaactagtagactagacacctatactgtccttacacttccttacccgacctatctgtaac

SEQ ID NO: 137827 - DNA, 517 bp, Homo sapiens
  misc_feature: GYAE6OF01CLFAO.46.67.G01.1.454.CMB.1.raw
  modified_base (493)..(493): a, c, t, g, unknown or other
  misc_feature (493)..(493): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatgtatcaacatagaccagggaccgccctaagctcctaatctatgctgcatccagtttgacaaagtgggtcccagtcgaggttcagtggcagtggatctgggacagtatttcactctacacatcagtaatctgcaacgtgaagtattttgacaacttattactgtacaacagaattacaattgtttacgaccgtaagggactaacgactaaacaaattaaacgaactgtcgctgcacatctgttccttanacttccttacccgactatctgtac

SEQ ID NO: 137828 - DNA, 506 bp, Homo sapiens
  misc_feature: GYAE6OF01BCJ53.46.67.G01.1.454.CMB.1.raw
  modified_base (383)..(383): a, c, t, g, unknown or other
  misc_feature (383)..(383): n is a, c, g, or t
  modified_base (468)..(468): a, c, t, g, unknown or other
  misc_feature (468)..(468): n is a, c, g, or t
  modified_base (470)..(470): a, c, t, g, unknown or other
  misc_feature (470)..(470): n is a, c, g, or t
  modified_base (476)..(476): a, c, t, g, unknown or other
  misc_feature (476)..(476): n is a, c, g, or t
  modified_base (479)..(479): a, c, t, g, unknown or other
  misc_feature (479)..(479): n is a, c, g, or t
  modified_base (502)..(502): a, c, t, g, unknown or other
  misc_feature (502)..(502): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggccctaagctcctaatctatgctgcatccagtttgcaaagtgggtcccatcgaggttcagtggcagtggatcgtgggacagatttcactctcaccatcagtaatctgcaacgtnaagtattttagtaactttattactgtacaacagtaattacaattgttttcggcaagggacacgtactaacaaattaaacgactgngntgcacntcngtcttcattctcccgcatctgtntacg

SEQ ID NO: 137829 - DNA, 558 bp, Homo sapiens
  misc_feature: GYAE6OF01C1G2Q.46.67.G01.1.454.CMB.1.raw
  modified_base (192)..(192): a, c, t, g, unknown or other
  misc_feature (192)..(192): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccgggcaagtcggaacattgacactatttaaatgtatcaacatagaccaggacgccctaagctctaatctatgctgcatccagtttgactaaagtcgggtcccatcgaggttcagtggcagtggatcgtgggacagtatttcacttctcaccatcataatctgactaacgtgaagtattttagactaactttattactagtacaactagtaaattactaattcgtttaccggaccgtaaggactaacgtaacttaactaaacttaaacgaacttaggtagacgttagacctacctattcgttcgttcctttactacttcccttaccccgtacctaacttcgtgtaac

SEQ ID NO: 137830 - DNA, 575 bp, Homo sapiens
  misc_feature: GYAE6OF01BZKUB.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtgggagacagtgtcaccatcacttgccggcaagtcgaacattgacacttatttaaatgtatcaacatagacgagggaccgccctaagctcctaatctatgctgcatccagtttgacaaagtcgggtacccagtcgagttcgagtgcagtggatcgtaggacagtattcactctcaccatctagtaactcgtagactaacggtagtaagttatttacgacttaactttattactagtaactaactaagtaacttactaagttcggtttaccgaccgtaagggacctaacgtaacttaaacgaaacttaacgaacttggtacgtactacgacctaaccgtattacttgttaccttacgtaccttccgttaccccgtatacttcgtgtaac

SEQ ID NO: 137831 - DNA, 578 bp, Homo sapiens
  misc_feature: GYAE6OF01AE9LO.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccgagggaaggggctggaatacattggaagtgtctctcatagtggaggttcctattacagtccgtctctcaagagtcgagtcaccatatctctggacacgtccagcaatctagttttccctgaagatgagttctgtcgaccgccgcgtgacacgggtcgtttattactgtgcgagagacggcttattatgtattttggagttggtttatttcgacctacccgtagtacgtcggaccgggggtctccggtaccccgtgggggtacccgaggggtaacgtacgttcggttaccaccggttaccttcccgttagcccctaccccgg

SEQ ID NO: 137832 - DNA, 509 bp, Homo sapiens
  misc_feature: GYAE6OF01C3CZS.46.67.G01.1.454.CMB.1.raw
  modified_base (482)..(482): a, c, t, g, unknown or other
  misc_feature (482)..(482): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacaccttatttaaattgtatcaacatagaccagggacgccctaagctcctaatctatgctgcatccagtttgacaaagtgggtccatcgagttcagtggcagtggatcgtagggacagtatttcactctacacctatcaagtatctagacaacgtagaatatttgactaattattactgtacaacagtaatactattgtttcgacaaggacaagactaactaaataacgaactgtagctagacactatctntcttcactccttcccgactatctgtac

SEQ ID NO: 137833 - DNA, 615 bp, Homo sapiens
  misc_feature: GYAE6OF01C6OUK.46.67.G01.1.454.CMB.1.raw
  modified_base (193)..(193): a, c, t, g, unknown or other
  misc_feature (193)..(193): n is a, c, g, or t
  modified_base (219)..(219): a, c, t, g, unknown or other
  misc_feature (219)..(219): n is a, c, g, or t
  modified_base (229)..(229): a, c, t, g, unknown or other
  misc_feature (229)..(229): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtggganacagtgtcaccatcacttgccggganagtcggaacntgacactattaaattgtatcaacatagaccagggaccggaccctaagctacctaatctatgctgctatcctagttttgacgaaaaggttcggggtacccctagtccggtaaggtttcgaaggtggactaggtggactcgtggggaactaggtactttcactctacaccatcagtatctgacaacgtagaattatttcgactaattacttactagtacaaacgtaagtaactttaactaagtttcggttttacggaaccgtaaggtaaccacgtaacctaaagttaaaacgttaacgtaagttacggtacggtacctacggacctaaccgtattacggttcgttacttctaaccttcccgttacccgaccttagtacctgttaaccg

SEQ ID NO: 137834 - DNA, 584 bp, Homo sapiens
  misc_feature: GYAE6OF01B5487.46.67.G01.1.454.CMB.1.raw
tcagactagcagtacacgaccggtgctcgatttagagtatacatattggggtttagggggagtctcggtcaggacacagcatggacatggaaggggtccccgctcagctcctggggctcctgctactctggctccgaaggtgccagatgtgacatcgagctgacccagtctccatcctccctgtctgcaaccgtgggagacagtgtcaccgatccgacttggccgggcaaggtcggaacagttgactacctatttaaatggtatcaacatagaccagggacggccctaagctcctaatctatgctgcatccgagtttgcaaacgtcggggtcccagtcggtaggttcaggtggcagtggatcgtgggacagtatttcactctacaccatcaagtaatctagacaacgtgaagtatttagactaacttattactgtactaacagtaactactaattgtttacggacgtaacgggactaaccgtaactaactaaacgttaaaccgaacgttacggtcgtactcggtaacctaccgtattcgtcgtaccttccaacttccttaccccggtactacgttcttggtaac

SEQ ID NO: 137835 - DNA, 573 bp, Homo sapiens
  misc_feature: GYAE6OF01BX6EQ.46.67.G01.1.454.CMB.1.raw
  modified_base (219)..(219): a, c, t, g, unknown or other
  misc_feature (219)..(219): n is a, c, g, or t
  modified_base (230)..(230): a, c, t, g, unknown or other
  misc_feature (230)..(230): n is a, c, g, or t
  modified_base (568)..(568): a, c, t, g, unknown or other
  misc_feature (568)..(568): n is a, c, g, or t
tcagactagcagtacacgaccggtgctcgatttagagtatacatattgggtttgggggagtctcggtcaggacacagcatggacatgagggtccccgctcagctcctggggctcctgctactctggctccgaggtgccagatgtgacatcgagctgacccagtctccatcctccctgtctgcaaccggtgggagacagtgtcaccatcacttgccgggnaagtcggaacnttgacacttatttaaatgtatcaacatacgacagggaccgccctaagctacctaatctatgctgcatccgtagtttgactaaaggtcgggtacccagtcggtaggttcaggtggctaggtgatcgtgggacagtattcactctacacatctataatctagactaagtgaagtatttgaacttaacgttattactagtacctaataagtaactttaactaagtttcggtttaccggaacgtaaacggtactaaacgtaacttaactaaaagttaaacgaacgttaggtagacttcgactactatcgtacttctacgtacttcctacccgactactcgtntaacg

SEQ ID NO: 137836 - DNA, 658 bp, Homo sapiens
  misc_feature: GYAE6OF01DSG2B.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgaccggtgaggccttcggagacccctgtccctcacctgcgctgtctctggtgcctccatcagtagtggtttcttcgtggggctgggtccggcagcctcccgagggaaggggctggaatacagttggaagtgtctctcatagtggaggttcctattacagtccgtctctcaagagtcgagtcaccatatctctggacacgtcagcaatctagttttcccagaagatgagttctgtcgaccgcgctagacgtacgggtcttttatcgtgtgacgagagacgtacttattagtgttagttttggagttgtttactttcgacctaccgtagtacgtcgggacgggtctccggtacccggtcggggtaccgacgggtaacgttacgtcgggttacgacccgttccgttaccgttacgtccctacccgaaccggtaaccgggtcccctaaggttccccgggttacccctttccccccggtacggtacccccttacccccgttacccctaacccggtaacggtaccgtccccgttaaccccgggg

SEQ ID NO: 137837 - DNA, 618 bp, Homo sapiens
  misc_feature: GYAE6OF01BVVNW.46.67.G01.1.454.CMB.1.raw
  modified_base (354)..(354): a, c, t, g, unknown or other
  misc_feature (354)..(354): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggacaagtcggaacattgacaccttatttaaatggtatcaacatagacagggacggccctaagctcctaatctatgctgcatccagtttgacaaaggtgggtcccatcgaggttcaggtgctagtgatcgtaggacagtnttcactctacacatcagtaatctagacgacgtagaagtattttgactaacttattaacgtgtactaaactaagtaaacttaataatttacggtttttaccggaaccgtaacgggaaccgtaaaccggtaaaccttaaacgtaaaacgtttaaaaccggaaaccgttaggttaacggtacgttacggaccctaaaccgtacttacttacggttcctttactaacctttcccttaccccggtacctaacgttccttagttaaaccg

SEQ ID NO: 137838 - DNA, 562 bp, Homo sapiens
  misc_feature: GYAE6OF01B0LZY.46.67.G01.1.454.CMB.1.raw
  modified_base (460)..(460): a, c, t, g, unknown or other
  misc_feature (460)..(460): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccaggggaaggggctgggaatacattggaagtgtctctcatagtggaggttcctattacagtccgtctctcaagagtcgagtcaccatatctctggacacgtccagcaatctagttttccctgaagatgagttctgtcgaccgccgctgacgacgggtctttattactgtgcgagagacggctattatgttagttttggagttggttatttcgactaccgtagctcggacggggctccggcccgnggggccagggtatacgtggtcaccgtctcctagccctaccgaccgacggcccacgtccggttcccttcccccgtcgtcccaccctcccaccgagcgtacccg

SEQ ID NO: 137839 - DNA, 534 bp, Homo sapiens
  misc_feature: GYAE6OF01DI6EH.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatgtatcaacatagaccaggacgccctaagctcctaatctatgctgcatccagtttgacaaagtgggtacccatcgaggttcagtggcagtggatcgtgggacagtatttcactctcacatcagtaatctgcaacgtgaagtatttgactaacttattactgtacaactagtaacttactaattcgtttacgaccgtaaggactaacgaacttaactaaagttaaacgaactagtacggctagactacctaattctgttaccttctactccttacccgactatcctgtaac

SEQ ID NO: 137840 - DNA, 714 bp, Homo sapiens
  misc_feature: GYAE6OF01BOI48.46.67.G01.1.454.CMB.1.raw
  modified_base (192)..(192): a, c, t, g, unknown or other
  misc_feature (192)..(192): n is a, c, g, or t
  modified_base (226)..(226): a, c, t, g, unknown or other
  misc_feature (226)..(226): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccggcaagtcgaacnttgactacttatttaaatgtatcaacatagaccgagggacgaccctaagctacctaatctatgctgcactccgtaggtttcgacgtaaaggttcggggtacccctagttacggtaggtttccgaaggtcggactaggttagggtattcggtaggggaacctaaggttactttccaacgttcctacccaaaccgtatacgtaacgttaaacttcgtaggtaaccgtaacgttaggtaaagttaacgttttgaaccttaaactttaatttaacgttacgttaactaaactagtaaactttacgtaagttttcggtttacggaaccgttaaagggaacctaaccggttaaacttaaacgtaaaactttaaaccgacgtttaggtacggtaaccgtcgtaacccgaaccgttaattaccggtttacgttacccgtttacctaacccgtttacccgttacccccggtaattacccgttactacggtttaaacc

SEQ ID NO: 137841 - DNA, 522 bp, Homo sapiens
  misc_feature: GYAE6OF01CMZOU.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggccctaagctcctaatctatgctgcatccagtttgcaaaagtcgggtcccagtcgaggttcagtggcagtggatcgtgggacaggatttcactctacaccatcagtaatctgacgaacgtgaagtattttgactaacttatacttgtacaacagtaattacaattgtttcgacgaagggactacgtactaactaaattaacgaactgtgactgacacctatctgtcttacacttcctcccgctactctgtaac

SEQ ID NO: 137842 - DNA, 716 bp, Homo sapiens
  misc_feature: GYAE6OF01CU0BF.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctcgtgggctgggtccgcagctcccgaggggaagggctggaatacgagttggaagttgtctctcagtagtggtaggttcctattacagtccgtctctacaagagtcgagtcacctatactctctggacacgtccagactaatcgtacgttttcccagaagtatgtaagtttcgtgtcgacccgccgtcgtacggaaccgtacggggttacttttaagttaccgtggtacggacgaaggacggtacggtactttaagttagttagtttagtttttagggagtttaggtttacgtttacgtaaccgtacccgttaaggtaccgttaccgggtacggggtcccttacccgggtaccccggtgggggacccgtaaggggtaacttaccggttcgggttaccgtacccggttcctacccgttaccgccccgttacccgaacccggtaaccgggtcccctacggttcccggttcccccttacccccgtccggtacccctaccccttacccgtacccgtaacgccgtaccccg

SEQ ID NO: 137843 - DNA, 542 bp, Homo sapiens
  misc_feature: GYAE6OF01EX3ZR.46.67.G01.1.454.CMB.1.raw
  modified_base (379)..(379): a, c, t, g, unknown or other
  misc_feature (379)..(379): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggaaggggctggaatacattggaagtgtctctcatagtggaggttcctattacagtccgtctctcaagagtcgagtcaccatatctctggacacgtccagcaatctagttttccctgaanatgagttctgtcgaccgccgctgacgacgggtcgtttattactgtgcgagagacggctattatgtagttttggagttgtttatttcgactacctagagtcggacggggctccggacccgtggggccagggactacgcgtccgaccgtcttcctcgcctacccg

SEQ ID NO: 137844 - DNA, 701 bp, Homo sapiens
  misc_feature: GYAE6OF01BUD6I.46.67.G01.1.454.CMB.1.raw
  modified_base (197)..(197): a, c, t, g, unknown or other
  misc_feature (197)..(197): n is a, c, g, or t
tcagactagcagtacacgaccggtgctcgatttagagtatacatattgggtttggggagtctcggtcaggacacagcatggacatgagggtccccgctcagctccgtggggctcctgctactctggctccggaggtgccagatgtgacatcgagctgacccagtcctccatccctccctgtctgcaaccggtggganacagtgtccaccatcacgttggccgggacaaggtcggaactattgacctaccttaatttaaattggtatacaacatacgaccgagggaccgaccctaagcctacctaatctatgactgctactcctagtttcgacgtaaggttcgggtaccctagtaccggaggtttacaggttcggactaagggtcggtacgttacggtacggggtaactaaggttactttcccaaccttcctaccaaccgtaatcgtaaacgttaacttcgtaacgtaccgtaaacgttaggtaaagtttatttacggtaacctttaaagtttaacgttacttaggtaacctaaagtaacgttaaattaacttaaggtttacggtttaacggacccgtaaagggactaacgtaacttaaacaaacgttaaacgaccgttggtacgaccgttacgacctacgttattaccttcgttacttaccgtacctttaccgtacccctagttacttaccgtgttaaacc

SEQ ID NO: 137845 - DNA, 601 bp, Homo sapiens
  misc_feature: GYAE6OF01CYHH8.46.67.G01.1.454.CMB.1.raw
  modified_base (364)..(364): a, c, t, g, unknown or other
  misc_feature (364)..(364): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggttttcttcgtggggctgggtccggcagctcccaggggaaggggctggaatacattggaagtgtctctcatagtggaggttcctattacagtccgtctctcaagagtcgagtcaccatatctctggacacgtccagcaatcagttttccagaagatgagttctgtgaccgcgctgacncgggtctttatactgtgcgagagacgcttattatgttagttttggagttggtttattcgtactacccgtagacgtcggacgggggtcctacgaccccgtggggacccgaagggtaactacgtggtaccaccgtctaccgttacgccctaccaacccgtaacgggtccctaacgttcccggttccctttccccccgtcggtacccctacccccttcccgtacccaacgtacgtacccg

SEQ ID NO: 137846 - DNA, 611 bp, Homo sapiens
  misc_feature: GYAE6OF01DZ4LY.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacactattaaatgtatcaacatagaccagggacgccctaagctctaatctatgctgcatcctagtttgacgaaagtgggtcccagtcgaggttcagtggcagtgatcgtggacagtactttcactctcaccatcaagtaatctgactaacgtgaaagtatttagactaacttattactacgtacaaactaagtaactttaactaagtttacgttttacgggaaccctaaaggggtaacctaaccggtaaaccttaaacgtaaaaacgtttaaaacggaaaccgttaggtacgggtaccttaggaccctaaccctaattccgttcgttaccctttaccgaactttcccgtttacccccgaccttaacttccgtagttaacc

SEQ ID NO: 137847 - DNA, 501 bp, Homo sapiens
  misc_feature: GYAE6OF01CARM4.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccaggacggccctaagctcctaatctatgctgcatccagtttgcaaagtgggtcccatcgagttcagtggcagtggatctgggacagatttcactctcaccatcagtaatctgcaacgtgaagtattttgactaacttattactgtcaacagaattacaatgtttacggacctaagggacacgactaacaaattaacgaactgtgctgcaccatctgtcttcatccttccaccatctgtac

SEQ ID NO: 137848 - DNA, 528 bp, Homo sapiens
  misc_feature: GYAE6OF01EW0I1.46.67.G01.1.454.CMB.1.raw
  modified_base (421)..(421): a, c, t, g, unknown or other
  misc_feature (421)..(421): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgactcagtctccatcctccctgtctgcaaccgtgggagacagtgtcaccatcacttgccgggcaagtcgaacattgacactatttaaattgtatcaacatagaccagggaccggaccctaagctcctaatctatgctgcatccagtttgctaaagtgggtcccatcgaggttcagtggcagtggatcgtgggacagtattcactctcaccatctagtaactctgactaacgtagtaagtattttgacctaacttattactgtacaanagtaattacaattgtttacgacgaaggtacaacgtaactaactaaattaacgaacgtgtaggactagcacacttctgttcttactacttccttacccgctatctacg

SEQ ID NO: 137849 - DNA, 516 bp, Homo sapiens
  misc_feature: GYAE6OF01AQ68U.46.67.G01.1.454.CMB.1.raw
  modified_base (494)..(494): a, c, t, g, unknown or other
  misc_feature (494)..(494): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggccctaagctcctaatctatgctgcatccagtttgcaaagtgggtcccatcgaggttcagtggcagtggatctgggacagatttcactctcaccatcagtaatctgcaacgtgaagtattttgactaactttattactgtactaacagtaattacaattgttttcggaccaagggacacgtaactaacaaattaacgaactgtagactagcacctatctgtcttnacttcttcccgctactctgtac

SEQ ID NO: 137850 - DNA, 506 bp, Homo sapiens
  misc_feature: GYAE6OF01A6W02.46.67.G01.1.454.CMB.1.raw
  modified_base (471)..(471): a, c, t, g, unknown or other
  misc_feature (471)..(471): n is a, c, g, or t
  modified_base (498)..(498): a, c, t, g, unknown or other
  misc_feature (498)..(498): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggccctaagctcctaatctatgctgcatccagtttgcaaagtggggtcccatcgaggttcagtggcagtggatctgggacagatttcactctcaccatcagtaatctgcaacgtgaagattttgactaacttattactgtcaacagaattacaattgttttacggaccaagggacacgtaactaacaaattaacgaactgtgntgcacatctgtcttcactctcccgacntcctgtac

SEQ ID NO: 137851 - DNA, 778 bp, Homo sapiens
  misc_feature: GYAE6OF01A5E2K.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttcggccgatacgacgactgtcgactacttaattaagtagtatacaactagtaccgacggacgggacccgtaccgtaacgtcctaacctacttactagtcgtcgtcgactacctacgttaggttacgaaacggtaaggggttcccgggtacctacggtacgggttacgttacggtagggtcgacggtagggtagtacgttacgggacggtaacgtaagttacgtttacctaccttccctaaccgtaacctaacgttacgtaaagtttacctcggtaacgaacggtaacggttaaggtaaactttttgttacgtaaacctttaaattttaccttaacgttacgtaaacctaaaaggtaacgttttaaacgttaaaccttaagggtttttacccgggttaacccggaaacgggtaaacggtacctaaacccggtttaaataaaaccgtttaaaagttaaacccgaaggtttggaccttacggaccgaccttaaaccgtgtttaccgttcgtttaccctaactttaccgtttcccccgtaccccgaagttaaccttccgtaaggttaaacccc

SEQ ID NO: 137852 - DNA, 691 bp, Homo sapiens
  misc_feature: GYAE6OF01CQSJS.46.67.G01.1.454.CMB.1.raw
  modified_base (193)..(193): a, c, t, g, unknown or other
  misc_feature (193)..(193): n is a, c, g, or t
  modified_base (222)..(222): a, c, t, g, unknown or other
  misc_feature (222)..(222): n is a, c, g, or t
tcagactagcagtacacgaccggtgctcgatttagagtatacatattgggtttggggagtctcggtcaggacacagcatggacatgagggtccccgctcagctccgtggggctcctgctactctggctccgaggtgccagatgtgacatcgagctgacccagtctccatcctcctgtctgcaaccggtggganacagtgtcaccatcacgttggccgggtanaaggtcggaacatttcgaacctaaccttaattttaaacgttggtatcaacatagaccagggacgccctaagctcctaatctatgctgcatccagtttcgacaaaggtcgggtacccagtcgaggtttcaaggttcggacgtaggtggaatcgtaggggaactaggtacttttacacttcgtacaacctaactacgtaacgttaactcgttacgaccgtaaacggttaggtaaacgtttagtttttacggaacttaaacttttaatttacttaggtaacctaaacgtaagttaaactttaacgtaaacgtttcggttttaaccggaaccgtaaacgggtacctaacgtaaccttaaacgtaaaacttaaacggaaacgttaggtacggtaccttacggacctaaccgtacttacgttacgttaccttactacgtttcccgttaccccgacttacgtccgttagttaaccg

SEQ ID NO: 137853 - DNA, 624 bp, Homo sapiens
  misc_feature: GYAE6OF01EVF1V.46.67.G01.1.454.CMB.1.raw
  modified_base (192)..(192): a, c, t, g, unknown or other
  misc_feature (192)..(192): n is a, c, g, or t
  modified_base (226)..(226): a, c, t, g, unknown or other
  misc_feature (226)..(226): n is a, c, g, or t
tcagactagcagtacacgaccggtgctcgatttagagtatacatattgggtttggggagtctcggtcaggacacagcatggacatgagggtccccgctcagctcctggggctcctgctactctggctcgaggtgccagatgtgacatcgagctgacccagtctccatcctccctgtctgcaaccggtggganacagtgtcaccatcacttgccggcaagtcgaacnttgactacctatttaaatgtatcaacatagaccagggacgccctaagctacctaatctatgctgcatccgtagtttgacgtaaaggttcgggtaccctaagttcggtaggttcagtcggactaggtagtatcgtagggaactagtatttacgactctcaaccgtatcgagtaatctgacaacgtgaagtatttagactaacgtttattactcgtaactaactaagtaacttaactaagtttacgttttaccggaaccgtaaagggtacctaaacgtaacgttaaactaaagttaaaaccgtaacgttaggtacgtcgtaacgaccgtaaccgtattaccgttcgttacctttcctaactttcccgttacccgtacccttacgttcgtacgttaaaccg

SEQ ID NO: 137854 - DNA, 518 bp, Homo sapiens
  misc_feature: GYAE6OF01DS3WG.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccaggacggccctaagctcctaatctatgctgcatccagtttgcaaagtgggtcccatcgaggttcagtggcagtggatcgtgggacagatttcactctcacatcagtaatctgcaacgtgaagtatttagactaactttattactgtacaactagtaattacaattgtttacgactaagggacaacgactaacaaattaacgaactgtaggctagacacctatcttgtacttcaacttccttacccgcctatctgtac

SEQ ID NO: 137855 - DNA, 582 bp, Homo sapiens
  misc_feature: GYAE6OF01C8RWP.46.67.G01.1.454.CMB.1.raw
  modified_base (285)..(285): a, c, t, g, unknown or other
  misc_feature (285)..(285): n is a, c, g, or t
  modified_base (318)..(318): a, c, t, g, unknown or other
  misc_feature (318)..(318): n is a, c, g, or t
  modified_base (340)..(340): a, c, t, g, unknown or other
  misc_feature (340)..(340): n is a, c, g, or t
tcagactagcagtacacgaccggtgctcgatttagagtatacatattgggtttgtcctcctgctggtggcagctcccagatgggtcctgtccctggtgcaactgcaggagtccgggcccacgactggtgaggccttcggagaccctgtccctcacctgcgctgtctctggtgcctccatcagtagtgtttctctgggctgggtccgcagctcccgagggagggctggaatacagttggaagtgtctctcatagtggaggttcctattacagtccgtctctcaagngtcgagtcaccatactctctggaccacgtccancaatctacgttttcccagaagntgagttcgtgtcgaccgcgctagacgtcgggtctttatactgtgacgagagacgtctattagttgtagttttggagttgttagttcgactaccgtagtacgtcggaccgggcctccggacccgtggggaccgagggtaactcgtacggtcctaccggttcctccgttacgccctaccgaccgacggtcccacgttcccgtccttcccccgcgtccctacccctacctccgaacgcgtacccg

SEQ ID NO: 137856 - DNA, 515 bp, Homo sapiens
  misc_feature: GYAE6OF01BKL61.46.67.G01.1.454.CMB.1.raw
tcagactagcagtacacgaccggtgctcgatttagagtatacatattgggtttgggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctattaaattggtatcaacatagaccagggacggccctaagctcctaatctatgctgcatccagtttgcaaagtgggtcccatcgaggttcagtggcagtggatctgggacagatttcactctcaccatcagtaatctgcaacgtgaagtattttgactaactttattactgtacaacagtaatttacaattgttttacggacctaagggactacgtaactaacaaattaaacgaactgtaggctgactaccatctgtctcatcttcccacatctgtac

SEQ ID NO: 137857 - DNA, 524 bp, Homo sapiens
  misc_feature: GYAE6OF01DIOH4.46.67.G01.1.454.CMB.1.raw
  modified_base (306)..(306): a, c, t, g, unknown or other
  misc_feature (306)..(306): n is a, c, g, or t
  modified_base (357)..(357): a, c, t, g, unknown or other
  misc_feature (357)..(357): n is a, c, g, or t
  modified_base (511)..(511): a, c, t, g, unknown or other
  misc_feature (511)..(511): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggccctaagctactaatctatgctgcatccagtttganaagtgggtcccatcgaggttcagtggcagtggatcgtgggacagtatttcnctctcacatcagttaatctgactaacgtagaagtattttgactaactttattactgtacaatataattactaattgtttcgacaagggactacgactaacaaattaacgaactgtaggctgaccacctatcttgttcttctacttccttacccnctactcctgtaac

SEQ ID NO: 137858 - DNA, 555 bp, Homo sapiens
  misc_feature: GYAE6OF01EKP5T.46.67.G01.1.454.CMB.1.raw
  modified_base (192)..(192): a, c, t, g, unknown or other
  misc_feature (192)..(192): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccgggcaagtcggaacattgacactatttaatgtatcaacatagaccagggacgccctaagctcctaatctatgctgcatcctagtttgactaaaggtgggtcccagtcgtaggttcaggtgcagtgatcgtgggactagtactttcactctacacctatctaagtaatctagactaacgtgtaagttatttagactaaactttattactgtactaaactagtaattactaagttcgtttacggaccgaagggacctaacgtaactaaactaaattaaaccgattggtacgtactagacctacctattctcgttcttactacttcctcccgactattctgtaac

SEQ ID NO: 137859 - DNA, 508 bp, Homo sapiens
  misc_feature: GYAE6OF01CL1GM.46.67.G01.1.454.CMB.1.raw
  modified_base (383)..(383): a, c, t, g, unknown or other
  misc_feature (383)..(383): n is a, c, g, or t
  modified_base (408)..(408): a, c, t, g, unknown or other
  misc_feature (408)..(408): n is a, c, g, or t
  modified_base (481)..(481): a, c, t, g, unknown or other
  misc_feature (481)..(481): n is a, c, g, or t
  modified_base (505)..(505): a, c, t, g, unknown or other
  misc_feature (505)..(505): n is a, c, g, or t
tcagactagcagtacacgaccggtgctcgatttagagtatacatattgggtttggggagtctcggtcaggacacagcatggacatgagggtccccgctcagctcctggggctcctgctactctggctcgaggtgccagatgtgacatcgagctgacccagtctccatcctccctgtctgcaaccgtgggagacagtgtcaccatcacttgccgggcaagtcggaacattgacacctatttaaaatggtatcaacatagaccagggacggccctaagctcctaatctatgctgcatccagtttgcaaaagtgggtcccatcgaggttcagtggcagtggatctgggacagaatttcatctcaccatcagtaatctgcaaacgtnaaagaattttgcaattattactgtnaacagaaattacaaatgttttcggcaagggacacgaactaacaaattaaacgaaactgtaggctgcacatctntctctatctacccgtccactcctntac

SEQ ID NO: 137860 - DNA, 629 bp, Homo sapiens
  misc_feature: GYAE6OF01CVSZG.46.67.G01.1.454.CMB.1.raw
  modified_base (228)..(228): a, c, t, g, unknown or other
  misc_feature (228)..(228): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacnttgacactatttaaatggtatcaacatagaccagggacgccctaagctcctaatctatgctgcatccagtttgcaagtgggtcccatcgaggttcagtggcagtgatcgtggacagatttcactctcaccatcagtaatctgactaacgtgtaagtattttacgactaacgttatttactacgttacaaactaaggtaaatttaactaacgtttggtttttacccggacgtaaacggggacctaaaccggtaacttaaaccgtaaaagtttaaaccggtaaaccgttaaggttacggaccgttaaccggacctaaacccgtagtttaccttcggtttacctttaccgtactttacccctttacccccggtacccttaacgttcccttacggtttaaacccg

SEQ ID NO: 137861 - DNA, 582 bp, Homo sapiens
  misc_feature: GYAE6OF01EUIQG.46.67.G01.1.454.CMB.1.raw
  modified_base (99)..(99): a, c, t, g, unknown or other
  misc_feature (99)..(99): n is a, c, g, or t
  modified_base (176)..(176): a, c, t, g, unknown or other
  misc_feature (176)..(176): n is a, c, g, or t
  modified_base (214)..(214): a, c, t, g, unknown or other
  misc_feature (214)..(214): n is a, c, g, or t
  modified_base (286)..(286): a, c, t, g, unknown or other
  misc_feature (286)..(286): n is a, c, g, or t
  modified_base (329)..(329): a, c, t, g, unknown or other
  misc_feature (329)..(329): n is a, c, g, or t
  modified_base (334)..(334): a, c, t, g, unknown or other
  misc_feature (334)..(334): n is a, c, g, or t
  modified_base (352)..(352): a, c, t, g, unknown or other
  misc_feature (352)..(352): n is a, c, g, or t
tcagactagcagtacacgaccggtgctcgatttagagtatacatagttgggtttgtcctcctgctggtggcagctcccagatgggtcctgtcctggtancaactgcaggagtcgggcccacgactggtgaggccttcggagtaccctgtccctcaccgtgcgcttggtctctggtncctccattcagtagtggttctcgtgggctgggtccgcngctccagggacggctggaatcattggactcgtctctcatagtggagttcctattacagtccgtctctcaagngtcgagtcacatatctctggacacgtcagcaatcagttttccngaagntgagttctgtgaccgcgntgacacgggcttttatactgtgcgagagacggtctattatgtattttggagttcggttatttcgactacctagtagtcggacgggggtctccggaccccgttgggggacccaggggtaactacgtcgggtccaccggttcttccgttacgcccttaccgaccgaacgggtccctaagtcccgggttcccttcccccgtggtccctaccccttccctccaaagacgtcccg

SEQ ID NO: 137862 - DNA, 533 bp, Homo sapiens
  misc_feature: GYAE6OF01CAEPE.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctattaaattggtatcaacatagaccagggacgccctaagctacctaatctatgctgcatccagtttgcaaaggtcgggtcccagtcgaggttcaggtggcagtggatcgtgggacagtatttcactctcaccatcagtaatctagactaacgtgtaaagtattttgactaactttattactagtacaaacataattacaattgtttcgacaagggtactaacgtaactaactaaattaaacgaactagtagctgaccaactatacttgtcttcacttcctacccgactactctgtac

SEQ ID NO: 137863 - DNA, 554 bp, Homo sapiens
  misc_feature: GYAE6OF01D4H3Q.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatgtatcaacatagaccaggacgccctaagctcctaatctatgctgcactccagtttgacaaagtgggtcccagtcgaggttcagtggcagtggatcgtgggacagtatttcactctacaccatcagtaatctgacaagtgaagtatttagactaactttattactgtacaactagtaaatttactaattggttttaccggaccgtaagggacctaacggtaacttaaactaaattaaaccgaacgttgtaggctagacctacctatccttgtccttactacttcccttacccgacctacttcctagtaac

SEQ ID NO: 137864 - DNA, 542 bp, Homo sapiens
  misc_feature: GYAE6OF01A9YOM.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctattaaatgtatcaacatagaccagggacgccctaagctccaatctatgctgcatccagtttgacaaagtgggtccatcgaggttcagtgcagtgatcgtggacagattcactctcaccatctagtaatctcgacaacgtgaatatttagactaacttattactgtactaacgaagtaattaactaagttgttttacggacctaaagggactaacggtaactaactaaattaaacgaacgtgtaggactagacaccgtatacttcgtacttcgtaacttccgttaccccgacctactcgtagtaac

SEQ ID NO: 137865 - DNA, 580 bp, Homo sapiens
  misc_feature: GYAE6OF01BYUQE.46.67.G01.1.454.CMB.1.raw
  modified_base (193)..(193): a, c, t, g, unknown or other
  misc_feature (193)..(193): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtcccctnacctgcgctgtctctggtgcctccatcagtagtggtttcttcgtggggctggggtccggcagcctccgagggaaggggctggaatacattggaagtgtctctcatagtggaggtttcctattacagtccgtctctcagagtcgagtcaccatatctctggacacgtccagcaatctagttttccctgaagatgagttctgtgaccgccgctgacacgggtcgtttattactgtgcgagagacgctattatgttagttttggagttgggtttactttcgacctaccgtagacgtccgggacggggtcctaccggaccccggttcggggaccgacgggtaacgttaccgtacggtccacccgttaccgttcccttacgccctaccccgg

SEQ ID NO: 137866 - DNA, 518 bp, Homo sapiens
  misc_feature: GYAE6OF01EN3SV.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctattaaatggtatcaacatagaccagggacggccctaagctcctaatctatgctgcatccagtttgcaaagtggggtcccatcgaggttcagtggcagtggatctgggacagatttcactctcacatcagtaatctgcaacgtagaagtattttagactaactttattactgtcaaacagtaattacaattgttttacggaccaagggactacgaacttaacaaattaaacgaatgtggctagacactatctgtcttcacttccttcccgaccatctgtaac

SEQ ID NO: 137867 - DNA, 681 bp, Homo sapiens
  misc_feature: GYAE6OF01AY55Y.46.67.G01.1.454.CMB.1.raw
  modified_base (208)..(208): a, c, t, g, unknown or other
  misc_feature (208)..(208): n is a, c, g, or t
  modified_base (289)..(289): a, c, t, g, unknown or other
  misc_feature (289)..(289): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctcgtgggctgggtccgnagctccgaggggaagggctggaatacattggaagtgtctctcagtagtggtaggttcctattacgagtccgtctctcaagngtcgagtcgacctatactcgtcgtaggacaccgtccagctaattctacgttttcccaggaacgtagtcgtagttcgtgtccgaccgccgctcggacgtacgggtctttattaccgtggtcggacgagacggtacggtcttagttagttgttacgtttttgggaggtttaggtttactttccggtaacctacccgttaggtacgttaccgggacgggggtcctacccggtacccccgggtgggggacccggtaaggggtaacgttaccggttcgggtaccgtacccggtccttcccgttacgtcccgtacccgaacccggtacgggcccctacggttcccggttcccttcccccgtcggccctacccccgtccctacccgaagtccgtacccg

SEQ ID NO: 137868 - DNA, 601 bp, Homo sapiens
  misc_feature: GYAE6OF01C162Q.46.67.G01.1.454.CMB.1.raw
  modified_base (360)..(360): a, c, t, g, unknown or other
  misc_feature (360)..(360): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacaccttatttaaattggtatcaacatagaccagggacggccctaagctcctaatctatgctgcatccagtttgcaaagtgggtcccatcgaggttcagtgcagtgatcgtgggacagtacttcactcncaccatcagtaatctgacaacgtgaagttattttagtaactttagtactagtacaaactaagtaacttaactaagtttacgttttaccggaccgtaaacggggtaccaaaggtaaactaaactaaaacgttaaaaccgaacgttaggttacggaccgttacgacctaaccgtacttacgttcgttacctttacgtaaccttccccgttaccccgtacctaagttcctagtaactttaccgg

SEQ ID NO: 137869 - DNA, 590 bp, Homo sapiens
  misc_feature: GYAE6OF01BYCGR.46.67.G01.1.454.CMB.1.raw
  modified_base (335)..(335): a, c, t, g, unknown or other
  misc_feature (335)..(335): n is a, c, g, or t
  modified_base (387)..(387): a, c, t, g, unknown or other
  misc_feature (387)..(387): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctctggggctgggtccggcagctcccgagggaaggggctgggaatacattggaagtgtctctcatagtggaggttcctattacagtccgtctctcaagagtcgagtcaccatatctctggacacgtccagcaatcagttttcccngaagatgagttctgtgaccgccgctgacacgggtctttatactgtgacgagngacggtctattattgtagtttttggagttggttatttcggactacccgtagtacgtcggaacgggggtctccggaacccgtcggggcccgaggggtaataccgtggtccgaccgtcctccgttagcccttacccgaaccgaaccgggcccacgtccggtccctcccccgtcggtccctacccctccctaccaacgcgtacccg

SEQ ID NO: 137870 - DNA, 580 bp, Homo sapiens
  misc_feature: GYAE6OF01DEC6X.46.67.G01.1.454.CMB.1.raw
  modified_base (336)..(336): a, c, t, g, unknown or other
  misc_feature (336)..(336): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagttggtttctcgtggggctgggtccgcagctccgagggaaggggctggaatacattggaagtgtctctcatagtggaggttcctattacagtccgtctctcaagagtcgagtcaccatatctctggacacgtcagcaatcagtttcccagaanatgagttctgtcgaccgcgctgaccgacgggtctttattactgtgcgagagacgctattatgtagttttggagttggtttatttcgacctaccctagacgttcggacggggctcggaccccgtggggccgaagggtaactacgtcggtacgtaccgttcgtacccttagccctaccgaccgaacgggccctacgtccggttcccttcccctcggccctaccccgtccctacccaagcgtacccg

SEQ ID NO: 137871 - DNA, 631 bp, Homo sapiens
  misc_feature: GYAE6OF01BIQG7.46.67.G01.1.454.CMB.1.raw
  modified_base (192)..(192): a, c, t, g, unknown or other
  misc_feature (192)..(192): n is a, c, g, or t
  modified_base (220)..(220): a, c, t, g, unknown or other
  misc_feature (220)..(220): n is a, c, g, or t
  modified_base (380)..(380): a, c, t, g, unknown or other
  misc_feature (380)..(380): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttcggccggganaaggtccggaaactatttggaacctaaccttaatttaaaagttggtaatcaaacatagaaccagggaccggccctaagcctacctaatctatgctgcatcctagtttgcgaaaggtcggggtacccagtcggaggttcagtggcaggtgactcgtggganagtatttcactctcacctatactaagtaatcgtagacctaacgtagtaaagttatttacgacttaactttatttacgtacgttacctaaacgtaagtaaatttactaaagtttcggttttaccggaccgtaaagggacctaacgtaaaccttaactaaaacgttaaacgtaacttaggtacgcgtacgacaaccgtattccgttcgtacctttacaccgtttccttaccccgtacctacttccgtgtaacc

SEQ ID NO: 137872 - DNA, 616 bp, Homo sapiens
  misc_feature: GYAE6OF01D635M.46.67.G01.1.454.CMB.1.raw
  modified_base (192)..(192): a, c, t, g, unknown or other
  misc_feature (192)..(192): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccggacaagtcgaacattcgacaccttattaaattgtatacaacatagaccagggacggccctaagctcctaatctatgctgcactcctagtttgacgtaaaggtcgggtaccagtcgaggttcaggtggacaggtggatcgtagggacagtactttacacctctacaactatacgaagttactctagacgtacgtagtaatatttagacctaatttatacgtacgtacaactaagtaacttaactaagtttcggtttaaccggaacgtaacgggaactaaccgtaaaccttaaagtaaaacgttaaaccggaacttaggtacgtacgttaaccgtacctaaccttagtccttacgttaccttctaacccgtttccttaccccggacttattccgtagttaaccg

SEQ ID NO: 137873 - DNA, 529 bp, Homo sapiens
  misc_feature: GYAE6OF01BBJ2S.46.67.G01.1.454.CMB.1.raw
  modified_base (368)..(368): a, c, t, g, unknown or other
  misc_feature (368)..(368): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtgtggtttctctggggctgggtccgcagctccagggaagggctggaatacattggaagtgtctctcatagtggaggttcctattacagtccgtctctcaagagtcgagtcaccatatctctggacacgtccagcaatcagtttcccngaagatgagttctgtgaccgcgctgacacgggcgtttatactgtgcgagagacggtctattatgtatttttggagttggtttatttcgtacacccttagatcggacggggctcggcccgtggggccagggatacgtggtcacgttctccttgccctacccg

SEQ ID NO: 137874 - DNA, 676 bp, Homo sapiens
  misc_feature: GYAE6OF01BSZT9.46.67.G01.1.454.CMB.1.raw
  modified_base (407)..(407): a, c, t, g, unknown or other
  misc_feature (407)..(407): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatccctccctgtctgcaaccggtgggagacagtgtcaccatccacgttcggccgggacaaggtcggaactattacgaactaaccttaatttaaagtggttaactacaaactataacgaccgaaggggaccggaccctaagcctacctaatctatcgtctcgctactccgtagtttcgacgtaaggtcgggtaccctagtcggtaggttcgaggtcggcgtagtggatcggtaggactagtnttccactctacactatacgagtaactcgtagactaacggtagtaaagttcgtttacgaaccttaaatttacttacgttagtaacctaaagtaacgttaaattaactaagtttacggtttacccggaacgtaacgggtaacctaaccgtaaacttaaacgtaaaacgttaaccgtaacgttcggtacgtacctacggaccctaaccgtacttcgtttacgtaccctttacaaccgtttcccgttacccgtactattcccgtagttaaccg

SEQ ID NO: 137875 - DNA, 580 bp, Homo sapiens
  misc_feature: GYAE6OF01EUQ6B.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccaggggaagggctggaatacattgggaagtgtctctcatagtggaggttcctattacagtccgtctctcaagagtcgagtcaccatatctctggacacgtccagcaatcagttttcccctgaagatgagttctgtgaccgccgctgactacgggcgttttatactgtgcgagagacggctattatgtattttggagttggtttatttcgactacctagatcggacggggctcgcccgtggggccagggaatacgtggtccaccgttctccgttacgccctaccgacccgaacgggtccccacgtccgggttccccttcccccgtcggcccctaccccgttccctacccgtaacggacgtccccg

SEQ ID NO: 137876 - DNA, 557 bp, Homo sapiens
  misc_feature: GYAE6OF01BLH0N.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtgggagacagtgtcaccatcacttgccgggcaagtcggaacattgacaccttatttaaattggtatcaacatagaccagggaccgccctaagctacctaatctatgctgcatccagtttgacgtaaaggtcgggtaccctagtcggtaggttcaggtggcagtggatcgtggacagtattcactctcaccatcagtaatctagactaacggtataagttatttcgacttaactttattactagtacaactagtaattactattgtttacgacgaaggactacgaacttaactaaattaacgacgtgtacgtactgacctactattccgtgtaccttctaccttcccttacccgacctacgttctcgtaac

SEQ ID NO: 137877 - DNA, 750 bp, Homo sapiens
  misc_feature: GYAE6OF01D4FYR.46.67.G01.1.454.CMB.1.raw
  modified_base (265)..(265): a, c, t, g, unknown or other
  misc_feature (265)..(265): n is a, c, g, or t
tcagactagcagtacacgaccggtgctcgatttagagtatacatattgggttggtcctcctgcgtggtggcacgctccccagatgggtccctggtcccttggtgtcgaactgcaggacgtccgggcccacgactggtgaggcccttcggagacccgtgttccctcacctgcgtcgttgtctctggtgtacctcatcagtagtggtttctcgtgggctgggtcgcagcgtccgagggagggctggaatcgattggaagtgtctctnagtagtggacggttcctagttacagtccgttatctactaacgagtcgagtcgacctatagtccgtcgtagggacctacggtccaggtctaaattcctaagtttttacccagaagtacgtgtacgttctagtcgtaccgccgtcgtcgaaccgtacgggtcgttttagttacgtggtacgcgtaacgacgtaccggtacttaacgttagtaggttacgtttttaacgggaagtttacggttttaacttttccggtaacctacccgttaagtacgttaccgggaacgggggtcctacccggaaccccggttcggggacccgtaaggggtaagttaccgtacgggtacccgtacccggttccgttacccgttaacgtcccttacccgaaccggtaaacgggtacccctaaggttcccgggttaccccttaccccccggtacgggtaccctaacccccgttaccgtacccggtaagtccggtaacccgg

SEQ ID NO: 137878 - DNA, 513 bp, Homo sapiens
  misc_feature: GYAE6OF01CFJB5.46.67.G01.1.454.CMB.1.raw
  modified_base (506)..(506): a, c, t, g, unknown or other
  misc_feature (506)..(506): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctattaaattggtatcaacatagaccagggacgccctaagctcctaatctatgctgcatccagtttgcaaagtcgggtcccatcgagttcagtggcagtggatcgtgggacagatttcactctcaccatcagtaatctgcaacgtgaagtatttgactaacttattactgtacaactagaattacaattcgttttcggacctaagggacacgaactaacaaagttaacgtaactgtgctagcacctatctgtcttctactccttcccgacntctgtac

SEQ ID NO: 137879 - DNA, 530 bp, Homo sapiens
  misc_feature: GYAE6OF01B3NGW.46.67.G01.1.454.CMB.1.raw
tcagactagcagtacacgaccggtgctcgatttagagtatacatattgggtttggggagtctcggtcaggacacagcatagacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatgtatcaacatagaccagggacgccctaggctcctaatctatgctgcatccagtttgcaaagtgggtccagtcgaggttcagtggcagtggatctgggacagtatttcactctcaccatcagtaatctgacaacgtgaagtatttgactaatttattactgtacaactagtaattactaattgtttacggacctaagggtacctacgaactaactaaattaacgaactgtaggctagacaccgtatacgtgttcttacacttcccttacccgacctattctgtaac

SEQ ID NO: 137880 - DNA, 509 bp, Homo sapiens
  misc_feature: GYAE6OF01BSJA6.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattgtatcaacatagaccagggacggccctaagctcctaatctatgctgcatccagtttgcaaagtggggtcccatcgaggttcagtggcagtggatctgggacagtatttcactctcaccatcagtaatctgcaacgtgaagtattttgactaacttattactgtacaacagtaattacaattgtttacggacaagggacacgactaacaaattaacgaactgtggctgcaccatctgtcttcacttccttcccgacatctgtac

SEQ ID NO: 137881 - DNA, 512 bp, Homo sapiens
  misc_feature: GYAE6OF01AEKE9.46.67.G01.1.454.CMB.1.raw
  modified_base (416)..(416): a, c, t, g, unknown or other
  misc_feature (416)..(416): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacgccctaagcctcctaatctatgctgcatccagtttgcaaagtgggtcccagtcgaggttcagtggcagtggatcgtgggacagtatttcactctcaccatcagtaatctgcaacgtgaagtattttgactaacttattactgtacaanagtaattacaattgttttcgaccaagggactacgactaacaaataacgactgtgctgacactatctcgtcttcacttccttacccgcactctgtac

SEQ ID NO: 137882 - DNA, 564 bp, Homo sapiens
  misc_feature: GYAE6OF01EU7HZ.46.67.G01.1.454.CMB.1.raw
  modified_base (561)..(561): a, c, t, g, unknown or other
  misc_feature (561)..(561): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggaccgccctaagctacctaatctatgctgcatcctagtttgactaaaggtcgggtcccagtcgtaggttcaggtggcaggtggatcgtgggacagtatttcactctacactatactaagttaactctagactaacgtagtaagttagttttcgaacttaactttattactgtacaacgtaataattaactagttacgtttccggacgtaacgggactaacgtaactaaactaaattaaacgaacgtgtacgctagactacctattctgttacttcacttcctacccgactatcgtntac

SEQ ID NO: 137883 - DNA, 586 bp, Homo sapiens
  misc_feature: GYAE6OF01D53WZ.46.67.G01.1.454.CMB.1.raw
  modified_base (297)..(297): a, c, t, g, unknown or other
  misc_feature (297)..(297): n is a, c, g, or t
  modified_base (330)..(330): a, c, t, g, unknown or other
  misc_feature (330)..(330): n is a, c, g, or t
  modified_base (382)..(382): a, c, t, g, unknown or other
  misc_feature (382)..(382): n is a, c, g, or t
  modified_base (388)..(388): a, c, t, g, unknown or other
  misc_feature (388)..(388): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccctttcggagaccctgtcccctcacctgcgctgtctctggtcgcctccatcagtagtggtttcttctgggggctggggtccggcagcctccgagggaagggctggaatacatttggaagtgtctntcagttagtggaggttcctattacagttccgtntctcaagagtcgagtcaccatatctctggacacgtcagcaatcagtttcccngaagtntgtagttctgtcgaccgtccgctgacgacgggtcgtttattacgtgtgcgagagacggtctagttatgtattttggagttggttatttcgactaccgtagtacgtcggaccggggcttaccgggaccccgtgggggacccgtaggggaaacttacgtacggtccctaacccgttcctaccctttacggcccctacccg

SEQ ID NO: 137884 - DNA, 624 bp, Homo sapiens
  misc_feature: GYAE6OF01DDJLM.46.67.G01.1.454.CMB.1.raw
  modified_base (171)..(171): a, c, t, g, unknown or other
  misc_feature (171)..(171): n is a, c, g, or t
  modified_base (349)..(349): a, c, t, g, unknown or other
  misc_feature (349)..(349): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtncctccatcagtagtggtttcttcgtggggctgggtccgcagcctcccgaggggaagggctgggaatacagtttgggaagttgtctctcagtagtggaggtttctattacagtccgtctctcaagtagtcgagtcaaccatatctctggacacgtccagcaatctacgtttcctagaantgtattcgtgtgaccgccgctgaacgtcgggtctttattacgtgtgacgagacgacgcttattatgttagttttggagtttgttattcgactaccgtagtagtcggacgggtctccggacccgtacgggccgtaagggtacttacgtcggtctaccgtcttaccgtacgccctaccgaccgtaaccgggtaccctacggttccccggttaccctttccccccggtacggtcccctaacccccgttacctaccccgtaaacggtccgtaaccccgg

SEQ ID NO: 137885 - DNA, 687 bp, Homo sapiens
  misc_feature: GYAE6OF01BCQ1A.46.67.G01.1.454.CMB.1.raw
  modified_base (193)..(193): a, c, t, g, unknown or other
  misc_feature (193)..(193): n is a, c, g, or t
tcagactagcagtacacgaccggtgctcgatttagagtatacatattgggtttggggagtctcggtcaggacacagcatggacatgagggtccccgctcagctcctggggctcctgctactctggctccggaggtgccagatgtgacatcgagctgacccagtctccatcctccctgtctgcaaccgtggganacagtgtcaccatcacttgccgggacaagtcgaacattgactacttatttaaatggtatcaacatagacgagggaccgccctaagctacctaatctatgctgctactcctaggtttcgacgtaaacggttcggggtaccctagtcggtaggtttcgaggtggacgtaggtggatcgtagggactagtactttcgacttcgtacacctatactaagttaactcgtagacgtaacgtagtaagttacttttacgaacttaaacgtttacttacgtacgtaactaaacgtaagttaaactttaacgtaagttttacggttttaaccggaaccggtaaacgggtaacctaaaccgttaaaccttaaacgttaaaacggtttaaaccgtaacgttagggttaacggtaccgttaacggacccgtaaccttagttaccgttcgttacctttacctaccgtttaccccgttaccccgtactttacgttccgttacgttaac

SEQ ID NO: 137886 - DNA, 590 bp, Homo sapiens
  misc_feature: GYAE6OF01C9VB6.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggttttcttcgtggggctgggtccggcagctcccgaggggaaggggctggaatacattggaagtgtctctcatagtggaggttcctattacagtccgtctctcaagagtcgagtcaccatatctctggacacgtccagcaatctagttttcccagaagatgtagttctgtcgaccgccgctgacgcgggtctttattacgtgtgcgagagacggtctattatgttagttttggagttggtttatttcgactacccgtagtacgtcggacggggctccggaccccgtggggaccgagggtaacgtacgtcggtccaccgttctccgttacgccctccgaccgaacgggcccacgttcccggtcccttcccccgtcggtcccacccctccctacccaagcgtacccg

SEQ ID NO: 137887 - DNA, 633 bp, Homo sapiens
  misc_feature: GYAE6OF01BAT1K.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcttccatcagtagtggtttcttcgtggggctgggtccggcagctcccgaggggaagggctggaatacattggaagtgtctctcatagtggaggttcctattacagtccgtctctcaagagtcgagtcaccatatctctggacacgtccagcaatctagttttccccagaagatgagttctgtgaccgcgctgacgacgggtcgtttatactgtgcgagagacgctattatgtagttttggagttggtttatttcgacctacccgtagacgtcgggtacggggtcctccggaccccggtcggggacccgaaggggtaacttaccggttcggtaccgtacccgttccgttcccgttaacgtcccctacccgaacccggacgggtaccccaacggttcccggttaccccttccccccgttcggtcccctacccccttcccgtaccccgtaaacggccgtaccccg

SEQ ID NO: 137888 - DNA, 557 bp, Homo sapiens
  misc_feature: GYAE6OF01DPUTP.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacgccctaagctctaatctatgctgcatccagtttgcaaaggtgggtcccagtcgaggttcagtggcagtggatcgtgggacagtatttcactctcacctatcagtaatctgacaacgtagaagtattttagactaactttattactgtacaactagtaattaactaattcggtttacgaccgtaagggaccaacgtaactaaactaaacgttaacgaactgtaggactgacctaacctattcttcgttacctttcgacctttcccttaccccgtacctacttcgtgtaacg

SEQ ID NO: 137889 - DNA, 516 bp, Homo sapiens
  misc_feature: GYAE6OF01ALBMP.46.67.G01.1.454.CMB.1.raw
tcagactagcagtacacgaccggtgctcgatttagagtatacatattgggtttgggggagtctcggtcaggacaccagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacggccctaagctcctaatctatgctgcatccagtttgcaaagtgggtcccatcgagttcagtgcagtggatctgggacagatttcactctcaccatcagtaatctagcaacgtgaagtattttgactaacttattactgtacaactagtaattacaattgttttacgaccgtaaggactacgaactaacaattaacaacgtgtagctgaccactatctgtcttacactccttacccgactctctgtac

SEQ ID NO: 137890 - DNA, 573 bp, Homo sapiens
  misc_feature: GYAE6OF01CAX9O.46.67.G01.1.454.CMB.1.raw
  modified_base (214)..(214): a, c, t, g, unknown or other
  misc_feature (214)..(214): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagcncccttagggaagggctggaatacattggaagtgtctctcatagtggaggttcctattacagtccgtctctcaagagtcgagtcacatatctctggacacgtccagcaatcagttttccctgaagatgagttctgtgaccgccgctcgactacgggtcgttttattactgtgcgagagacggctattatgtattttggagttggttatttcgactaccctagactcggacggggtcctcggaccccgtggggccgagggtaacgtacgttggtccgaccgttctccttacgccctaccacccgacggacccacgtccggtccttcccccgtcggccctacccctccaccacgcgtacccg

SEQ ID NO: 137891 - DNA, 560 bp, Homo sapiens
  misc_feature: GYAE6OF01ANB4L.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggccctaagctcctaatctatgctgcatccagtttgactaaaggtcggggtcccagtcgtaggttcagtggcaggtggatcgtgggacagtatttcactctcacatcagtatctgacaagtgaagtatttgactaacttattactgtacaactagtaactttacaattgttttaccggacctaagggacctaacgtaactaaactaaacgttaaacgaacttggtacgctagacctacctatccttcgttaccttacgtacttcccttaccccgacctacttccgtagtaac

SEQ ID NO: 137892 - DNA, 538 bp, Homo sapiens
  misc_feature: GYAE6OF01BOZHH.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacgccctaagctcctaatctatgctgcatccagtttgcaaagtgggtcccatcgaggttcagtggcagtggatcgtgggacagtatttcactctcacatcagtaatctgctaacgtgaagtattttagtaaacttattactgtacaaactagtaatttacaatttcgtttacggaccgtaagggaccaacgtaactaactaaaacttaaacgaacttgtggactacgactaccattctgttcttacacttccttcccgactatctgtatacg

SEQ ID NO: 137893 - DNA, 529 bp, Homo sapiens
  misc_feature: GYAE6OF01BBNPM.46.67.G01.1.454.CMB.1.raw
  modified_base (228)..(228): a, c, t, g, unknown or other
  misc_feature (228)..(228): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacntgacactattaaatgtatcaacatagaccagggacggccctaagctctaatctatgctgcatccagtttgcaaagtgggtcccatcgaggttcagtggcagtggatcgtgggacagatttcactctcaccatctagtaatctgactaacgtgaagtattttagactaactttattactagtacaactagtaattactaattgtttacgacgtaagggacacgtaactaactaaagttaacgaactgtaggctagacctactattctcgttcttacacttccttcccgacctattctgtaac

SEQ ID NO: 137894 - DNA, 603 bp, Homo sapiens
  misc_feature: GYAE6OF01BTLGU.46.67.G01.1.454.CMB.1.raw
  modified_base (192)..(192): a, c, t, g, unknown or other
  misc_feature (192)..(192): n is a, c, g, or t
  modified_base (217)..(217): a, c, t, g, unknown or other
  misc_feature (217)..(217): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccgggnaagtcgaacattgacactatttaaatgtatctaacatagaccagggaccgccctaagctcctaatctatgctgcatccagtttgacaaagtcggggtcccagtcgaggttcaggtcggacagtgggatcgtagggacaggtactttcgactctacacatcaagtaactctcgactaacgtagtaagtacttttagacttaacttaacgttacttagtacaaagtaagtaaatttaataacttggttttaccggaaccgtaagggaacctaacgtaaaccttaaactaaaagttaacgaacgtggtacggtactacggtaccacgtattacctgttaccctttacgaactttcccgttaccccgtacctaacttcgtacggttaacg

SEQ ID NO: 137895 - DNA, 684 bp, Homo sapiens
  misc_feature: GYAE6OF01AESSP.46.67.G01.1.454.CMB.1.raw
  modified_base (335)..(335): a, c, t, g, unknown or other
  misc_feature (335)..(335): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgcttgtctcgtggtcgcctccatcagttagttggtttctcgtggggctggggtccgcacgctccgagggacggggctggaatacagttggaagtgtctctcagtagtggaggttcctatacagtccgtctctcaagntcgagtcaccatactctcgtggactacgtccagacaatcgtacgttttcccagaacgtatcgtagttctgtacgacccggccgcgttcggaaccgtaccggggttacttttaattacgttcggttaggccggtaaggtacggtacggttaccttaagtttagttaggttttacgtttttgggtaggtttacggttttagtttaccgaaccgtacccgtaggtacgttaccggggaccgggggtctccccgggtaccccgggttgggggaccgtaacggggtaactttacccggtcgggttacccgtaccccgttaccgtttacccggttaccgccccgttaacccccgg

SEQ ID NO: 137896 - DNA, 740 bp, Homo sapiens
  misc_feature: GYAE6OF01DT77O.46.67.G01.1.454.CMB.1.raw
  modified_base (169)..(169): a, c, t, g, unknown or other
  misc_feature (169)..(169): n is a, c, g, or t
tcagactagcagtacacgaccggtgctcgatttagagtatacatattggggtttcgggagtctcggtccaggacacagccatggacatgacgggtccccgctcaggctccgtggggctcctgcctactctggctccgaggtgccagatgtgaccatccgagctgacccngtctccatcctccgtgtctgcaaccgtgggacgtacgagtgtacacctattccacttcggaccgggtctaaggtcggaactcgttcgaacctaccttatttaaagtggtatacaactatagaccgagggaccgacccgtaagcgtacctaagtctagtgtcgtagtcgtacgtccgtagtttacgacgtaaacggtcgggtaccctagtaccgtagttcgaggtcggacgtaggtcggaacgtcggtacggggtactacggttactttccgaccttccgtacctaccgtacgttacgtaacggttaacttacgtacggtaaccgtaaacggttacgtaaagtttagttttacgaacctttaaactttaacgttaacgttacggtaacctaaacgttaacgttaacgtttaacgtaacggtttacggtttaccgaaccggtaaacgggtactaacgttaactaaacgtaaagttaaccgtacgttcggtacggtacgtacgacgtaccgtagttcgtcgttaccttacggaccgtttcccgttacccggacttacgttccgtagttaacccg

SEQ ID NO: 137897 - DNA, 547 bp, Homo sapiens
  misc_feature: GYAE6OF01CGGHF.46.67.G01.1.454.CMB.1.raw
  modified_base (336)..(336): a, c, t, g, unknown or other
  misc_feature (336)..(336): n is a, c, g, or t
  modified_base (534)..(534): a, c, t, g, unknown or other
  misc_feature (534)..(534): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccgaggggaaggggctggaatacattggaagtgtctctcatagtggaggttcctattacagtccgtctctcaagagtcgagtcaccatatctctggacacgtccagcaatcagttttcccngaagatgagttctgtgaccgccgctgacacgggctttatactgtgcgagagacggctattatgtattttggagttggtttatttcgactaccctagatcgacggggctcgacccgtggggccgagggatacgtggtcaccgtctcctacgcctccgaccgacgggcccagtccgtccttcccctggtcccaccctccnccaagcgtacccg

SEQ ID NO: 137898 - DNA, 551 bp, Homo sapiens
  misc_feature: GYAE6OF01DRO0N.46.67.G01.1.454.CMB.1.raw
  modified_base (217)..(217): a, c, t, g, unknown or other
  misc_feature (217)..(217): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggnagtcgaacattgacactattaatgtatcaacatagaccagggacggccctaagctcctaatctatgctgcatccagtttgacaaggtgggtcccatcgagttcagtggcagtgatcgtgggactagtatttcgactctcacctatacagtaatcgtagacgtaacgtaggtaattattttcgacctaactttattactagttacaaactaagtaattaactaatttacggtttcggacctaagggacaacgtaacttaaactaaacttaacgaaacttgtacggctacgacacctattcttgtccttcgacttaccttcccacacttctgtacg

SEQ ID NO: 137899 - DNA, 697 bp, Homo sapiens
  misc_feature: GYAE6OF01C205R.46.67.G01.1.454.CMB.1.raw
tcagactagcagtacacgaccggtgctcgatttagagtatacatattggggtttgggggagttctcggtcaggacacagcatggacatgagggtccccgactcagctcctggggctcctgcctactctcggctccgaggtgccagatgtgacatcgagctgacccagtctccatcctcctgtctgacaaccgtgggagacagtgtcacatcaacgttgccgggacaacggtccggaactattgaactaccttatttaaagtggtaactcaaactatagaaccgtaggggaccggaccctaagcctaccgtaatcgtaatgctgctacgtcctagtttgactaacggtcgggtacccagtcgagttcagtgcagtgaatcgtagggactagtactttcacttctacctaactatacgtaagttaacttcgtacgtaaccgtaaacggttacgtaaaggtttacttttacgaaaccttaaacgtttaacgttaacgttacgtaacgaaactaaggtaaacttaactaagtttacggttttaccggaaccgtaaagggtaccctaaccgtaaccgttaaactaaaacgtttaaccgtaaacgttacggtaacggtacctacgacccgtaaccgttaaagttcgttacggttacctttacgtacttacccgttacccgaccttacgttcgtacggtaaacg

SEQ ID NO: 137900 - DNA, 559 bp, Homo sapiens
  misc_feature: GYAE6OF01AO92F.46.67.G01.1.454.CMB.1.raw
  modified_base (208)..(208): a, c, t, g, unknown or other
  misc_feature (208)..(208): n is a, c, g, or t
  modified_base (335)..(335): a, c, t, g, unknown or other
  misc_feature (335)..(335): n is a, c, g, or t
  modified_base (340)..(340): a, c, t, g, unknown or other
  misc_feature (340)..(340): n is a, c, g, or t
  modified_base (541)..(541): a, c, t, g, unknown or other
  misc_feature (541)..(541): n is a, c, g, or t
  modified_base (549)..(549): a, c, t, g, unknown or other
  misc_feature (549)..(549): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctctggggctgggtccgnagctcccgagggaaggggctggaatacagttggaagtgtctctcatagtggaggttcctattacagtccgtctctcaagagtcgagtcaccatatctctggacacggtccagcaatcagttttcccngaagntgtagttctgtcgaccgccgctgacacgggtcgttttattacgtgtgcgagagacggctattatgtagttttggagttggttactttcgactaccctagtacgtcggacggggtctcggaccccgtggggccagggtaactacgtggtccacgtctcctacgcctccgaccgacggcccagtccggtcctcccctcgcccnccctaccnccaagcgacc

SEQ ID NO: 137901 - DNA, 503 bp, Homo sapiens
  misc_feature: GYAE6OF01BR0GL.46.67.G01.1.454.CMB.1.raw
  modified_base (478)..(478): a, c, t, g, unknown or other
  misc_feature (478)..(478): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggccctaagctcctaatctatgctgcatccagtttgcaaagtgggtcccatcgaggttcagtggcagtggatctgggacagatttcactctcaccatcagtaatctgcaacgtgaagtattttgactaacttattactgtcaacagtaattacaattgtttcggaccaaggacacgactacaaattaacgaactgtagctgacacatctntctcactccttcccgcactctgtac

SEQ ID NO: 137902 - DNA, 552 bp, Homo sapiens
  misc_feature: GYAE6OF01EM794.46.67.G01.1.454.CMB.1.raw
  modified_base (211)..(211): a, c, t, g, unknown or other
  misc_feature (211)..(211): n is a, c, g, or t
  modified_base (327)..(327): a, c, t, g, unknown or other
  misc_feature (327)..(327): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtncctccatcagtagtggtttctctggggctgggtccggcagctcccgagggaagggctggaatacattggaagtgtctctcatagtggaggttcctattacagtccgtctctcaagngtcgagtcaccatatctctggacacgtccagcaatctacgttttccctagaagtatgtagttctgtcgaccgccgctgacgacgggtcgtttattactgtgcgagacgacggctattatgtattttggagttggttatttcgactaccctagagtcggacggggtcctccggacccgtggggccagggaactacgtcggtaccaccgtctccttcgccctacccg

SEQ ID NO: 137903 - DNA, 809 bp, Homo sapiens
  misc_feature: GYAE6OF01CVM2Z.46.67.G01.1.454.CMB.1.raw
  modified_base (175)..(175): a, c, t, g, unknown or other
  misc_feature (175)..(175): n is a, c, g, or t
  modified_base (296)..(296): a, c, t, g, unknown or other
  misc_feature (296)..(296): n is a, c, g, or t
tcagactagcagtacacgaccggtgctcgatttagagtatacatattgggtttgtcctcctgctggtggcagctcccagatgggtcctgtccctggtgcaactgcaggagtccgggcccacgactgggtgaggccttcggacgacccctgtccctcacctgcgctgtctctggtncctccatcagtagttggtttcttcgtggggctgggtccggcagcctccgaggggagggctaggaatacagttggagtgtctctcagtagtggagttcctattacagtccgtctctcgaagngtcgagtcacattatctctaggacacgtcagactaatctacgttttccagaagtatgtagttctggtcgacccgccgctcggaacgtacgggttacgtttttaactacgttggtgaccggtaaggaacggtaccgtacgtttaagtttacgttaggttttagtttttagggttaaggtttacgggtttttaacgtttacccggtaaaccttaaccccgttaaggtaaccggttacccggggggtaacccggggggttccccgttaccccggggtaaccccccgggttggggggtaaccccggtaaggggtaaccgtttaaccgggttccggttaaccccgttacccggtttacccgttaccccgtttaccgtacccccgttacccgaaaccccggtaaccccggggtccccttaaaccggtttcccccgggtttaccccctttacccccccggttacggtacccccccttaaccccttccccgtaaacccgaaccggtacccggtaacccccg

SEQ ID NO: 137904 - DNA, 623 bp, Homo sapiens
  misc_feature: GYAE6OF01CZF79.46.67.G01.1.454.CMB.1.raw
  modified_base (253)..(253): a, c, t, g, unknown or other
  misc_feature (253)..(253): n is a, c, g, or t
  modified_base (404)..(404): a, c, t, g, unknown or other
  misc_feature (404)..(404): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacactatttaaatggtatcaanatagaccagggaccgccctaagctacctaatctatgctgcatctagtttgacgaagtcgggtccatcgtaggttcagtggctagtgatcgtagggactagtatttcacttctacaactatactagtaatctagactaacggtagaacgttnttttacgactaaacgtttattactagtaacaacgtaagttaacttaactaacgtttcgtttaccggaaccgtaaacggggtactaaccgtaactaaacgttaaagttaaaccggtaacttacggtacggtacctacgacctaaccgtattacccgttacggttaccctttaccgacttttaccccgtaccccgtacttaacgtccgttaaggttaaccg

SEQ ID NO: 137905 - DNA, 676 bp, Homo sapiens
  misc_feature: GYAE6OF01EJBU7.46.67.G01.1.454.CMB.1.raw
  modified_base (194)..(194): a, c, t, g, unknown or other
  misc_feature (194)..(194): n is a, c, g, or t
  modified_base (257)..(257): a, c, t, g, unknown or other
  misc_feature (257)..(257): n is a, c, g, or t
tcagactagcagtacacgaccggtgctcgatttagagtatacatattgggtttggggagtctcggtcaggacacagcatggacatgagggtccccgctcagctcctggggctcctgctactctggctccggaggtgccagatgtgacatcgagctgacccagtctccatcctccctgtctgcaaccggtggganacagtgtcaccatcacttggccgggacaagtcgaacattgactacttatttaatgtatacaanatagaccagggaccgccctaagctacctaatctatgctgctatccgtagtttgacgtaaggttcggtaccctagtcggtagttcgaggtggacgtagttaggacttcggtagggtactagttactttacgacttcctaccaacctatactaagttaactctaggaacgtaacgttagtaacgtttgtttacgaactttaaacgtttactttacgtacgtaactaaacgtaagttaaacgtttaacgtaacgttttacgggtttaacccggaaccggtaaacgggtaacctaaaccggttaaaccttaaaacgtaaaacgttaaaccggtaacgttacggtacggtacctacggtaaccctaaccttagttcgttcgttaccttacgtaccgttcccttaccccgatacttcgagttaac

SEQ ID NO: 137906 - DNA, 501 bp, Homo sapiens
  misc_feature: GYAE6OF01B5YSK.46.67.G01.1.454.CMB.1.raw
  modified_base (192)..(192): a, c, t, g, unknown or other
  misc_feature (192)..(192): n is a, c, g, or t
  modified_base (217)..(217): a, c, t, g, unknown or other
  misc_feature (217)..(217): n is a, c, g, or t
  modified_base (228)..(228): a, c, t, g, unknown or other
  misc_feature (228)..(228): n is a, c, g, or t
  modified_base (253)..(253): a, c, t, g, unknown or other
  misc_feature (253)..(253): n is a, c, g, or t
  modified_base (301)..(301): a, c, t, g, unknown or other
  misc_feature (301)..(301): n is a, c, g, or t
  modified_base (496)..(496): a, c, t, g, unknown or other
  misc_feature (496)..(496): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccgggnaagtcggaacnttgacactatttaaatggtatcaanatagaccagggacgccctaagctcctaatctatgctgcatccagtttncaaagtgggtcccatcgagttcagtggcagtgatcgtggacagtattcactctcaccatcagtatctgcaacgtgaagtattttgacctaactttattactgtaccaacgtagtaattactaattgtttcgaccgtaaggactacgactaacaataacgaatgtagctgcacatctgtctcatccttcccgcatntgtac

SEQ ID NO: 137907 - DNA, 550 bp, Homo sapiens
  misc_feature: GYAE6OF01AICUR.46.67.G01.1.454.CMB.1.raw
  modified_base (334)..(334): a, c, t, g, unknown or other
  misc_feature (334)..(334): n is a, c, g, or t
  modified_base (537)..(537): a, c, t, g, unknown or other
  misc_feature (537)..(537): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctctggggctgggtccggcagctcccgagggaaggggctggaatacattggaagtgtctctcatagtggaggttcctattacagtccgtctctcaagagtcgagtcaccatatctctggacacgtccagcaatcagttttcccngaagatgagttctgtgaccgccgctgacacgggtctttatactgtgcgagagacggctattatgtattttggagttggttatttcgacaccctagatcggacggggctcggaccccgtggggccagggtaatacgtggtcaccgtctcctagcctccaccgacgggcccagtccggtccttcccccgtggccctacccctccnccaagcgtacccg

SEQ ID NO: 137908 - DNA, 604 bp, Homo sapiens
  misc_feature: GYAE6OF01COTB9.46.67.G01.1.454.CMB.1.raw
  modified_base (192)..(192): a, c, t, g, unknown or other
  misc_feature (192)..(192): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcacatcacttgccggcaagtcggaacattgacacctatttaaatggtatcaacatagaccagggacgccctaagctcctaatctatgctgcatccagtttgacaaaggtcggggtcccagtcgaggttcagtggcaggtggatcgtggggactaggactttcgacttcgtccaacctatactaagtaatcgtgacctaacgtagtaaagtattttagactaactttattactagtactaacaagtaaactttaactaagtttggtttacggaaccggtaaagggtaacctacgtaaccttaaactaaaacttaacgaaacgttaggtacgacgttcgaccgtaacctattcgttacgttctttacctaccgttccttacccccgacttaccttcgttacgtaaac

SEQ ID NO: 137909 - DNA, 543 bp, Homo sapiens
  misc_feature: GYAE6OF01CGA2N.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggccctaagctcctaatctatgctgcatccagtttgacaaagtgggtcccatcgaggttcagtggcaggtgatcgtgggacagtatttcactctcaccatcagtaatctagcaacgtagaagtatttgactaactttattactagtacaactagtaaacttactaattgtttacggacgtaacgggactaacgtaactaactaaataacgtaactgtagactagacaacctattactgttacttactacttccttacccgtacctactctgtaac

SEQ ID NO: 137910 - DNA, 546 bp, Homo sapiens
  misc_feature: GYAE6OF01BD2GF.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctattaaattgtatcaacatagaccagggacggccctaagctcctaatctatgctgcatccagtttgactaaagtcgggtacccagtcgaggttcagtggcagtggatcgtagggacagtattcactctcaccatacagtaatctgactacgtagtaagtatttagactaactttattacttgtaactaactagtaaattactaagtttcgtttaccgacgtaaggactaacgtaactaacaaattaacgaagtgtacgtctagacctactattcgtcgttcttactactccttcccgactactctgtaac

SEQ ID NO: 137911 - DNA, 567 bp, Homo sapiens
  misc_feature: GYAE6OF01BWY0W.46.67.G01.1.454.CMB.1.raw
  modified_base (378)..(378): a, c, t, g, unknown or other
  misc_feature (378)..(378): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcgggagaccctgtccctcacctgcgctgtctctggtgcctccatcagtagtggtttctcgtggggctgggtccgcagcctccgagggaagggctggaatacattggaagtgtctctcatagtggaggttcctattacagtccgtctctcaagagtcgagtcaccatatctctggacacgtcagcaatctagtttcccagaagntgattctgtcgaccgcgctgacgacgggtgtttatactgtgcgtagacgtacgcttatatgttagttttggagttggtttatttcgacctaccgtagtacgtccgggacgggtcctccggaccccggtggggacccgtagggtaactaggtcggtcccgtacgttacctccgttccgtcccgtaccccg

SEQ ID NO: 137912 - DNA, 566 bp, Homo sapiens
  misc_feature: GYAE6OF01ESEMG.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccggcaagtcggaacattgacactattaaattggtatcaacatagaccagggacggccctaagctacctaatctatgctgcatccagtttgacaaaggtcgggtcccatcggtaggttcaggtggcaggtggatcgtgggacaggtatttcactctacacatcagtaactctagcaacgtgaagtatttgactaaactttattacttagtacaaactagtaacttaactaatttcgttttacggaccgtaaagggacctaacgtaacttaaactaaaattaaacggaacttgtacggctacggaccacctattcttcgttacttcacttccttaccccggatacgttcgtgtaac

SEQ ID NO: 137913 - DNA, 602 bp, Homo sapiens
  misc_feature: GYAE6OF01C247P.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagttagtggtttctcgtggggctgggtccggcagcctccgagggaaggggctggaatacattggaagtgtctctcatagtggaggttcctatttacagtccgtctctcaagagtcgagtcaccatatctctggacacgtccagcaatcagtttttccctgaacgatgtagtttctgtcgaccgccgctcgacgacgggtcgtttattacgtgtgcgagagacggctattatgttagttttggagttggtttatttcgactacccgtagacgtcggaccgggggtctacccggtaccccggtggggacccgtaacggggaacgttaccgttacgggtacccgtacccggttccttaccccgtttacgtccccgttaacccccgg

SEQ ID NO: 137914 - DNA, 566 bp, Homo sapiens
  misc_feature: GYAE6OF01A1MN3.46.67.G01.1.454.CMB.1.raw
  modified_base (211)..(211): a, c, t, g, unknown or other
  misc_feature (211)..(211): n is a, c, g, or t
  modified_base (374)..(374): a, c, t, g, unknown or other
  misc_feature (374)..(374): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtncctccatcagtagtggtttctcgtggggctgggtccggcagctcccgagggaagggctggaatacattggaagtgtctctcatagtggagttcctattacagtccgtctctcagagtcgagtcacatatctctggacacgtcagcaatctagtttcccagaanatgtagttctgtcgaccgcgctgacgacgggtctttatctgtgacgagacgacgtctattgtgtagttttggagttgttactttcgactaccgtagtacgtcggaccggggtctcccggaccccgtggggaccgtaggggaacttaccggtcggtacccgtaccgtaccttcccgttacgtcccctaacccg

SEQ ID NO: 137915 - DNA, 510 bp, Homo sapiens
  misc_feature: GYAE6OF01A0YVQ.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggccctaagctcctaatctatgctgcatccagttttgcaaagtggggtcccatcgaggttcagtggcagtggatctgggacagatttcactctcaccatcagtatctgcaacgtgaagtattttgactaacttattactgtacaacagaattacaattgttttcgactaaggacacgactaacaaattaacgaactgtggctgcacctatctgttcttcactccttcccgacctatctgtac

SEQ ID NO: 137916 - DNA, 602 bp, Homo sapiens
  misc_feature: GYAE6OF01A0768.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggaccggccctaagctcctaatctatgctgcactcctagtttgacaaaggtgggtcccagtcgaggttcagtggcaggtgatcgtgggacagtatttcactctacaccatcagtaatctagactaacgtgaagttattttcgacttaaactttattaacttgtactaaactagtaaactttactaagtttcggttttaccggaccgtaaagggacctaacgtaaccttaaactaaaacgtttaaaccgaacttaggtaggtacctaggaaccctacctattaccgttcgttacctttacacctttacccttaccccgaccttacttccgtacgttaac

SEQ ID NO: 137917 - DNA, 572 bp, Homo sapiens
  misc_feature: GYAE6OF01BQB2Y.46.67.G01.1.454.CMB.1.raw
  modified_base (192)..(192): a, c, t, g, unknown or other
  misc_feature (192)..(192): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccgggcaagtcggaacattgacacctattaaatgtatcaacatagaccaggacggccctaagctcctaatctatgctgcatccagtttgcaaagtgggtcccatcgagttcagtgcagtgatcgtgggacagtatttcactctcacatcataatctgctaacgtagaagtatttagactaacttattactgtacaactagtaacttacaattcggttttaccggaccgtaaggggacctaacggtaacttaaaccgtaaaagttaaaaccgaacgttggtacgggtaccttacggaaccaccttaattccgtacgttaccttctacgttcccttaccccgaccttacttccgtaggttaac

SEQ ID NO: 137918 - DNA, 634 bp, Homo sapiens
  misc_feature: GYAE6OF01E6E2I.46.67.G01.1.454.CMB.1.raw
  modified_base (195)..(195): a, c, t, g, unknown or other
  misc_feature (195)..(195): n is a, c, g, or t
  modified_base (476)..(476): a, c, t, g, unknown or other
  misc_feature (476)..(476): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgacgaaccggtggganacagtcgtccaccatcacgttggccggacaagtccggaactagttacgacctaaccttaattttaaagttggtaactacaaactagtaacggacccgacggggacccgaccctaagtcctacctaatctatgctcgctactccgtagtttacgacgtaacgggtcgggtaccagtcgtaggttcgaggtggacgtaggtgagtcgtagggactagtacttcactctacacatacatactcgtacgacgtaacgtagtaagttactttactcttaaaacttnttactacgtactaacgtaataacttaagtacgttacgttacggtaaccgaacggtacgtaacgtaacctaaacgttaaacgtaacgtaacgtagtcgacgtacgtacgtactactactcttcttacctacctccttaccctactacttcgtcgttacg

SEQ ID NO: 137919 - DNA, 583 bp, Homo sapiens
  misc_feature: GYAE6OF01BH4P7.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcgggagaccctgtccctcacctgcgctgtctctggtgcctccatcagtagtggtttctcgtggggctgggtccggcagctcccgagggagggctggaatacattggaagtgtctctcatagtggaggttcctattacagtccgtctctcaagagtcgagtcaccatactctctggacacgtccagcaatctacgttttccctagaagatgtagttcgtgtcgacccgccgcgtacgacgtacggggtcttttatacgtgtcgacgaggagacggtacttattatgttagttttgggagtttggtttattcgacctaccgtagacgtcgggacggggtcctccggacccgtccgggcgagggtactacgtgtcaccgtctccgttacgcctccgacgacggcccacgttccgtccctccccgtcgcccaccctaccaccagcgtacccg

SEQ ID NO: 137920 - DNA, 727 bp, Homo sapiens
  misc_feature: GYAE6OF01AJ8DT.46.67.G01.1.454.CMB.1.raw
  modified_base (192)..(192): a, c, t, g, unknown or other
  misc_feature (192)..(192): n is a, c, g, or t
tcagactagcagtacacgaccggtgctcgatttagagtatacatattgggtttggggagtctcggtcaggacacagcatggacatgaggtcccgctcagctcctggggctcctgctactctggctccgaggtgccagatgtgacatcgagctgacccagtcctccatcctccgtgtctagcaaccgtggganacagtgtcaaccatcacttggccggcaagtcggaacattgactacctatttaaatggtatcaacatagaccaggacggaccctaagctacctaatctaatgactgcatccatttcgactaaacgtcgggacctagtccggtaggttacctaagtggaccgtaggtaggtaacgtcgttacggggaacgtaggtaattttaccaaccgttctaccgtaacctactaccgtaagtaacgttctaacgacgtaaaccgtaggtaaacgttacgttttacgaaccttaaactttaagttacttaacggtactaaacgtaaggtaaactttaactaaaaggtttcgtttacccgggtaacctaaacggggtaacccgtaaacgttaaccggtaaaaccttaaaacgttaaaaaccggtaccgttaaggttacggtaaaccggtacggtacccttaaacccgtatttacccggttagtttaccctttacaaccggttttccctaccccggtaaccctttacgtccggttaacttaaaccgg

SEQ ID NO: 137921 - DNA, 513 bp, Homo sapiens
  misc_feature: GYAE6OF01BKOMX.46.67.G01.1.454.CMB.1.raw
  modified_base (493)..(493): a, c, t, g, unknown or other
  misc_feature (493)..(493): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggccctaagctcctaatctatgctgcatccagtttgcaaagtgggtcccatcgaggttcagtggcagtggatctgggacagatttcactctcacatcagtaatctgcaacgtgaagtattttgactaactttattactgtacaacagtaattactaattgttttacggacctaaagggactaacgactaacaaattaaacgaactgtggctgcacatctgtcttnactcttacccgcatctgtac

SEQ ID NO: 137922 - DNA, 565 bp, Homo sapiens
  misc_feature: GYAE6OF01BUS09.46.67.G01.1.454.CMB.1.raw
  modified_base (337)..(337): a, c, t, g, unknown or other
  misc_feature (337)..(337): n is a, c, g, or t
  modified_base (396)..(396): a, c, t, g, unknown or other
  misc_feature (396)..(396): n is a, c, g, or t
  modified_base (552)..(552): a, c, t, g, unknown or other
  misc_feature (552)..(552): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccgaggggaaggggctggaatacattggaagtgtctctcatagtggaggttcctattacagtccgtctctcaagagtcgagtcaccatatctctggacacgtccagcaaatcagttttcccngaagatgagtttctgtcgaccgccgctgacacgggtctttatactgtgcgagagacggntattatgtattttggagttggttatttcgactaccgtagatcggacggggctcgaccccgtggggaccgaggggaactacgtggtcgaccgtcgtccttacgccctaccaccgacgggtcccacgttccggtcccttcccccgtgcccaccctccnccacgcgtacccg

SEQ ID NO: 137923 - DNA, 532 bp, Homo sapiens
  misc_feature: GYAE6OF01C5ETO.46.67.G01.1.454.CMB.1.raw
  modified_base (519)..(519): a, c, t, g, unknown or other
  misc_feature (519)..(519): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacgccctaagctcctaatctatgctgcatccagtttgcaaagtgggtcccagtcgaggttcagtggcagtggatcgtgggacagatttcactctcaccatcagtaatctgacaacgtgaagtattttgactaactttattactgtacaactagtaattaactaattgttttacggaccgtaagggtacaacgtaactaacaaattaacgaacgttgtaggctagacacctatcttgtacttcacttccttcccnctactcgtgtaac

SEQ ID NO: 137924 - DNA, 586 bp, Homo sapiens
  misc_feature: GYAE6OF01CGJ4B.46.67.G01.1.454.CMB.1.raw
  modified_base (193)..(193): a, c, t, g, unknown or other
  misc_feature (193)..(193): n is a, c, g, or t
  modified_base (218)..(218): a, c, t, g, unknown or other
  misc_feature (218)..(218): n is a, c, g, or t
tcagactagcagtacacgaccggtgctcgatttagagtatacatattgggtttgggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccgggnaagtcggaacattgacactatttaaatgtatcaacatagacagggacgccctaagctcctaatctatgctgcactccagtttgacaaaggtcgggtcccatcgaggttcagtggcagtggatcgtgggactaggtatttcactctcaccatacagtaatctagactaacgtagaagtattttagactaacttattactagtacaaactagtaaacttactaaagttcgttttacggaaccgtaaacgggtactaacgtaactaaactaaaagttaaacgtaaacgttaggtacggtctacggacctaaccctattaccgttcgttaccttactacttcccgttaccccgtacctacttcgttagtaac

SEQ ID NO: 137925 - DNA, 552 bp, Homo sapiens
  misc_feature: GYAE6OF01A4R4D.46.67.G01.1.454.CMB.1.raw
  modified_base (473)..(473): a, c, t, g, unknown or other
  misc_feature (473)..(473): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccgcagctcccgagggaagggctggaatacattggaagtgtctctcatagtggaggttcctattacagtccgtctctcaagagtcgagtcaccatatctctggacacgtccagcaatcagttttccctgaagactgagttctgtcgaccgccgctgacacgggtcgttttaagttactgtgcgagagacggctattatgtagttttggagttggttatttcgactaccctagatcggacggggctcgacccgtgggccagggatacgngtcacgtctcctagcctccaccgacggcccagtccggtccttcccccgtcggtcccaccctcctaccaacgcgtacccg

SEQ ID NO: 137926 - DNA, 546 bp, Homo sapiens
  misc_feature: GYAE6OF01E5J9B.46.67.G01.1.454.CMB.1.raw
  modified_base (192)..(192): a, c, t, g, unknown or other
  misc_feature (192)..(192): n is a, c, g, or t
  modified_base (517)..(517): a, c, t, g, unknown or other
  misc_feature (517)..(517): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccgggcaagtcggaacattgacaccttatttaaattggtatcaacatagaccagggacgccctaagctcctaatctatgctgcatccagtttgcaaaggtgggtcccatcgaggttcagtggcagtggatcgtgggacagtatttcactctcaccatcagtaatctgcaacgtgtaagtattttcgactaacttattactagtacaacgtagtaaatttactaattcgttttacggaccgtaagggactaacgtaactaactaaacttaacgaactgtggtactagaccacctattctgttacctntacttccttacccgactacttcgtgtacg

SEQ ID NO: 137927 - DNA, 778 bp, Homo sapiens
  misc_feature: GYAE6OF01ALF1J.46.67.G01.1.454.CMB.1.raw
  modified_base (505)..(505): a, c, t, g, unknown or other
  misc_feature (505)..(505): n is a, c, g, or t
  modified_base (688)..(688): a, c, t, g, unknown or other
  misc_feature (688)..(688): n is a, c, g, or t
tcagactagcagtacacgaccggtgctcgatttagagtatacatattgggtttggggtagtcgtcggtcgaggacacgagcatggacatgagggtcccgctcagctcctgggctcctgctactctggctccgaggtgccagatgtgacatcgagctgacccagtcctccatccctccctgtcctacgccaaccggttgggacgacagtgtccaccagttccacgtttcggccgggacaagtcccggaaatgtttgaaccctaacctttaattttaaaagttggtaacttaccgaaactaacgttacgaccgtaacgggaccggtaccccttaaggtccttaaccccgtaataccttacttcggacttcgacgtaacttacccggagttttgaacccgtaaagggtttccggggtaccccaagttaccggtacgggttcaacgggttgaacccgtgggtagtaacgtccgtaggggaactacgtaacgtttcccaaacgtccctanaacccgtattacctaagttaccgtatccgaccgttaaagcgtttaaagttacgtttttacgtaaacttttacttaccgttacggttaacaaacgtaagttaatttcgaaatttcgttttaccgggacttaaagggaacctcgttaaactttaacgaaacttaaacgggtacttgggttaccgntaaacggaccccttaagaccgttacttaggtttacccattttaccggaccccttttacccggaacttaattccgttaagttccctaaacg

SEQ ID NO: 137928 - DNA, 594 bp, Homo sapiens
  misc_feature: GYAE6OF01DAW94.46.67.G01.1.454.CMB.1.raw
  modified_base (346)..(346): a, c, t, g, unknown or other
  misc_feature (346)..(346): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagacccctgtcccctcacctgcgctgtctctggtgcctccatcagtagttggtttcttcgtgggggctggggtccggcagcctccgaggggaaggggctggaatacattggaagtgtctctcatagtggaggttcctattacagttccgtctctcaagagtcgagtcaaccatatctctggacacgtccagcaatctacgttttcccngaacgatgagtttctgtgacccgcgctgacacgggtcttttattacgtgtgcgagagacggtctattatgtattttggagttggtttattcggtacctaccgtagacgtcggacggggtcctcggaccccgtggggaccgaagggtaatacgtcggtccaccgttccttccttacgcccttaccaacccgaacgggccccagtcccggttcccttccccctcgtcccaccctcccaccaagcgacccg

SEQ ID NO: 137929 - DNA, 1012 bp, Homo sapiens
  misc_feature: GYAE6OF01DNUF2.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaaccggtgggagacagtcgtcaccatcacttggcccgggacaaggtccggaaactatttacggaacctaacctttaattttaaaagttggttaactctaaaactagttaacgaacccgaacgggggaaccgggtaccccttaaaggccttacctaaattccttaagtcggtaccttacggacctacttacccgttaaggttttacgtaaccggtaaaaacgggttccggggggttacccccaaggtttaccgggtaacgggtttccgtaagggttggggtaccgtaagggttacggggtaacttccggttacgggggtaactaacgggttaactttttaccgacccgttttacccgtacctaaacccctaagttaaccgtaaacggtttaaacttacccgttacggtaacccgtaaaccggtttaagggtaaacggtttaacgttttttaacggtaaaccgtttaaaccgtttttaaacttttaaccgttaccggtttaaccgtaaacttaaacggtttaaaacttttaaccgttaaagtttttaccgggtttttttaaacccgggaaccggttaaaacccgggggtaaaccgttaaacccgggttaaaacccgttttaaaaccgttaaaaaaaccggttttaaaacccggttaaaaccggtttaccgggtttaaccggggtacccgtttaccggtaacccgttaaaaccccgttaacgtttacccggtttttacccgttttaacccgttttaacccgttaaacccttttccccccgtttttaaaccccccggtaccctttaaaccctttacgtttaaccggttaaaacccg

SEQ ID NO: 137930 - DNA, 656 bp, Homo sapiens
  misc_feature: GYAE6OF01EE4E2.46.67.G01.1.454.CMB.1.raw
  modified_base (193)..(193): a, c, t, g, unknown or other
  misc_feature (193)..(193): n is a, c, g, or t
tcagactagcagtacacgaccggtgctcgatttagagtatacatattgggtttgggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccgggcaagtcgaacatgacactattaattgtatcaacatagaccgagggaccgccctaagctacctaatctatgctgcatcctagtttgactaaggtcgggtacccagtcggtaggttcaggtggctaggtggatcgtggacagtatttcactctcacatcagtatctgctaagtagtaagttatttagactaacttattacttacgtacaactaagtaaactttaacgtaatttcggttttaccggaaccgtaacgggtaacctaaccggtaaaccttaaacgtaaaacgtttaaaaccgtaaaccgttaggttaccgggtacctaacggtaaccctaacccgttaagttacccgttacgtttacccgtttacccttaacccgttttaccccgtttacccccccggtacccttaaccgtttcccgtttaacggttaaacccg

SEQ ID NO: 137931 - DNA, 625 bp, Homo sapiens
  misc_feature: GYAE6OF01CUW0U.46.67.G01.1.454.CMB.1.raw
  modified_base (208)..(208): a, c, t, g, unknown or other
  misc_feature (208)..(208): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctcgtgggctgggtccgnagctccgagggagggctggaatacagttggaagtgtctctcataggtggtaggttcctattacagtccgtctctacaagagtcgagtcaccatatctctggacacgtccagacaatctagttttccagaagtatgagttctgtcgaccgccgtcgtcgacgtacggggtcttttaagtacgtggtaggacgtagtacggtacggtacttagtttagttgttaagtttttgggagtttggtttaatttcgaacgtacccgtagtacgtacgggacggggtcctccggacccgtggggaccgtaagggtaacgtacgtcggtacctaccggttcctccgttacgccctaccgaccgaacggtcccacgtccggttcccttcccccgtcggtcccctaccctacctaccaagcgtacccg

SEQ ID NO: 137932 - DNA, 581 bp, Homo sapiens
  misc_feature: GYAE6OF01EHTOM.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacttatttaaatggtatcaacatagaccagggaccggccctaagctacctaatctatgctgcatcctagtttgacaaggtcgggtccagtcgaggttcagtggcagtggatcgtagggactagtatttcactctccaactatacaagtaatctgactaacgtagtaagttatttacgactaactttattactagtactaactagtaattactaagttacgttttccggaaccgtaaggacctaacgtaactaaactaaacgttaaacgtaacttaggtacgtacttacgacgtaacctagttacttcgttaccttactacttccttacccgacctactcgtaggtaac

SEQ ID NO: 137933 - DNA, 605 bp, Homo sapiens
  misc_feature: GYAE6OF01BYS8L.46.67.G01.1.454.CMB.1.raw
  modified_base (290)..(290): a, c, t, g, unknown or other
  misc_feature (290)..(290): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggcagctcccgaggggaagggctggaatacattggaagtgtctctcatagtggaggttcctattacagtccgtctctcaagngtcgagtcaccatatctctggacacgtccagcaatctagttttcccagaagatgagttctgtcgaccgccgctgacacgggtctttatacgtgtgcgagagacgctattatgttagttttggagttggttattcgactacctagagtcggacggggtctcggacccgtggggaccgagggtaactacgtcggtccaccgtccttccgttacgccctacccgaaccgtaaccgggtcccctaacggttcccggttcccctttccccccgtcggtcccctacccccgttacccctacccgaaacggtccgtaccccg

SEQ ID NO: 137934 - DNA, 601 bp, Homo sapiens
  misc_feature: GYAE6OF01AFLKI.46.67.G01.1.454.CMB.1.raw
  modified_base (353)..(353): a, c, t, g, unknown or other
  misc_feature (353)..(353): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattgtatcaacatagaccagggaccggccctaagctcctaatctatgctgcatcctagtttgactaaaggtgggtcccatcggaggttcagtggcagtgatcgtgggacngtatttcactctcaccatcagtatctgacaacgtagtaagtattttacgacttaaacttattactagtacaactagtaattactaagttacgttttaccggaccgtaacgggacctaacgtaacttaaactaaaactttaaaccggaacgttaggtacggtaccttagaccctaaccctaagttccgttcgttacctttacctaacctttaccctttaccccggaccctacttccgttcggttaaacc

SEQ ID NO: 137935 - DNA, 657 bp, Homo sapiens
  misc_feature: GYAE6OF01CPNL1.46.67.G01.1.454.CMB.1.raw
  modified_base (171)..(171): a, c, t, g, unknown or other
  misc_feature (171)..(171): n is a, c, g, or t
  modified_base (250)..(250): a, c, t, g, unknown or other
  misc_feature (250)..(250): n is a, c, g, or t
  modified_base (333)..(333): a, c, t, g, unknown or other
  misc_feature (333)..(333): n is a, c, g, or t
  modified_base (353)..(353): a, c, t, g, unknown or other
  misc_feature (353)..(353): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtncctccatcagtagtggtttctcgtgggctgggtccgcagctcccgaggggagggctaggaatacattggaatgtctctnatagtggagttcctattacagtccgtctctacaagagtcgagtcacatatctctgaccacgtccagcaatctagtttccaganatgattctgtcgaccgccgntgacgtacgggtcttttaatcgtggtgcgagaggacggtcttattagtgttagttttggagttgtttattcgaactacccgtagtacgtccgggacggggtccctaccggtaccccggttgggggacccgtaaggggtaacttaccggttcgggttacccgtacccggttccttaccgttaccgtccccttaccgaaccccggtaaccggggccccctaacggttcccggttccccctttcccccccggtcggtacccccgttaccccccgttaccccgtacccgtaaacggcccgtaccccgg

SEQ ID NO: 137936 - DNA, 562 bp, Homo sapiens
  misc_feature: GYAE6OF01B3Y7N.46.67.G01.1.454.CMB.1.raw
  modified_base (214)..(214): a, c, t, g, unknown or other
  misc_feature (214)..(214): n is a, c, g, or t
  modified_base (224)..(224): a, c, t, g, unknown or other
  misc_feature (224)..(224): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgatccagtctccatcctcctgtctgcaaccgtgggagacagtgtcacatcacttgccggnaagtcgaacnttgacactattaattgtatcaacatagacaggacgccctaagctcctaatctatgctgcatccagtttgactaaaggtcgggtccctagtcgtaggttcaggtggcagtggatcgagggacagtatttcactctcaccatcagtaactctacgacaacgtgaagtatttagactaactttattactgtacaactagtaattacgtaattcgtttacggaccgtaagggtaactaacgtaactaactaaacgttaaaccgaacgttaggtacgacgtacgacctaaccattccgtacgttaccgttactacttacccttacccgcctacttccgtaacg

SEQ ID NO: 137937 - DNA, 527 bp, Homo sapiens
  misc_feature: GYAE6OF01D5UP9.46.67.G01.1.454.CMB.1.raw
  modified_base (350)..(350): a, c, t, g, unknown or other
  misc_feature (350)..(350): n is a, c, g, or t
  modified_base (413)..(413): a, c, t, g, unknown or other
  misc_feature (413)..(413): n is a, c, g, or t
tcagactagcagtacacgaccggtgctcgatttagagtatacatattgggtttggggagtctcggtcaggacacagcatgggcatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacactatttaatgtatcaacatagaccagggacgccctaagctctaatctatgctgcatccagtttgacaaagtgggtacccagtcgtaggttcagtggcagtggatcgtgggacagtntttcactctacacatcagtaatctgacacgtagaagttatttagtaacttattactgtacaanagtaattactaattcgtttcgactaaggacacgtactaacaaattaacgaactgtgactgacctactacttctgttcttactacttcccgttccccgactattctgtattaccg

SEQ ID NO: 137938 - DNA, 526 bp, Homo sapiens
  misc_feature: GYAE6OF01B8HTW.46.67.G01.1.454.CMB.1.raw
  modified_base (192)..(192): a, c, t, g, unknown or other
  misc_feature (192)..(192): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccgggcaagtcggaacattgacacctatttaaattggtatcaacatagaccagggacggccctaagctcctaatctatgctgcatccagtttgcaaagtgggtcccatcgagttcagtggcagtgatcgtgggacagatttcactctcaccatcagtaatctgacaacgtgtaagtattttgactaacttattactgtacaacagtaattacaattgtttcgacctaaggactacgaactaactaaattaacgaactgtaggctagacaccattcgtgttccttctacttcccttcccgacccacgttctgtaac

SEQ ID NO: 137939 - DNA, 582 bp, Homo sapiens
  misc_feature: GYAE6OF01EYB6L.46.67.G01.1.454.CMB.1.raw
  modified_base (289)..(289): a, c, t, g, unknown or other
  misc_feature (289)..(289): n is a, c, g, or t
  modified_base (336)..(336): a, c, t, g, unknown or other
  misc_feature (336)..(336): n is a, c, g, or t
  modified_base (568)..(568): a, c, t, g, unknown or other
  misc_feature (568)..(568): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctcgtggggctgggtccggcagctcccgaggggaagggctggaatacattggaagtgtctctcatagtggaggttcctattacagtccgtctctcaagngtcgagtcaccatatctctggacacgtccagcaatctacgttttccngaagatgagttctgtcgaccgcgctgactacgggtcgtttatactgtgcgagagacggtctattatagtagttttggagttggttactttcgactacccgtagtacgtcgggacggggtctccgacccgtggggaccctagggtaactacgtcggtccgtaccgtcgtccttacgccctaccgaaccgaccggcccacgtccggttcccttccccgcgtcctacccctaccnccaagccgtacccg

SEQ ID NO: 137940 - DNA, 571 bp, Homo sapiens
  misc_feature: GYAE6OF01B6X4V.46.67.G01.1.454.CMB.1.raw
  modified_base (333)..(333): a, c, t, g, unknown or other
  misc_feature (333)..(333): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggaaggggctggaatacattggaagtgtctctcatagtggaggttcctattacagtccgtctctcaagagtcgagtcaccatatctctggacacgtccagcaatcagtttcccngaagatgagttctgtcgaccgccgctgacacgggtctttatacgtgtgcgagagacgctattatgttattttggtagttgttatttcgactacctagatcggacggggctcggacccgtggggccgagggtaatacgtcggtacgtaccgtctccgttacgcccttccgacccgacggtccccacgtcccggttcccttcccccgtcggtcccacccctccctaccaacgcgtacccg

SEQ ID NO: 137941 - DNA, 775 bp, Homo sapiens
  misc_feature: GYAE6OF01DDZSC.46.67.G01.1.454.CMB.1.raw
  modified_base (252)..(252): a, c, t, g, unknown or other
  misc_feature (252)..(252): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtgggagacagtgtcaccatcacttggccggacagtcgaacattgacacttatttaatgtatcaanatagaccagggacgccctaagctactaatctatgctgcatcctagtttcgacgaaaggttcggggtacccagtaccggtaggtttccgaggttcggactaggttaggacgttacggttacgggggaacctaaggtactttttaccaccttaccctacaaacccctaattaccgtaagttaaacttcctacggtaaccgtaaccggttaagtaaaggtttacgtttttacggaaccttttaaaccgttttaattttaaaccgttacggttaaaccctaaaacgttaacgtttaaaactttaaccgttaaacggttttttacgggtttttaacccgggaacccgttaaacgggggtaaaccctaaacccgggttaaaccttaaaaccgttaaaaacgtttaaacccggttaaacgttaccggtacgggtaccttaccgaaccgtaaccttaccttcggttacgtttaccctttaccttacccgtttccccgtttaccccgtacccttacttcgttacggttaacc

SEQ ID NO: 137942 - DNA, 778 bp, Homo sapiens
  misc_feature: GYAE6OF01DUQA3.46.67.G01.1.454.CMB.1.raw
  modified_base (309)..(309): a, c, t, g, unknown or other
  misc_feature (309)..(309): n is a, c, g, or t
  modified_base (483)..(483): a, c, t, g, unknown or other
  misc_feature (483)..(483): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgccaactgcgaggacgtccgggcccacgacgtggtgacggtccttcggacgaccctgtccctcacctgcgtctgtctcgtggccctcatcagtagttgttctcgtggggctcgggccgcagccgtaccgaggggaagggctaggaactacgagttaggaagtgttcgtctanagttaggtggtacgttacctaattacgagtccgtactccagaagtcgtcgtatcaacctatactcctcgtaggacctacggtaccagtacctaagttcttaacggtttccagtaaatgtacggtacgtttcgtacggtacgacccgccgtacgtacgaacggttacccgggttnttttaaccgtaggttccggtaggaaccggtaagggttaccggaacgttacgtttaagtttaggttgggttttaaggtttttagggaagggttttacgtttaaacgtttaccgaacccgttaacccggtaggtaaccgggttacccccggggtaccggggtcccttaaccccggggaacccccggggtttgggggaaaccccttaaagggggttaaacccgttccgggttacgggttaaccccccgttacccgtttacccggtttaccccttaaacggtcccccgtaaaccccggg

SEQ ID NO: 137943 - DNA, 586 bp, Homo sapiens
  misc_feature: GYAE6OF01DS4JL.46.67.G01.1.454.CMB.1.raw
  modified_base (397)..(397): a, c, t, g, unknown or other
  misc_feature (397)..(397): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcgaacatgacactatttaatgtatcaacatagaccagggacgccctaagctactaatctatgctgcatcctagtttgacgtaaaggtcgggtacccagtcgaggttcaggtgcagtgatcgtgggacagtactttcacttctcacctatacagtaatctgactaacgtagaagttntttacgactaactttattactgtacaatagtaatttaacaagtttgtttaaccgggacctaaagggacctaacggtaaaccttaaactaaaacgtttaaaccggaacttaggtacgtacgtaggtaccctaaccgtattaccttgttaccctttacaccttcccgttaccccgactaactcgtgtaacc

SEQ ID NO: 137944 - DNA, 539 bp, Homo sapiens
  misc_feature: GYAE6OF01CAFEE.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccgagggaaggggctgggaatacattggaagtgtctctcatagtggaggttcctattacagtccgtctctcaagagtcgagtcaccatatctctggacacgtccagccaatcagttttcccctgaagatgagttctgtgaccgccgctgacacgggcgtttattactgtgcgagagacggctattatgtatttttggagttggttatttcgactaccctagactcgacggggcgtcgacccgtgggccacgggatacgtggtcaccgtctccttcgcctacccg

SEQ ID NO: 137945 - DNA, 522 bp, Homo sapiens
  misc_feature: GYAE6OF01BFVBZ.46.67.G01.1.454.CMB.1.raw
  modified_base (498)..(498): a, c, t, g, unknown or other
  misc_feature (498)..(498): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtatccatcctccctgtctgcaaccgtgggagacagtgtcaccatcacttgccgggcaagtcggaacattgacacctatttaaatggtatcaacatagaccagggacgccctaagctcctaatctatgctgcatccagtttgcaaagtgggtcccatcgaggttcagtggcagtggatcgtgggacagtattcactctcaccatcagtaatctagcaacgtgaagtatttgactaacttattactgtacaactagtaattactaattgtttacgaccgtaaggactacgtaactaacaaattaacgaactgtagtctagaccacctattctgtccttnacttccttcccgactactctgtac

SEQ ID NO: 137946 - DNA, 563 bp, Homo sapiens
  misc_feature: GYAE6OF01ECOZ6.46.67.G01.1.454.CMB.1.raw
  modified_base (335)..(335): a, c, t, g, unknown or other
  misc_feature (335)..(335): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctcgtggggctgggtccggcagctcccgagggaaggggctggaatacattggaagtgtctctcatagtggaggttcctattacagtccgtctctcaagagtcgagtcaccatatctctggacacgtccagcaatcagttttcccngaagatgagttctgtcgaccgccgctggacacgggtcgtttattactgtgcgagagacggctattatgtattttggagttggttatttcgactaccctagagtcggacggggctcgaccccgtggggccagggtaatacgtcggtcaccgtcttcctacgccctccgaccgaacgggcccagtccggtcccttcccccgtcgccctaccctccctccaagcgtacccg

SEQ ID NO: 137947 - DNA, 592 bp, Homo sapiens
  misc_feature: GYAE6OF01DWPB2.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacggccctaagctcctaatctatgctgcatccagtttgcaaagtgggtcccagtcgaggttcagtggcaggtggatcgtgggacagtatttcactctcaccatcagtaatctgactaacgtgtaagtatttacgactaactttattactgtacaaactagtaattaactaagtttcgtttacggaccaaagggtaacctaaccggtaaccttaaactaaaacttaaaccgaacttaggttacggacgtacgacctaacccgtattccgttacgttacctttacctacctttccccgtttaccccctaccgttacttccgtggtaacc

SEQ ID NO: 137948 - DNA, 593 bp, Homo sapiens
  misc_feature: GYAE6OF01AU4AN.46.67.G01.1.454.CMB.1.raw
  modified_base (332)..(332): a, c, t, g, unknown or other
  misc_feature (332)..(332): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcacggtggagacagtgtcaccatcacttgccgggcaacgtacggaacattgactacctaatttaaattggtatacaacatagaccagggtaccgccctaagctacctaatctatgctgctactccagtttgcgaaaggtcgggtccagtcgnggttacgagtggcaggtcgatcggtggacagtattcactcacacatcaagtactctgacacgtagaatatttgactaacttattactagtactaagtaactaatttaactaacgtttaggtttaccgaacggtaacgggtaacgtaaccgaaacgttaaactaaaacgtttaaaccgaacgttcggtaggacctagtacccgtaccttatacgttcgttaccttacgtacttacccgtcccgtacctaactcgtactaacg

SEQ ID NO: 137949 - DNA, 697 bp, Homo sapiens
  misc_feature: GYAE6OF01CSTLN.46.67.G01.1.454.CMB.1.raw
  modified_base (194)..(194): a, c, t, g, unknown or other
  misc_feature (194)..(194): n is a, c, g, or t
  modified_base (219)..(219): a, c, t, g, unknown or other
  misc_feature (219)..(219): n is a, c, g, or t
  modified_base (229)..(229): a, c, t, g, unknown or other
  misc_feature (229)..(229): n is a, c, g, or t
  modified_base (253)..(253): a, c, t, g, unknown or other
  misc_feature (253)..(253): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatccctccctgtctgcaaccggtggganacagtgtcaccatcacttgccgggnaagtcgaacnttgacactatttaaatgtatcaanatagaccagggaccgaccctaagctacctaatctatgctgcatccagtttagactaaaggtcgggtaccagtcgtaggttcagtggcagtcggatcgtagggactaggtactttacacgtctaccaactatacgtaagttaactcgtagaccgtaaacggttagtaaacgttagttttacgaaccttaacttttaacgttaacttacggttaacctaaacgttaaagttaaacttttaaactaagttttacgggtttttaaccggaacccggtaaacggggtaacctaaacggttaaacctaaaacgttaaaaaccgtttaaacggaaacgtttacggttaacggtaccgttacggaaccctaacccgtaatttccgttacgtttaaccgtttacctacctttaccccgttaccccgaccgttaacttccgttaagttaaaccg

SEQ ID NO: 137950 - DNA, 767 bp, Homo sapiens
  misc_feature: GYAE6OF01C0JY9.46.67.G01.1.454.CMB.1.raw
  modified_base (194)..(194): a, c, t, g, unknown or other
  misc_feature (194)..(194): n is a, c, g, or t
  modified_base (208)..(208): a, c, t, g, unknown or other
  misc_feature (208)..(208): n is a, c, g, or t
  modified_base (295)..(295): a, c, t, g, unknown or other
  misc_feature (295)..(295): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctcatcagtagtggtttctcgnggggctgggtccgnagctcccgaggggaaggggctaggaatacagttggaagtgtctctcataggtggtacggttcctattacagtcccgtctctcgaagngtcgagtcacctatactctcgtaggacctaccgtcagctaatccgtagtttcccagaagtactgtacgtttctaggtaccgtaccgccgtacgtacggtaaccggtaccgggttacgtttttaactacgttggtacggacgggtaacggtacggtaaccggttactttaaagtttaggttaggttttaaggttttttaggggtaagggttttacgggttttaacgtttacccggtaaccgttaacccgttaaggtacccggttaccggggtaaccggggggtcccttaccccggggtaccccggttaccgggggacccggtaaggggtaaccgttaccggttcgggttacccgtacccgttccgttaccgttaccgcccctaccggaacccgtaccgggtacccctacggttccccggttccccttccccgtcggtacccctacccctacccgtaccgaacgacgtaccccg

SEQ ID NO: 137951 - DNA, 539 bp, Homo sapiens
  misc_feature: GYAE6OF01B9ALM.46.67.G01.1.454.CMB.1.raw
  modified_base (217)..(217): a, c, t, g, unknown or other
  misc_feature (217)..(217): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggnaagtcggaacattgacacctatttaaatggtatcaacatagaccagggacgccctaagctcctaatctatgctgcatccagtttgacaaagtcggggtcccagtcgaggttcagtggcagtggatcgtgggacagtatttcactctcaccatcagtaatctagactaacgtgaatatttgactaacttattactgtacaacagtaacttacaattcgtttacgaccgtaacggactaacgtaactaactaaattaacgaactagtacgtctaggacctacgtatcttacgtcttacacttcttacccgacctactctgtaac

SEQ ID NO: 137952 - DNA, 512 bp, Homo sapiens
  misc_feature: GYAE6OF01AM6PL.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggccctaagctcctaatctatgctgcatccagtttgcaaagtggggtccccatcgaggttcagtggcagtggatcgtgggacagatttcactctcaccatcagtaatctgcaacgtgaagtattttgctaacttattactgtcaacagtaattactaattgttttcggaccaaggacacgactaacaaattaacgaactgtgctgacaccatctgttcttcacttccttcccgccactctgtac

SEQ ID NO: 137953 - DNA, 557 bp, Homo sapiens
  misc_feature: GYAE6OF01BD1IL.46.67.G01.1.454.CMB.1.raw
tcagactagcagtacacgaccggtgctcgatttagagtatacatattgggtttgggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggccctaagctcctaatctatgctgcatccagtttgcaaagtggggtcccatcgaggttcagtggcaggtggatcgtgggactagatttcactctcaccatcatatctgcaacgtagtaagtattttagactaacttattactgtacaacagtaattactaattcggtttacgaccgtaagggtaacctaacgtaacctaaactaaacttaaacgaactaggtcggtactcgacctaccgtatccttcgttccttactacttccgttaccccgtctacttcgtgtaac

SEQ ID NO: 137954 - DNA, 567 bp, Homo sapiens
  misc_feature: GYAE6OF01C9RE2.46.67.G01.1.454.CMB.1.raw
  modified_base (211)..(211): a, c, t, g, unknown or other
  misc_feature (211)..(211): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtncctcatcagtagtggtttctctggggctgggtccgcagcctccgagggaagggctggaatacattggaagtgtctctcatagtggagttcctattacagtccgtctctcaagtagtcgagtcaccatatctctggacacgtccagcaatctacgttttcccagtaacgatgtaagttctgtgaccgccgctcgacgacgggtcttttatactgtgcgagacgacggcttattagtgttattttggagtttggttatttcgactacccgtagtacgtcggaccggggtctacccggaccccgtggggaccaggggtaactacgtcggtccaccgttctacccgttgcccgtaacccg

SEQ ID NO: 137955 - DNA, 592 bp, Homo sapiens
  misc_feature: GYAE6OF01ASITI.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacaccttatttaaattggtatcaacatagaccagggaccgccctaagctcctaatctatgctgcatccagtttgacaaaggtcgggtcccagtcgaggttcaggtggcagtgatcgtaggacagtattcactcacacatctagtaatctgacctaacgtgtaagtatttgacttaactttattactagtaaacagtaattactaagtttcggtttacggaccgtaacgggtactaacgtaaccttaaactaaaacgttaaacgtacgtggtacggtactacgaccgtaacctagttaccgttacgttacccttactaacctttcccgttaccccgtacttaattccgttacgtacttaccg

SEQ ID NO: 137956 - DNA, 628 bp, Homo sapiens
  misc_feature: GYAE6OF01DMHOB.46.67.G01.1.454.CMB.1.raw
  modified_base (171)..(171): a, c, t, g, unknown or other
  misc_feature (171)..(171): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtncctccatcagtagtggtttcttcgtggggctgggtccgcagctcccgagggaagggctggaatacattggaagttgtctctcagttaggtggtaggttcctaattacagtccgtctctcaagagtcgagtcaccatatctctggacacgtcagactaatctacgtttccagtaacgatgtagttctgtcgaccgcgctgacgtacggtctttatcgtgtcgcgagagacgtctagttatgttagttttggagtttaggtttattaccgtactaccgtagtacggtcggacggggtctccggtacccggtacggggaccgtaagggtactaccggtcggtacctccgtccttaccgttaccgccctacccgaccgtaccggtccctacggttcccggttaccccgttcccccgtacggtacccctaccccgttacccgtaccgtaacgtcgtaccccg

SEQ ID NO: 137957 - DNA, 526 bp, Homo sapiens
  misc_feature: GYAE6OF01AM6LK.46.67.G01.1.454.CMB.1.raw
  modified_base (381)..(381): a, c, t, g, unknown or other
  misc_feature (381)..(381): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggacattgacacctatttaaatgtatcaacatagaccagggacgccctaagctcctaatctatgctgcatccagtttgcaaagtggggtcccatcgaggttcagtggcagtggatcgtgggacagtatttcactctcaccatcagtaatctgcaacgtnaagtattttgactaacttattactgtacaactagtaattacaattagttttcggaccgtaagggactaacgaacttaacaaattaaaccgaactgtagctgactacctatctgttccttcacttccttacccgctactctgtaac

SEQ ID NO: 137958 - DNA, 579 bp, Homo sapiens
  misc_feature: GYAE6OF01C2RO1.46.67.G01.1.454.CMB.1.raw
  modified_base (191)..(191): a, c, t, g, unknown or other
  misc_feature (191)..(191): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaaccgtggganacagtgtcaccatcacttgccggcaagtcgaacattgacactatttaaatgtatcaacatagaccagggacggccctaagctctatctatgctgcatccagtttgcaagtggtcccatcgaggttcagtggcagtgtatcgtgggacagtatttcactctacacctatcagtaatctgacaacgtagaagtatttgactaacttattactgtacaactaagtaaattactaagttcgtttaaccggacctaaacgggacctaacggtaaccttaaacgtaaaacgttaaacgaaccgttagtacggtacctaggacctaacctaagttaccgttacgttacctttacctacgttccctttaccccgaccttaacttccgtaggtaaac

SEQ ID NO: 137959 - DNA, 537 bp, Homo sapiens
  misc_feature: GYAE6OF01BU4BW.46.67.G01.1.454.CMB.1.raw
  modified_base (193)..(193): a, c, t, g, unknown or other
  misc_feature (193)..(193): n is a, c, g, or t
  modified_base (212)..(212): a, c, t, g, unknown or other
  misc_feature (212)..(212): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggcctttcggagaccctgtccctnacctgcgctgtctctggtncctccatcagtagtggtttctctggggctgggtccgcagctccagggaaggggctggaatacattggaagtgtctctcatagtggaggttcctattacagtccgtctctcaagagtcgagtcaccatatctctggacacgtcagcaatcagttttccctgaagatgagttctgtgaccgccgctgacacgggtcgtttattactgtgcgaggagacggctattatgatttttggagttggttatttcgacaccctagatcggacggggctccggccccgtggggccgagggaactacgtaggtcaccgtctccttgcctaccccg

SEQ ID NO: 137960 - DNA, 519 bp, Homo sapiens
  misc_feature: GYAE6OF01BH5CR.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacggccctaagctcctaatctatgctgcatccagtttgcaaagtggggtcccatcgaggttcagtggcagtggatcgtgggacaggatttcactctcaccatcagtaatctgcaacgtgaagtattttgactaacttattactgtacaacagtaaattacaattgtttacggacctaagggactaacgaactaacaaacttaaacgaactgtacgctgactacatctgtcttcacttcctcccgacatctgtac

SEQ ID NO: 137961 - DNA, 552 bp, Homo sapiens
  misc_feature: GYAE6OF01EBGS9.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtcgcctccatcagtagtggtttcttcgtggggctgggtccgcagctcccgagggaagggctggaatacagttggaagtgtctctcatagtggaggttctattacagtccgtctctcaagagtcgagtcaccatatctctcggacacgtccagcaatctacgttttcccagaacgtatgtagttctgtcgaccgcgctgacgcgggtctttatactgtgcgagaggacgtctattagtgttagttttggagttggtttatttcgacctacctagacgtcggcggggcctccggacccgtggggaccagggactacgtcggtcctaccgtctcctcgcctacccg

SEQ ID NO: 137962 - DNA, 848 bp, Homo sapiens
  misc_feature: GYAE6OF01ECZM2.46.67.G01.1.454.CMB.1.raw
tcagactagcagtacacgaccggtgctcgatttagagtatacatattgggtttggggagtctcggtcaggacacagcatggacatgacgggtccccgctcagctcctggggctcctgctactctggctccggaggtgccagatgtgacatcgagctcgacccagtcctccatcctccctgtctgaccgaaccggtgggacacgtagtcgtccacctatcctacgttcggaccgggactaaggtccggaaactagtttacgaacctaaccgtttaagttttaaacgttggttaacttaccaaaacgtaacgtaacggaacccgaacgggggtaacccgtacccccgtaaagtaccttaccctaaacttccgtaacgttcggtccttacgtaccgtaacgttccccgtttaaggtttacggtaaccgtaaaacggggtttccggggttaccccaaggtttacccggtaggttaccgaagggttcggaccgtagggttacgggtacgttccggtaggggtaaccttacggttaccttttaccgaaccgttaccctaccgtaacccgtattaccgtaaagtttaaccgtccgttaaggtaacccgtaaggttacgtaaagtttacgtttaacgtaaccttaaactttaacgtttaaccgtacgtaaccgtaaactaagttaactttaacgtagtttaccggttttacggaaccgtaacggtacgtaaccgtaaacttaaacgttaaaacgtaaccggtaagtacggtcgtacccgtagtacccgtaccgttagtaccgttcgttaccttactacccgttacccttaccccgtacgtacttccgtcgttaacg

SEQ ID NO: 137963 - DNA, 752 bp, Homo sapiens
  misc_feature: GYAE6OF01CM5Y3.46.67.G01.1.454.CMB.1.raw
  modified_base (230)..(230): a, c, t, g, unknown or other
  misc_feature (230)..(230): n is a, c, g, or t
tcagactagcagtacacgaccggtgctcgatttagagtatacatattgggtttggggagggtctcggtcaggacacagcatgggacatgagggtccccgctcaggctcctggggctcctgctactctggctccgaggtgccagatgtgacatcgagctgacccagtctccatcctccctgtctgcgaaccgtggagacagtgtcaccatcacttgccggacaagtcgaanttgacactatttaattgtatcaacatagaccagggaccgaccctaagctacctaactactatgctgcatccagtttagacgtaaacggttcggggtaccctagtcggtaggttcgaggttcggcgtaaggttacggaagttccgtaggggaacaggtactttaccaccgttcctaccacctaactcgtaagtaacttcgtagaccgtaacggttaggaaagttagtttttacgaacttaactttactttaacttaggtaacctaaacgtaacgtaaactttaacgtaaacgtttcggtttttaaccggaaccggttaaacggggtaacctaaccggttaaaccttaaaaccgttaaaacggtttaaaccgggtaaaccggttacgggttacgggtaccgttacggtaacccgtaacccgttaacgtttacccggtttacggtttacccgtttaacccgttaccgtttacccccggtttacccccggaaccctttaaccttcccggtttaccggttaaacccg

SEQ ID NO: 137964 - DNA, 584 bp, Homo sapiens
  misc_feature: GYAE6OF01CTP5F.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaaccgtgggagacagtgtcaccatcacttgccgggcaagtcggaacattgacactatttaaatgtatcaacatagaccagggacgccctaagctacctaatctatgctgcatccagtttgactaaaggtgggtcccatcggaggttcagtggcaggtggatcgtgggactagatttcactctcacatacagtaatctgacaacgtagaagttatttacgactaactttattactgtacaactagtaaattaactaagtttcgttttaccggaccgtaaaggggaacctaacgtaacttaaactaaaacgttaaacgtaacttaggtacggactacgacctaacctattccgttgttaccgttactacctttcccttaccccgaccttactccgttagtaaaccg

SEQ ID NO: 137965 - DNA, 657 bp, Homo sapiens
  misc_feature: GYAE6OF01BKBZR.46.67.G01.1.454.CMB.1.raw
  modified_base (248)..(248): a, c, t, g, unknown or other
  misc_feature (248)..(248): n is a, c, g, or t
  modified_base (331)..(331): a, c, t, g, unknown or other
  misc_feature (331)..(331): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctcgtgggctgggtccgnagctccgagggaagggctggaatacagttggaagtgtctctcagttgtggtaggttcctattacgagttccgtctctacaagngtcgagtcaccatatctctggactacgtccagctaatcttaacgttttcccagaaacgtagttgtaacgtttcgtgttacgacccgccgtcgtaggaaccgtacgggttactttaacttacgtggtcgacgaggacggtacgtcttaatttagtagttacgtttttagggagtttaggtttaactttccgaacctacccgttaaggtcgtaccggggtaccgggggtccttacccggtaccccgggtaggggacccggtaacggggtaactacggttcgggtacccgtacccggttacccttccgttaccgtcccgtaacccccgg

SEQ ID NO: 137966 - DNA, 654 bp, Homo sapiens
  misc_feature: GYAE6OF01D3B9N.46.67.G01.1.454.CMB.1.raw
  modified_base (192)..(192): a, c, t, g, unknown or other
  misc_feature (192)..(192): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcacatcacttgccgggacaagtcggaacattgactacctaatttaaatgtatcaacatagacagggacgccctaagctctaatctatgctgactactcctagtttgactaaaggtcgggtacccagtcgtaggttcagtggctagtggatcgtagggacagtactttcactctacactatactaagttaactcgtgacgtaacggttagtaaagttattttacgacttaaactttatttacgtacgtacctaaacgtaagtaaactttaacctaagtttacggttttaccggaaccgtaacggggtaacctaacggtaaaccttaaacgtaaaacgtttaaaccgaaacgttacggtacgtaccgtacggtaaccctaaccgtacgttcttaccggtttaccttacctaacgtttccccgttaccccgtaccgttaacttccgttaagtaacccg

SEQ ID NO: 137967 - DNA, 578 bp, Homo sapiens
  misc_feature: GYAE6OF01BD8T5.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctcgtgggctgggtccgcagctcccgagggagggctggaatacagttggaagtgtctctcataggtggtaggttcctattacagtccgtctctcaagtgtcgagtcaccatatctctggacacgtccagcaaatctacgttttccagaagtatgtagttctgtcgacccgccgtctacgaccgtacgggtcttttatacgtgtcgacgagtaggacgtctattagtgttagttttggagttgtttagttcgtactaccgtagacgtcggacgggtctccggacccgtgggaccgtagggtaacttcgtcggtctaccgtcttcctacgcctaccaccgacggtcccagtcccgtccttccccgcggccctacccctcaccagcgaccg

SEQ ID NO: 137968 - DNA, 553 bp, Homo sapiens
  misc_feature: GYAE6OF01EW5EY.46.67.G01.1.454.CMB.1.raw
  modified_base (331)..(331): a, c, t, g, unknown or other
  misc_feature (331)..(331): n is a, c, g, or t
  modified_base (489)..(489): a, c, t, g, unknown or other
  misc_feature (489)..(489): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctctggggctgggtccggcagctccaggggagggctggaatacattggaagtgtctctcatagtggaggttcctattacagtccgtctctcaagagtcgagtcaccatatctctggacacgtccagcaatcagttttcccngaacgatgagttctgtgaccgccgctgacacgggtcgtttattacgtgtgcgagagacggctattatgtattttggagttgttatttcgacacctagactacggacggggctcgacccgtgggccgagggatacgtgtcgaccgtctccgtacgtccnccgaccgacggcccacgtccggtccttccccgcggtccctaccctaccctccaacgcgtacccg

SEQ ID NO: 137969 - DNA, 597 bp, Homo sapiens
  misc_feature: GYAE6OF01BY459.46.67.G01.1.454.CMB.1.raw
  modified_base (192)..(192): a, c, t, g, unknown or other
  misc_feature (192)..(192): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccggcaagtcggaacattgacacctatttaaatgtatcaacatacgaccgagggacgaccctaagcctactaatctatcgctgcactcctagtttgactaaaggtcgggtacccagtacgagttcgaggtggcgagtggatcgtggactagtacttcactctcactatcagtaatctgacgtaacgtagtaattagtttcgactaactttattacgttatactaacagtaacttaactaagtttcggtttacgaccgtaaacgggactaacgtaacttaaacgtaaacgttaacgaaacgttaggtacgtacgtacgacctaacctaagttcttacggttccttacttaccttacccgttacccgtacctacttcgtaggttaacc

SEQ ID NO: 137970 - DNA, 528 bp, Homo sapiens
  misc_feature: GYAE6OF01D357Z.46.67.G01.1.454.CMB.1.raw
  modified_base (340)..(340): a, c, t, g, unknown or other
  misc_feature (340)..(340): n is a, c, g, or t
  modified_base (412)..(412): a, c, t, g, unknown or other
  misc_feature (412)..(412): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacgccctaagctcctaatctatgctgcatccagtttgctaaagtgggtcccatcgagttcagtggcagtgatcgngggacagtattcactctcaccatcataatctagacaacgtgaagttatttgactaacttattactgtacaanagtaattacaattcggtttacgaccgaagggaccagtaacctaactaaacttaacgaactgtagctagccgaactatcttgtaccttacaacttcctccccgactacttcgtgtac

SEQ ID NO: 137971 - DNA, 535 bp, Homo sapiens
  misc_feature: GYAE6OF01EGMYO.46.67.G01.1.454.CMB.1.raw
  modified_base (345)..(345): a, c, t, g, unknown or other
  misc_feature (345)..(345): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggagacagtgtcaccatcacttgccgggcaagtcggaacattgactacctattaaatggtatcaacatagaccagggaccgccctaagctcctaatctatgctgcatcctagtttgacaaaggtcgggtcccagtcgagttcaggtgcagtggatcgnggacagtattcactctcacatcagtaatctgacgaacgtagtaagtatttagactaacttattactgtacaatagtaatactaattgtttcggactaaggacacgtaactaactaaataacgaactgtaggtactagtaccgacctataccttgttaccttcacttccttcccgacctactcgtgtaacg

SEQ ID NO: 137972 - DNA, 524 bp, Homo sapiens
  misc_feature: GYAE6OF01ESHNW.46.67.G01.1.454.CMB.1.raw
  modified_base (192)..(192): a, c, t, g, unknown or other
  misc_feature (192)..(192): n is a, c, g, or t
  modified_base (496)..(496): a, c, t, g, unknown or other
  misc_feature (496)..(496): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccgggcaagtcggaacattgacaccttatttaaattggtatcaacatagaccagggaccggccctaagctcctaatctatgctgcatcctagtttgcaaaggtggggtcccagtcgaggttcaggtggcagtggatcgtgggacagtatttcactctcaccatcagtatctgacaacgtgaagtattttgactaacttattactgtacaactagtaattacaattgtttacggacctaaggactacgaactaacaaattaaacgaactgtgctagctaccatctntcttcacttccttcccactctctgtaac

SEQ ID NO: 137973 - DNA, 655 bp, Homo sapiens
  misc_feature: GYAE6OF01CV41V.46.67.G01.1.454.CMB.1.raw
  modified_base (220)..(220): a, c, t, g, unknown or other
  misc_feature (220)..(220): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtgggagacgagtgtcaccatcacttggccgggnaagtcggaacattgacacttatttaaattgtatacaacatagaccgagggaccgccctaagctacctaatctaatgctgctatcctagtttgactaaaggtcgggtacccagtacgaggttcaggtcggacagtggatcgtagggactagtactttcacttctacacctatactaagttaactcgtacgactaacggtagtaaagttattttacggaccttaaactttactttaacgtaggttaacaaacgtaacgttaaactttaactaagttttacggttttaaccgggaaccgttaaacggggaaacctaaccggtaaaccttaaacgtaaaacgttaaacgtaaaccgtaggtacggtaccgttacgaccgtaacctattaccgttcgttacttacctacttcccgttaccccgactacttcgtggttaac

SEQ ID NO: 137974 - DNA, 602 bp, Homo sapiens
  misc_feature: GYAE6OF01CYD8A.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacgccctaagctacctatctatgctgcatccagtttgacaaagtcgggtcccagtcgaggttcagtggcagtggatcgtgggactagactttcgacttctacaccgatctaagtaactctgactaacgtgaaagtatttagactaactttatactctacaactaagtaattactaagttcggttttacggaccgtaagggtaacctaacgtaaccttaaactaaaacttaaacgaaacttggtacggtacctaggaccgtaaccgtattaccgttgttacccgtttacctactttaccctttacccccgtacccttaacttccgttaggttaaaccg

SEQ ID NO: 137975 - DNA, 547 bp, Homo sapiens
  misc_feature: GYAE6OF01BP90E.46.67.G01.1.454.CMB.1.raw
  modified_base (216)..(216): a, c, t, g, unknown or other
  misc_feature (216)..(216): n is a, c, g, or t
  modified_base (227)..(227): a, c, t, g, unknown or other
  misc_feature (227)..(227): n is a, c, g, or t
  modified_base (413)..(413): a, c, t, g, unknown or other
  misc_feature (413)..(413): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccggnaagtcggaacntgacactattaaatgtatcaacatagacaggacggccctaagctcctaatctatgctgcatccagtttgctaagtgggtcccatcgaggttcagtggcagtggatcgtgggacagtattcactctcacctatcaagtatctagactaacgtgtaagtattttcgactaactttattactgtacaanagtaattaacaagttacgtttacggaccgtaagggactaacggactaaacgtaaattaaacgaacttagaggtactacggacctacctatacttgttcttactacttccttccccgactacttcgtagtaaccg

SEQ ID NO: 137976 - DNA, 510 bp, Homo sapiens
  misc_feature: GYAE6OF01BX4V3.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacgccctaagctcctaatctatgctgcatccagtttgcaaagtgggtcccatcgaggttcagtggcagtggatcgtgggacagatttcactctcaccatcagtaatctgcaacgtgaagtattttgactaactttattactgtacaaactagtaattacaattgttttcggacctaagggacacgactaacaaattaacgaatgtggctgcactatctgtcttcattccttccgccatctgtac

SEQ ID NO: 137977 - DNA, 571 bp, Homo sapiens
  misc_feature: GYAE6OF01B5VLZ.46.67.G01.1.454.CMB.1.raw
  modified_base (253)..(253): a, c, t, g, unknown or other
  misc_feature (253)..(253): n is a, c, g, or t
  modified_base (289)..(289): a, c, t, g, unknown or other
  misc_feature (289)..(289): n is a, c, g, or t
  modified_base (556)..(556): a, c, t, g, unknown or other
  misc_feature (556)..(556): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtgggctgggtccggcagcctccgaggggaagggctggaatacattggaagtgtctctnatagtggaggttcctattacagtccgtctctcaagngtcgagtcaccatatctctggacacgtccagcaatcagttttccctgaagatgagttctggtgaccgccgctgacacgggcttttattactggtgcgagagacggctattatgttattttggagttggtttatttcgactacccgtagactcggacgggctcgacccgtcggggccagggtaactacgtggtccaccgttcctccttacgccctacccgaccgacgggcccacgttccggtccttcccccgtggtcccaccctcccnccgaacgcgtacccg

SEQ ID NO: 137978 - DNA, 607 bp, Homo sapiens
  misc_feature: GYAE6OF01DJB9X.46.67.G01.1.454.CMB.1.raw
  modified_base (252)..(252): a, c, t, g, unknown or other
  misc_feature (252)..(252): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggacattgacactatttaaatggtatcaanatagaccaggacgccctaagctctatctatgctgcatccagtttgacaaaggtcgggtcccagtcgagttcagtggactagtggatcgtgggacagtatttcgactctcaccatacagtaatctagactaacgtgtaagtattttacgactaactttattacttgtaacctaactaagttaattaactaagtttacggttttaccggaccgtaaacggggtacctaaaccgtaaccttaaacgttaaaacgttaaaccgtaaaccgttaggttacggacttacgacccgtaacctaacgttcgttcgttacctttacctaccttcccttaccccgaccttacttcctagttaacg

SEQ ID NO: 137979 - DNA, 620 bp, Homo sapiens
  misc_feature: GYAE6OF01B0AN9.46.67.G01.1.454.CMB.1.raw
  modified_base (286)..(286): a, c, t, g, unknown or other
  misc_feature (286)..(286): n is a, c, g, or t
  modified_base (322)..(322): a, c, t, g, unknown or other
  misc_feature (322)..(322): n is a, c, g, or t
  modified_base (424)..(424): a, c, t, g, unknown or other
  misc_feature (424)..(424): n is a, c, g, or t
tcagactagcagtacacgaccggtgctcgatttagagtatacatattagggtttggggagtctcggtcaggactacaggcagtggacatgagggtccccggctcagctcctaaggggctccctgctacgtctggctccgaggtgccagatgtgacatcggagtctgacccagtctccatcctcccgtgtctgaccgtaaccggtggggagtacgaggtcgtacgaccagtccacgttcgccggcaagtccgaacattcgaccacttattaacttcggtatcaactntacgaccgagggaccgccctaagcctacaagtctangcctcgtcactccgtaggtttgaccgtaaaggtcgggttacccagtcggagttccgagtggcaggtcggtatcgtagggaacgagtacttcacgtctcgacntacaagtatcgtagctaacgtgtaagttcttagactaatttctacgttacgtacaactagtaatttataagtttcgttacgacgtaaggtacctaacgtaacttaaacaaacgttaacgaactcggtaggtcctaacgtcaacctattccggttattcccttagtaccgttcccttacccggactactcgtagtac

SEQ ID NO: 137980 - DNA, 564 bp, Homo sapiens
  misc_feature: GYAE6OF01BOKBI.46.67.G01.1.454.CMB.1.raw
  modified_base (219)..(219): a, c, t, g, unknown or other
  misc_feature (219)..(219): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgccaaccgtgggagacagtcgtcaccatcacttgccgggnaaggtcggaacattgacaccttatttaaatgtatcaacatagaccagggacgccctaagcctctaatctatgctgcatcctagtttgcaaggtcgggtcccagtcggtagttcaggtggcaggtaggatcgtgggactagtattcactctacacctatcagtaatctagactaacggtagtaagttatttagactaactttattacttagactaacgaataatttaactagttgtttaccggacgtaagggacctaacgtaacttaactaaacgttaaacgaactggtacgactagaccactatcttcgttccttacgacttccctacccgacctcgttctgtac

SEQ ID NO: 137981 - DNA, 607 bp, Homo sapiens
  misc_feature: GYAE6OF01EEDBR.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtcgcctccatcagtagttggtttcttcgtggggctgggtccggcagcctccgaggggagggctggaatacagttggaagtgtctctcagtagtggaggttcctattacagtccgtctctcaagagtcgagtcacatatctctggacacgtccagcaatctacgttttcccagaagatgtagttctgtcgaccgccgctgacgacgggtcttttatacgtgtgacgagagacggtctattatgttagttttggagttggtttatttcgacctacccgtagtacgtcgggacggggtcctccggacccgtggggaccagggtatacgtcggtccaccgttctccgttacgccctacccgaaccgacgggtcccacgttcccggttaccccttcccccgcgggtacccctaccccttcccgtacccaaggtccgtaccccg

SEQ ID NO: 137982 - DNA, 582 bp, Homo sapiens
  misc_feature: GYAE6OF01EISH9.46.67.G01.1.454.CMB.1.raw
  modified_base (192)..(192): a, c, t, g, unknown or other
  misc_feature (192)..(192): n is a, c, g, or t
  modified_base (227)..(227): a, c, t, g, unknown or other
  misc_feature (227)..(227): n is a, c, g, or t
  modified_base (253)..(253): a, c, t, g, unknown or other
  misc_feature (253)..(253): n is a, c, g, or t
  modified_base (347)..(347): a, c, t, g, unknown or other
  misc_feature (347)..(347): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccggcaagtcggaacnttgacaccttatttaaatgtatcaanatagaccaggacgccctaagctcctaatctatgctgcatcctagtttgacaaagtgggtccatcgaggttcagtgcagtgatcgtgggacagtnttcactctacacatcagtaactctgactaacgtagtaagtatttagactaacttatttaactgttacaactaagtaatttaactaagttcgttttacgaccgtaaaggaactaaaccgtaacttaaactaaaacgtttaaaacgaaacgttaggtacggtactacgacctaacctattacttcgtacctttacgtaacctttcccttaccccgtaccctaacttccgtgttaaac

SEQ ID NO: 137983 - DNA, 544 bp, Homo sapiens
  misc_feature: GYAE6OF01EEO1M.46.67.G01.1.454.CMB.1.raw
  modified_base (335)..(335): a, c, t, g, unknown or other
  misc_feature (335)..(335): n is a, c, g, or t
  modified_base (516)..(516): a, c, t, g, unknown or other
  misc_feature (516)..(516): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggaaggggctggaatacattggaagtgtctctcatagtggaggttcctattacagtccgtctctcaagagtcgagtcaccatatctctggacacgtccagcaatctagttttcccngaagatgagttctgtcgaccgccgctgacgtacgggcgttttatactgtgcgagagacggctattatgtattttggagttgttattcgactaccctagagtcggacgggctcgacccgtgggccagggatcgtgcacgtctctacgcctccaccgacggcccagtccggtccttcccccgnggtcccacccctcctccaagcgtacccg

SEQ ID NO: 137984 - DNA, 542 bp, Homo sapiens
  misc_feature: GYAE6OF01D6IK5.46.67.G01.1.454.CMB.1.raw
  modified_base (406)..(406): a, c, t, g, unknown or other
  misc_feature (406)..(406): n is a, c, g, or t
  modified_base (537)..(537): a, c, t, g, unknown or other
  misc_feature (537)..(537): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctattaaattggtatcaacatagaccagggacggccctaagctcctaatctatgctgcactcctagtttcgacgtaaaggtcgggtcccagtcggtaggttcaggtggcaggtggatcgtggacagtattcactctcactatactagtaactctagacaacgtagtaagtntttgactaactttattactatacaactataacttactaagttagtttccgacgtaaggactaacgtactaactaaactaacgtactagtagctagacactatctcgtacttcactccttacccgactactntgtac

SEQ ID NO: 137985 - DNA, 603 bp, Homo sapiens
  misc_feature: GYAE6OF01EW45C.46.67.G01.1.454.CMB.1.raw
  modified_base (335)..(335): a, c, t, g, unknown or other
  misc_feature (335)..(335): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggaaggggctggaatacattggaagtgtctctcatagtggaggttcctattacagtccgtctctcaagagtgagtcaccatatctctggacacgtccagcaatcagtttttccccngaagatgagttctgtcgaccgccgctgacacgggtctttaattacctgtgcgagagacggctattatgtattttggagttggttatttcgactacccgtagacgtacggacggggtcctccggaccccgttggggcccaggggtaactacgttcggtcaccggtcttccgttacgccctacccgacccgaacgggtcccacgtcccggttccctttcccccccgtaggtcccctaccccttaccccgtaccctaaacggcgtaccccg

SEQ ID NO: 137986 - DNA, 606 bp, Homo sapiens
  misc_feature: GYAE6OF01CRDW0.46.67.G01.1.454.CMB.1.raw
  modified_base (252)..(252): a, c, t, g, unknown or other
  misc_feature (252)..(252): n is a, c, g, or t
  modified_base (401)..(401): a, c, t, g, unknown or other
  misc_feature (401)..(401): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgaccatcgagctgacccagtctccatcctccctgtctgcaaccggtggagacagtgtcaccatcacttggccggcaagtcgaacattgacactatttaaatgtatcaanatagaccagggacgccctaagctacctaatctatgctgcatccagtttgactaaggtcgggtacccagtcgaggttcagtggcaggtgatcgtagggactagtactttcacttctacacctatcagtaatctagactaacgtgtaattntttacgactaactttattaacttgtaacaactataaactttaacgtaatttcggtttaccggaacgaacgggtacctaacgtaacttaaactaaaacgttaacgtaacgttggtacggtactacggacctaacctagtttccgttagtttacccttaccttaccgttcccgttacccccgaccttaacttccgttagttaacccg

SEQ ID NO: 137987 - DNA, 569 bp, Homo sapiens
  misc_feature: GYAE6OF01BFJBP.46.67.G01.1.454.CMB.1.raw
  modified_base (333)..(333): a, c, t, g, unknown or other
  misc_feature (333)..(333): n is a, c, g, or t
  modified_base (393)..(393): a, c, t, g, unknown or other
  misc_feature (393)..(393): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctctggggctgggtccggcagctcccgagggaggggctggaatacattggaagtgtctctcatagtggaggttcctattacagtccgtctctcaagagtcgagtcaccatatctctggacacgtccagcaatcagttttcccngaagatgtagttctgtgacccgcgctgacgacgggtctttatactgtgcgagagtacggntattatgtattttggagttggttatttcgactaccctagacgtcggacggggcctccggacccgtggggccgagggactacgtcggtcaccgtctcctacgtcctaccaccgaacggcccacgtccggtacccttcccccgtcggtccctacccctccctaccaacgtcgtacccg

SEQ ID NO: 137988 - DNA, 584 bp, Homo sapiens
  misc_feature: GYAE6OF01ACCUG.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacgccctaagctctaatctatgctgcatccagtttgcaaagtcgggtcccatcgaggttcagtggcagtggatcgtgggacagtatttcactctcacatcataatctgcaacgtgaagtatttagacttaacttattactagtactaactaagtaattaactaattcggttttacggaccgtaaacgggtaacctaacgtaacttaaacgtaaaacgttaaaaccgtaacgttagtacggtacgttagacccgtaacctattacgttcgttaccttacgtacttccttacccccggtacctaacgttcctagtaaccg

SEQ ID NO: 137989 - DNA, 646 bp, Homo sapiens
  misc_feature: GYAE6OF01C9PN4.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtccaccatcacttgccgggcaagtcgaacattgacacctatttaaatgtatcaacatagaccagggaccgccctaagctacctaatctatgctgcatccagtttgacaaaggtcgggtcccagtcgaggttcagtggcagtgatcgtagggacagtatttcacttctcaacctatacagtaatctgactaacgtagtaagttatttagactaactttattactacgttacaactaagtaaatttaactaagtttacggttttaccggaaccgtaaacgggtacctaaccgtaacttaaaccttaaaaacgtttaaaccgtaaacgttacggttacggtaccgttacgaacccgtaacccgttaatttacccgtttacggtttaccctttaccttaaccgtttacccccgttttacccccgtacccttaaccgttccttaggttaaacc

SEQ ID NO: 137990 - DNA, 566 bp, Homo sapiens
  misc_feature: GYAE6OF01AJJ5Y.46.67.G01.1.454.CMB.1.raw
  modified_base (290)..(290): a, c, t, g, unknown or other
  misc_feature (290)..(290): n is a, c, g, or t
  modified_base (336)..(336): a, c, t, g, unknown or other
  misc_feature (336)..(336): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcgggagacccctgtccctcacctgcgctgtctctggtgcctccatcagtagtggtttctcgtggggctgggtccgcagcctccgaggggaggggctggaatacagttggaagtgtctctcatagtggaggttcctattacagtccgtctctcagngtcgagtcaccatatctctggacacgtccagcaatcagttttcccngaagatgagttctgtcgaccgccgctgacacgggtcgtttatacgtgtgcgagagacggctattatgtagttttggagttggttattcgactacctagacgtcggacggggcctccggacccgtggggccaggggtactacgtggtccaccgtctccgtacgtccctccaccgacggcccagttccggttcccttcccccgcgccctacccctcctacccagcgtacccg

SEQ ID NO: 137991 - DNA, 631 bp, Homo sapiens
  misc_feature: GYAE6OF01B5A15.46.67.G01.1.454.CMB.1.raw
  modified_base (254)..(254): a, c, t, g, unknown or other
  misc_feature (254)..(254): n is a, c, g, or t
  modified_base (412)..(412): a, c, t, g, unknown or other
  misc_feature (412)..(412): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaactattgacactatttaaattgtatcaanatagaccagggacgccctaagctcctaatctatgctgcatcctagtttcgacgtaaaggtcgggtaccccagtcggaggtttccgagtggactaggtggatcgtgggacagtagtttcactctcaaccatcaatatcgtagactaacgtgtaaagttntttagacttaactttattactagtaccaaactagtaaactttactaagtttcgttttaacggaccgtaaagggtacctaaaccggtaaacttaaacgtaaaacgtttaaaccgtaacgttaacggttacgtacctacgtaacccgtacctagttccgttacggtttaccctttactacctttacccgttacccctaccttaacttccgtacgttaaacg

SEQ ID NO: 137992 - DNA, 565 bp, Homo sapiens
  misc_feature: GYAE6OF01EMIBM.46.67.G01.1.454.CMB.1.raw
  modified_base (211)..(211): a, c, t, g, unknown or other
  misc_feature (211)..(211): n is a, c, g, or t
  modified_base (250)..(250): a, c, t, g, unknown or other
  misc_feature (250)..(250): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtncctccatcagtagtggtttctcgtggggctgggtccggnagcctccgagggaagggctggaatacattggaagtgtctctcatagtggaggttcctattacagtccgtctctcaagagtcgagtcacctatatctctggacacgtccagacaatctacgttttccctagaagtatggtagtttctggtcgaccgccgcgtgacgacgggtctttattacgtggtgcgagaggacgtcttattatgttagttttggtagttggtttattcgactacccgtagacgtcggacggggcctccggacccgtgggaccgagggtaactacgcggtccaccgtctccgtcgtcctacccg

SEQ ID NO: 137993 - DNA, 588 bp, Homo sapiens
  misc_feature: GYAE6OF01DZIVS.46.67.G01.1.454.CMB.1.raw
  modified_base (192)..(192): a, c, t, g, unknown or other
  misc_feature (192)..(192): n is a, c, g, or t
  modified_base (227)..(227): a, c, t, g, unknown or other
  misc_feature (227)..(227): n is a, c, g, or t
  modified_base (401)..(401): a, c, t, g, unknown or other
  misc_feature (401)..(401): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccgggcaagtcgaacnttgacactattaatgtatcaacatagacgaggacgccctaagctcctaatctatgctgcatccagtttcgactaaaggttcgggtacccagtcggtaggttcagtggcaggtggatcgtgggacagtatttcactctcacctatacagtaatcgtagactaacgtagtaaagtnttttacgacttaactttatttactgtactaaactaagtaatttaactagtttcgtttacggaccgtaaaggaccgtaacgtaacttaaactaaacgttaacgaacttggttagctacggacctaaccgtattaccttcgttacttacctaacgttcccctttaccccgccttaacttccttgtaacg

SEQ ID NO: 137994 - DNA, 715 bp, Homo sapiens
  misc_feature: GYAE6OF01DG7UO.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtgggagacagtgtccaccatcacttcggccgggacaaggtcggaaactatttacgaacctaaccttaattttaaagttggtaatacaacataagtaccgagggaccgccctaagcctacctaatctatcgctgcatcctagtttgactaaggtcgggtacccagtcgtaggttcaggtgacgagtggtatcgtagggactagtacgtttcacgtcctctaacctattacgaagttaatcgtagtacgtaacggtagtaagttagttttacgaacttaattacttacgtattaaccaaactaattaaattaactaagtttcggttttaccgaaccgtaacgggtacctaaacgtaaaccttaaacgtaaaacgtttaaaccggtacgtaacgggttacggtaacccgtacgtaaccctaaacccgttagttaacccgttcccgtttaactttaaccccgttacccgttttacccccgtttaaccccggtaccccctttaaacgttttacccgtaaggttttaaccccgg

SEQ ID NO: 137995 - DNA, 567 bp, Homo sapiens
  misc_feature: GYAE6OF01DV9PJ.46.67.G01.1.454.CMB.1.raw
  modified_base (328)..(328): a, c, t, g, unknown or other
  misc_feature (328)..(328): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacggccctaagcctcctaatctatgctgcatccagtttgcaaaggtgggtcccatcgaggttnagtggcagtggatcgtgggacaagatttcactctcaccatcagtaatctgcaacgtgaagtattttagactaactttattactagtacaaactaagtaattaactaatttcgttttacggaccgtaaaggggaactaacgtaacttaactaaaacttaaacgaactaggttacggacttagacctaaccctattccttgttccttcaacttcccttaccccgacctacttccttgtaac

SEQ ID NO: 137996 - DNA, 601 bp, Homo sapiens
  misc_feature: GYAE6OF01AIK8J.46.67.G01.1.454.CMB.1.raw
  modified_base (383)..(383): a, c, t, g, unknown or other
  misc_feature (383)..(383): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctcatcagtagtggtttctcgtggggctgggtccggcagctcccgaggggaagggctggaatacattggagtgtctctcatagtggtagttcctattacagtccgtctctcaagtgtcgagtcaccatatctcgtggacacgtccagcaattctacgttttcccagaagtntgtagttcgtgtcgaccgccgcgtacgacgtacgggtcttttagttacgtggtcggacgtagacggacggtacttagtttagttgttagtttttgggagtttggtttactttccgacctacccgttagacgtccgggacggggtcctacccgggtaccccggtggggacccgagggtaactacgtcggtaccgaccgttccttacctcgccctacccg

SEQ ID NO: 137997 - DNA, 688 bp, Homo sapiens
  misc_feature: GYAE6OF01CYF4O.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacgccctaagctcctaatctatgctgcatccagtttcgacgtaaaggtcggggtccccagtccggaggttcaggtggcaggtggtatcgtgggactagtatttcacttctacactatctagtaatcgtgacaacgtagtaagtacttttagactaaacgtttattactagttacaaactaagtaaactttaactaaagtttcggttttaccggaacgtaaacggggtaactaaccggtaaacttaaaccgtaaaactttaaacggtaaaccgttacgggttacgggtaacctaggtaacccgtaacccgttaacgtttacccgtttaccggtttaccttttaaccccgttaaacgtttacccccgtttttaacccccccggtaccctttaaacccgtttcccgttaaaccgggtttaaacccg

SEQ ID NO: 137998 - DNA, 588 bp, Homo sapiens
  misc_feature: GYAE6OF01CR8CZ.46.67.G01.1.454.CMB.1.raw
  modified_base (252)..(252): a, c, t, g, unknown or other
  misc_feature (252)..(252): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtcccctcacctgcgctgtctctggtgcctccatcagtagtggtttcttcgtggggctgggtccggnagcctccgagggaaggggctggaatacattggaagtgtctctcatagtggaggttctattacagtccgtctctcaagagtcgagtcaccatactctctgacacgtcagcaatcagttttcccagatatgtagttactgtgaccgcgtctcgacgacgggtctttattactgtgcgagagacggctattatgtattttaggagttgttatttcgactaccgtagtacgtacggaccggggtcctaccggtacccccgtggggacccgtaacggggtaattaccgggttcgggttacccgacccgttccgttacccgttaggtccccgttaacccccg

SEQ ID NO: 137999 - DNA, 645 bp, Homo sapiens
  misc_feature: GYAE6OF01C637L.46.67.G01.1.454.CMB.1.raw
  modified_base (217)..(217): a, c, t, g, unknown or other
  misc_feature (217)..(217): n is a, c, g, or t
  modified_base (229)..(229): a, c, t, g, unknown or other
  misc_feature (229)..(229): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtgggagacagtgtcaccatcacttgccggnaagtcgacattnacactatttaatgtatcaacatagaccagggacgccctaagctactaatctatgctgcatccgtagtttgacgtaaaggtcggggtacccagttcggaggtttcaggttcggactaggtggtatcgtagggtacaggtactttacacttctacctaacctacgtactaagtaacttcgtagtacgtaacgtagtaagtttaattttacgaacttaaactttattacgttacgttactaaactaacgttaacttaactaagtttacggttttaccggaacggtaacgggtaacctaaaccggtaaacttaaacgttaaaaccgttaaacggtaaacgttagttacggtacgtacgacctactacttacgttcgttccttacttacttcccttacccgacccttacttcgtcgtaacg

SEQ ID NO: 138000 - DNA, 583 bp, Homo sapiens
  misc_feature: GYAE6OF01EVVXG.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagacccctgtccctcacctgcgctgtctctggtgcctccatcagtagtggtttcttcgtggggctgggtccggcagcctcccgaggggaaggggctaggaatacagttgggaagtgtctctcatagtggaggttcctattacagtccgtctctcaagagtcgagtcaccatatctctggacacgtccagcaatctacgttttccccagaagatgagttctgtcgaccgccgctcgacgtacgggtctttattacgtgtgcgagagacgcttattatgttagttttggagtttggtttattcgacctacctagacgtcggacggggctccgacccgtgggaccgagggtaactcgtgtccaccgtctcctacgccctaccacccgacggccctacgtcccgttcccttcccccgcgtccctacccctaccctaccacgcgtacccg

SEQ ID NO: 138001 - DNA, 560 bp, Homo sapiens
  misc_feature: GYAE6OF01CD3QC.46.67.G01.1.454.CMB.1.raw
  modified_base (334)..(334): a, c, t, g, unknown or other
  misc_feature (334)..(334): n is a, c, g, or t
  modified_base (547)..(547): a, c, t, g, unknown or other
  misc_feature (547)..(547): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccgagggaaggggctggaatacattggaagtgtctctcatagtggaggttcctattacagtccgtctctcaagagtcgagtcaccatatctctggacacgtccagcaatcagttttccngaagatgagttctgtgaccgccgctgacacgggtctttattacgtgtgcgagagacggtctattatgtattttggagttggtttatttcgactaccctagagtcggacggggcctcggaccccgtggggccgagggtactacgtcggtcaccgtctccttagccctccaccgacgggcccacgtccgtcccttccccgtcggccaccctcccnccaagcgtacccg

SEQ ID NO: 138002 - DNA, 668 bp, Homo sapiens
  misc_feature: GYAE6OF01DEA94.46.67.G01.1.454.CMB.1.raw
  modified_base (218)..(218): a, c, t, g, unknown or other
  misc_feature (218)..(218): n is a, c, g, or t
  modified_base (229)..(229): a, c, t, g, unknown or other
  misc_feature (229)..(229): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtgggagacagtgtcaccatcacttgccgggnaagtcggaacnttgacaccttatttaaatggtatcaacatagacagggaccgccctaagctcctaatctattctgcatccagtttcgactaaaggtcgggtcccaagtcgtaggttcaggtgcaggtgatcgtgggacagtactttcactctacactatacaagtaactcgagtactaacggtgtaaagttatttttagtaaactttattaactagtactaaaacgtagtaaactttaactaacgttttcgggttttaaccggaccgtaaagggtaaccctaaaccggtaaaccttaaaacgttaaaaacgtttaaaaccgtaacgttacgggttaacgggtccttacggaaccctaacccgttaattcccgttaggtttaccctttacctaccgttaccccgtttaccccgacccttaattacccgttaggtaaacttcccgttaacgg

SEQ ID NO: 138003 - DNA, 565 bp, Homo sapiens
  misc_feature: GYAE6OF01A6LXQ.46.67.G01.1.454.CMB.1.raw
  modified_base (332)..(332): a, c, t, g, unknown or other
  misc_feature (332)..(332): n is a, c, g, or t
  modified_base (452)..(452): a, c, t, g, unknown or other
  misc_feature (452)..(452): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggcccttcggagacccctgtccctcacctgcgctgtctctggtgcctccatcagtagtggtttcttcgtggggctgggtccggcagcctcccgagggaagggctggaatacattggaagtgtctctcatagtggaggttcctattacagtccgtctctcaagngtcgagtcaccatactctctggacacgtccagcaatctagttttcccagaatactgtattctgtcgaccgccgtctgacgtacgggtcgtttattacgtgtgacgagagacgcttaattntgttattttggagttggtttattcgactacctagagtcggccggggtctcccggacccgtgggacccgtagggaacttacgtcgtccgaccgttcctaccttcgccctacccg

SEQ ID NO: 138004 - DNA, 614 bp, Homo sapiens
  misc_feature: GYAE6OF01C9A8G.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatccctccctgtctgcaaccgtgggagacagtgtcaccatcacttgccgggcaagtcggaacattgacacctatttaaattggtatcaacatagaccagggaccggccctaagctcctaatctatgctgcatcctagtttgacaaagtcgggtcccagtcgagttcagtggcaggtgatcgtgggacagtatttcactcacacatcaagtaatctagacgaacgtagtaagtattttacgacttaacttattacttagtactaactaagtaaatttactaagttacggttttaccggaccgtaaacgggaacctaacgtaaccttaaacgtaaaacttaaaccggtaaacgttaggtacggtacctagtacccgtaacctacgttaccttcgttacccgtttactaccgtttcccttacccccggacttacttcccgtaggttaaccc

SEQ ID NO: 138005 - DNA, 566 bp, Homo sapiens
  misc_feature: GYAE6OF01EM446.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcgaacattgactactatttaaattggtatcaacatagaccagggaccgccctaagctacctaatctatgctgcatcctagtttgactaaaggtcgggtcccagtcgaggttcagtggcagtggatcgtgggacagtactttcactctcaccatactagtaatctagactaacgttagtaagtattttgacttaactttattactgtacaaactagtaacttactaagttcgtttacggaccgtaagggactaacgtacttaactaaagttaacgactgtagcctagacctacctattcgtcgttaccttacctacttcccttaccccgacctacttcctgtaacc

SEQ ID NO: 138006 - DNA, 535 bp, Homo sapiens
  misc_feature: GYAE6OF01EBZUY.46.67.G01.1.454.CMB.1.raw
  modified_base (355)..(355): a, c, t, g, unknown or other
  misc_feature (355)..(355): n is a, c, g, or t
  modified_base (378)..(378): a, c, t, g, unknown or other
  misc_feature (378)..(378): n is a, c, g, or t
  modified_base (530)..(530): a, c, t, g, unknown or other
  misc_feature (530)..(530): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggccctaagctcctaatctatgctgcatccagtttgacaaaggtgggtcccatcgaggttcagtggcagtggatcgtgggacaggtntttcactctcaccatcagtaatntgacaacgtgaagtatttgactaactttattactgtacaactagtaatttaactatttcggtttacggacaagggaccaacgtaactaacaaattaacgaacttgacgtctgaccactattcgtgtacttcacttccttcccgactatcgtntaacg

SEQ ID NO: 138007 - DNA, 541 bp, Homo sapiens
  misc_feature: GYAE6OF01EW0J6.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcgaacatgacactattaaattgtatcaacatagaccaggacgccctaagctctatctatgctgcatccagtttgcaaagtgggtcccatcgagttcagtgcagtggatcgtggacagatttcactctcacatcaagtaatctgacaagtgaagtatttgctaattatactgtacacagtaattacattcgtttcgacgaaggacaacgtactaacgtaaattaaaccgtaacgtgtacggtactaggacctaacctaattcgttacgttaccgttctaacgttcccgttaccccgaccctaacgtttcctagttaaaccg

SEQ ID NO: 138008 - DNA, 577 bp, Homo sapiens
  misc_feature: GYAE6OF01EQDBK.46.67.G01.1.454.CMB.1.raw
  modified_base (254)..(254): a, c, t, g, unknown or other
  misc_feature (254)..(254): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggagacagtgtcacatcacttgccggcaagtcggaacattgacaccttatttaaattggtatacaanatagaccagggacgccctaagctcctaatctatgctgcatcctagtttgacgtaaaggtcgggtcccagttcggtaggttcgaggtggacaggtggatcgtgggactagtactttcactctacacctatactagtaatcgtagtacgaacgttagtaagttattttgaaccttaactttattacgtagtaacaacgtaagtaatttactaagttcgtttacggacgtaaggactacgtaactaactaaacttaaacgatggtcgtactagactactattctcgttccttactaccttccttcccgtacctacttcgtgttaac

SEQ ID NO: 138009 - DNA, 768 bp, Homo sapiens
  misc_feature: GYAE6OF01EV2VU.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggcctccgaggtcgccagatgtcgacatcgagctcgacccagtcctccactccctcctgtctcgaccgaaccggtgggacgacgtagtcgtaccacctatctacgttcggccgggacaacggtaccggaactagttacgacctaacctttaaatttaaagttggttactacaaactagtaccgaaccgacggggacccgaccctaacgcctacctaatctatcgctcgactactccgttagttcgacgtaagggtccgggtacctagtcggtacgttacgaggtcggcgtaggtgtactacggtacgggtactagttacttacctaccttcgtacctactactacgtaagttactcgtacgaactaagtacgtaagttactttacgtaacttaactttaacgttacgtacgtaactaaacgtaagttaactttaacgtaacgttttacggtttacccggaaccggtaacggtaaccgtaaacggttaaacccttaaaagtttaaaaccgttaaaacccggtaacgttacgggttaccgttaaccgtaccggttaaccctaaccgttacttaccgttacggtttacccttaaccgttacccttacccggttaccccttacccttaacgttcgtaacgttaaacccg

SEQ ID NO: 138010 - DNA, 727 bp, Homo sapiens
  misc_feature: GYAE6OF01BXDC2.46.67.G01.1.454.CMB.1.raw
  modified_base (254)..(254): a, c, t, g, unknown or other
  misc_feature (254)..(254): n is a, c, g, or t
  modified_base (379)..(379): a, c, t, g, unknown or other
  misc_feature (379)..(379): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggacgaccctgtccctcacctgcgctgtctctggtcgcctccatcagtagtgtttcttcgtgggctgggtccgcagctcccgagggaagggctaggaatacagttggaagtgtctctnagtagtggtacggttcctattacagttccgtctctacaagagtcgagtaccaacctatatctcgtaggacacgtccagacaactctacgttttccagaagtatgtagttctggtacgaccgccgngtcgacgtacgggttctttaactacgtggtcgacgtagacggtacggtacttagtttagttagtttagttttacgggagtttaggtttactttaccgaacctacccgtagacgtaccggggacggggtccctacccgggtaccccggtaggggacccgtaaggggtaacttaccggttcggtacccgtaccggttaccgtacccgttacgaccccgttaacccgaacccgggtaaccggtcccccgttaacggttccccgggtttacccccctttccccccggaccgggtaccccccttacccccgttaccccgttaaccccgaaaacgggtccccgtaacccccggg

SEQ ID NO: 138011 - DNA, 526 bp, Homo sapiens
  misc_feature: GYAE6OF01E3KEL.46.67.G01.1.454.CMB.1.raw
  modified_base (485)..(485): a, c, t, g, unknown or other
  misc_feature (485)..(485): n is a, c, g, or t
  modified_base (502)..(502): a, c, t, g, unknown or other
  misc_feature (502)..(502): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacgccctaagctcctaatctatgctgcatcctagtttgacaaaggtggggtacccatcgaggttcagtggcagtggatcgtgggacagtatttcactctcaccatcagtaatctgacaacgtgaagtattttgactaacttattactgtacaacagtaattactaattcgttttcggaccaagggacaacgtaactaacaaacttaacgaactgtgtcngcaccatctgttccttntactccttcccgactactctgtac

SEQ ID NO: 138012 - DNA, 586 bp, Homo sapiens
  misc_feature: GYAE6OF01BD508.46.67.G01.1.454.CMB.1.raw
  modified_base (229)..(229): a, c, t, g, unknown or other
  misc_feature (229)..(229): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtgggagacagtgtcaccatcacttgccgggcaagtcggaacnttgacacttattaaatgtatcaacatagaccagggacgccctaagctctaatctatgctgcatcctagtttgacgtaaaggtcgggtcccatcggaggttcagtggcagtgatcgtggacagtatttcactctacacctatacgaagttaactctacgactaacgtagaagttatttacgacttaacttattacttacgtactaacgtaagttaatttaactaagttacggttttaccggaaccgtaagggtacctaacgtaactaaacgtaaacttaaacgtaacgtggtacggtacttacgactacctattcgtcttaccttctacttcccttcccgacttacttcgttagtacg

SEQ ID NO: 138013 - DNA, 565 bp, Homo sapiens
  misc_feature: GYAE6OF01CRYBU.46.67.G01.1.454.CMB.1.raw
  modified_base (211)..(211): a, c, t, g, unknown or other
  misc_feature (211)..(211): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtncctcatcagtagtgtttctcgtggggctgggtccgcagctccgagggaaggggctggaatacagttggaagtgtctctcatagtggtagttcctattacagtccgtctctcaagagtcgagtcaccatactctctggacacgtcagcaatctacgtttccagaatatgtattcgtgtacgaccgccgctagaccgtacgggtcgttttatacgtgtgcgtagaggacgtcttaagttagtagttagttttggagttggtttattcgactaccgtagtagtcggacgggtctccggtacccggtgggccgagggtaactcgtcggtacctaccgttctccgtcgtccctacccgg

SEQ ID NO: 138014 - DNA, 578 bp, Homo sapiens
  misc_feature: GYAE6OF01AXJI0.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacgccctaagctctaatctatgctgcatccagtttgcaaagtggggtcccatcgaggttcagtggcagtggatctgggacagatttcactctcaccatcaagtaatctgcaacgtgtaagattttgactaacttattactagtacaaactagaaattactaattgttttacggaccgtaacgggactaacggtaaccttaaacaaaacgtttaaaccgaaacttacggtaggtaccttagaccgtaacccgtattaccttcggttaccttctaactttcccttaccccggtaccaacttccgtgttaaaccg

SEQ ID NO: 138015 - DNA, 548 bp, Homo sapiens
  misc_feature: GYAE6OF01AC5SI.46.67.G01.1.454.CMB.1.raw
  modified_base (192)..(192): a, c, t, g, unknown or other
  misc_feature (192)..(192): n is a, c, g, or t
  modified_base (215)..(215): a, c, t, g, unknown or other
  misc_feature (215)..(215): n is a, c, g, or t
  modified_base (413)..(413): a, c, t, g, unknown or other
  misc_feature (413)..(413): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgcacatcacttgccgggnaagtcgaacattgacacctatttaaatggtatcaacatagaccagggacgccctaagctcctaatctatgctgcatccagttttgacaaaggtcggggtacccagtcgaggtttcagtggcagtggatcgtgggacagtatttcactctcaccatcaagtatctagacaacgtgaagtatttgactaacttattactntacaactagtaattacaagttcgtttacggaccgtaagggacctaacgtaactaactaaattaaacgaacttggagactacgacctacctattacgtcgttacttacacttccttaccccgactacttctgtaac

SEQ ID NO: 138016 - DNA, 576 bp, Homo sapiens
  misc_feature: GYAE6OF01ESQEG.46.67.G01.1.454.CMB.1.raw
  modified_base (291)..(291): a, c, t, g, unknown or other
  misc_feature (291)..(291): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggcagctcccgaggggaaggggctggaatacattggaagtgtctctcatagtggaggttcctattacagtccgtctctcaagngtcgagtcaccatatctctggacacgtccagcaatctagttttcccagaagatgagttctgtcgaccgccgctgacacgggtctttatactgtgacgagacgacgctattatgtattttggagttaggttatttcgactaccctagacgtcggacggggtctccggacccgtgggccagggtatacgtggtaccaccgtctccttacgcctaccgaccgaacggtcccagtcccggttcccttccccccgtggtccccacccttaccctaccgaagcgtaccccg

SEQ ID NO: 138017 - DNA, 572 bp, Homo sapiens
  misc_feature: GYAE6OF01ENRFA.46.67.G01.1.454.CMB.1.raw
  modified_base (322)..(322): a, c, t, g, unknown or other
  misc_feature (322)..(322): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccgagggaaggggctggaatacattggaagtcgtctctcatagtggaggttcctattacagtccgtntctcaagagtcgagtcacatatctctggacacgtcagcaatctacgttttccctagaagatgtagttctgtcgaccgccgctgaccgtacgggtcgtttaattacgtgtgacgtaggacgacggtcttagttagtgttagtttttgggagttggtttattcgactaccgtagtagtacggacggggtcctccggacccgtgggaccgagggaactcgtacggtccaccgttcctccgttcgccctacccg

SEQ ID NO: 138018 - DNA, 661 bp, Homo sapiens
  misc_feature: GYAE6OF01EUWLD.46.67.G01.1.454.CMB.1.raw
  modified_base (192)..(192): a, c, t, g, unknown or other
  misc_feature (192)..(192): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttcggccgggcaagtcggaacattcgactaccttatttaaattggtatcaacatagaccagggacgaccctaagcctcctaatctatgctgcatccagtttcgacgaaaggtcggggtcccagtccggtaggttcaggtggcagtggatcgtgggacaggtatttcactctacacctatcctaagtactcgtagactaacgtgtaaagtattttcgactaactttattacttagtactaaacagttaaactttacgtaaagtttcggttttaccggaaccgtaaacgggtaacctaacggtaacccttaaacgtaaaactttaaaaccggaaaccgttagggttaccggtacttaaccgggaccctaacgttaacgttccctttacggttaccccttttaacacctttccccgtttaccccggtacctaaccgtttccgtacggtttaaaccg

SEQ ID NO: 138019 - DNA, 601 bp, Homo sapiens
  misc_feature: GYAE6OF01CQNNF.46.67.G01.1.454.CMB.1.raw
  modified_base (211)..(211): a, c, t, g, unknown or other
  misc_feature (211)..(211): n is a, c, g, or t
  modified_base (378)..(378): a, c, t, g, unknown or other
  misc_feature (378)..(378): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtncctccatcagtagtggtttctcgtggggctgggtccggcagcctccgaggggaaggggctggaatacagttggaagtgtctctcatagtggaggttcctattacagtccgtctctcaagagtcgagtcaccatatctctggacacgtccagcaatctagttttcccngaagtatgtagttctgtcgaccgccgctgacgcgggtactttattacgtgtgcgagacgacggtctattagtgttagttttggagtttggtttatttacgactacccgtagtacgtccggaccgggggtctaccgggtaccccgtgggggaccctaacggggtaacttaccggtcgggttaccctacccggttccttaccccgttacggccccttaaccccgg

SEQ ID NO: 138020 - DNA, 569 bp, Homo sapiens
  misc_feature: GYAE6OF01BX66Q.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctggggtccggcagcctcccgagggaaggggctggaatacattggaagtgtctctcatagtggaggttcctattacagtccgtctctcaagagtcgagtcaccatatctctggacacgtccagcaatctagttttcccagaagatgtagttctgtcgaccgccgctgacgacgggtcgtttattactgtgcgagagtacgctattagtgttagttttggagtttggttatttcgactaccctagtacgtcgggtaccggggctccggtaccccgtggggaccgagggtaactacgtcggtcctacccgtctccgttacgtccctacccg

SEQ ID NO: 138021 - DNA, 624 bp, Homo sapiens
  misc_feature: GYAE6OF01C8K4F.46.67.G01.1.454.CMB.1.raw
  modified_base (191)..(191): a, c, t, g, unknown or other
  misc_feature (191)..(191): n is a, c, g, or t
  modified_base (307)..(307): a, c, t, g, unknown or other
  misc_feature (307)..(307): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaaccgtggganacagtgtcaccatcacttggccgggacaagtcggaacattcgacaccttatttaaatggtatcaacatagaccagggacgccctaagctctaatctatgctgcatccagtttcganaaggtcgggtccagtcgaggttcagtggctagtgatgtgggactagactttcactctacactatcaagtaatcgtagacgtaacgtgtaagttacttttgaacgttaactttaattacgttacgtaaccgtaaactaaggttaaactttaaccgtaagttttcggttttacgaaccggtaaacgggtactaaccgtaacgttaaactaaaagttaacgaacgttggtacggtacctggacctaaccgtatttcgttacgttaccttttaccgacgtttacccgttaccccgtacctaaacgttccgttagtaaaccg

SEQ ID NO: 138022 - DNA, 558 bp, Homo sapiens
  misc_feature: GYAE6OF01B8RVW.46.67.G01.1.454.CMB.1.raw
  modified_base (379)..(379): a, c, t, g, unknown or other
  misc_feature (379)..(379): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctcgtggggctgggtccggcagcctccgagggaagggctggaatacattggagtgtctctcatgtggaggttctattacagtccgtctctcaagagtcgagtcaccatactctctgacaccgtcagcaatctacgttttccctagaagntgtagttcgtgtcgaccgccgctgacgacgggtcgtttatacgtgtgcgagagacggtactattatgttagttttggagtttggtttattcgactaccgtagtacgtcggacggggtcctaccggacccgtggggaccgagggtactacgtcggtctaccgtctccgttcgcctacccg

SEQ ID NO: 138023 - DNA, 570 bp, Homo sapiens
  misc_feature: GYAE6OF01DE9J2.46.67.G01.1.454.CMB.1.raw
  modified_base (212)..(212): a, c, t, g, unknown or other
  misc_feature (212)..(212): n is a, c, g, or t
  modified_base (330)..(330): a, c, t, g, unknown or other
  misc_feature (330)..(330): n is a, c, g, or t
  modified_base (378)..(378): a, c, t, g, unknown or other
  misc_feature (378)..(378): n is a, c, g, or t
  modified_base (385)..(385): a, c, t, g, unknown or other
  misc_feature (385)..(385): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagacccctgtccctcacctgcgctgtctctggtncctccatcagtagtggtttctcgtggggctgggtccggcagcctccgagggaaggggctggaatacattggaagtgtctctcatagtggaggttcctattacagtccgtctctcaagngtcgagtcaccatatctctggacacgtccagcaatctacgttttcccnggaagtntgtagttctgtcgaccgccgctgacgtacgggtcttttattactgtgcgagagcggtctattagtgtattttgggagttggtttatttcgacctaccgtagtacgtcggaccgggggtctccggaccccggtggggaccgagggaactcgtcggtcctaccggtccttcccgtgtccctaccccg

SEQ ID NO: 138024 - DNA, 526 bp, Homo sapiens
  misc_feature: GYAE6OF01CV0T9.46.67.G01.1.454.CMB.1.raw
  modified_base (191)..(191): a, c, t, g, unknown or other
  misc_feature (191)..(191): n is a, c, g, or t
  modified_base (391)..(391): a, c, t, g, unknown or other
  misc_feature (391)..(391): n is a, c, g, or t
  modified_base (417)..(417): a, c, t, g, unknown or other
  misc_feature (417)..(417): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaaccgtggganacagtgtcaccatcacttgccgggcaagtcggaacattgacacctatttaaatgtatcaacatagaccagggacggaccctaagctacctaatctatgctgcatccagtttgacaaagtggggtcccatcgaggttcagtggcagtggatcgtgggacagatttcactctcactatcagtaatctgacaacgtgaagttntttagactaactttatactgtacaanataattactaattgtttacgacaaggacacgtactaacaaattaacgaacgtgtacggactgacctacctattactgttacttcacttcttacccgactactctgtaac

SEQ ID NO: 138025 - DNA, 599 bp, Homo sapiens
  misc_feature: GYAE6OF01C5QPA.46.67.G01.1.454.CMB.1.raw
  modified_base (314)..(314): a, c, t, g, unknown or other
  misc_feature (314)..(314): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggcagcctcccgaggggaaggggctggaatacattggaagtgtctcgtcattagtggtaggttcctattacagtccgttctctcaagagtcgagtcaccatatctntggacacgtcagcaatctagttttcccagaagtactgtagttctgtcgaccgtccgctgaccgtacgggtcttttaagtacttgtgacgagacgacgtacttattagtagttagttttggagtttgttagtttacgactaccgtagagtcggacggggtcctccggtacccgtcggggtaccgagggtaactacgtggtacaccgtctccgttacgcctccgaccgaacggccctacgtccggtacccttccccgtcgtcccgaccctcctaccaagcgtacccg

SEQ ID NO: 138026 - DNA, 674 bp, Homo sapiens
  misc_feature: GYAE6OF01DENS5.46.67.G01.1.454.CMB.1.raw
tcagactagcagtacacgaccggtgctcgatttagagtatacatattgggtttggggagtctcggtcaggacacagcatggacatgagggtccccgctcagctcctgggggctcctgctactctggctccggaggtgccagatgtgacatcgagctgacccagtctccatccctccctgtctgcaaccggtgggagacagtgtcaccatcacgttggccgggacaagtcggaacattcgacaccttaatttaaattggtatacaacatagacgagggaccggccctaagctacctaatctatgctgcactcctagtttgacgaaaggtcgggacccagtcggaggttcaggtggcagtggatcgtagggacaagtactttacactctacaacctatactaagtaactctagactaacgtgtaaagttatttcgacttaaagtttattaacgtacgttaacaaacgtaagtaaactttaacgtaagttacggttttaccggaaccgtaaacgggaacctaaaccgtaaaccttaaaacgtaaaacgtttaaaaccggtaacgttacgggttacggtacgtaaccggtacctaaccgttaattccggtttacgtttaccctttacgttaacccgtttccccgtttacccccgaccttaccttccgtaagttaaccg

SEQ ID NO: 138027 - DNA, 623 bp, Homo sapiens
  misc_feature: GYAE6OF01CYN2W.46.67.G01.1.454.CMB.1.raw
  modified_base (395)..(395): a, c, t, g, unknown or other
  misc_feature (395)..(395): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaaccgtgggagacagtgtcaccatcacttgccgggcaagtcggaacattgacacctatttaaatggtatcaacatagaccagggacggccctaagctcctatctatgctgcatccagtttgacaagtcgggtcccatcgaggttcagtggcagtgatcgtgggactagatttcactctacaccatcagttaactcgtagactaacgtgaaagttntttagactactttatacttgtacaactagtaaacttaacgtaatttcggttttaccggaccgtaaagggtaacctaacggtaacttaaaccgtaaaacgtttaaaccgaacgttacggtacggtacctacggtaccctaaccgtactttaccgttcggtttaccctttaccgttaacctttaccccgtttacccccggtacccttaaccttccgttacgttaaacccg

SEQ ID NO: 138028 - DNA, 586 bp, Homo sapiens
  misc_feature: GYAE6OF01B4PFD.46.67.G01.1.454.CMB.1.raw
  modified_base (193)..(193): a, c, t, g, unknown or other
  misc_feature (193)..(193): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtggganacagtgtcaccatcacttggccgggcaagtcggaacattgacaccttattaaatggtatcaacatagaccgagggaccgccctaagctcctaatctatgctgcatcctagtttgactaaaggtcgggtacccagtcgaggttcagtggcagtgatcgtggacagtacttcactctacacctatcagttaatctagactaacgtagtaaagtattttacgacttaactttattaactagtaacaactaagtaaacttaacgtaagtttcggtttaccggaaccgtaagggaacctaacgtaactaaactaaacgttaaacgtacgtggtacgacgtacgacctacctatcgtcgttccttactacttacccttcccgacctacttcgtcgtaac

SEQ ID NO: 138029 - DNA, 574 bp, Homo sapiens
  misc_feature: GYAE6OF01DEGYC.46.67.G01.1.454.CMB.1.raw
  modified_base (226)..(226): a, c, t, g, unknown or other
  misc_feature (226)..(226): n is a, c, g, or t
  modified_base (249)..(249): a, c, t, g, unknown or other
  misc_feature (249)..(249): n is a, c, g, or t
  modified_base (348)..(348): a, c, t, g, unknown or other
  misc_feature (348)..(348): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaaccgtgggagacagtgtcaccatcacttgccgggcaagtcgaacnttgacactatttaatgtatcaanatagaccagggacgccctaagctcctaatctatgctgcatccagtttgactaaaggtcggggtcccatcgtaggttcaggtggcaggtgatcgtggganagtatttcgctctacacctatcaagttaactctgactaacgtgaaagttatttagactaactttatactagtacaaacagtaaattactaagtttcggtttacggaccaagggacacggtaactaaacgtaaacttaaacgactggtacggactcgacctaacctattacgttcgttacttacaccgtttcccttaccccgccgttaacttccgtaagttaaaccg

SEQ ID NO: 138030 - DNA, 590 bp, Homo sapiens
  misc_feature: GYAE6OF01AW8R0.46.67.G01.1.454.CMB.1.raw
  modified_base (192)..(192): a, c, t, g, unknown or other
  misc_feature (192)..(192): n is a, c, g, or t
tcagactagcagtacacgaccggtgctcgatttagagtatacatattggggtttggggagtctcggtcaggacacagcatggacatgagggtccccgctcagctcctggggctcctgctactctggctccgaggtgccagatgtgacatcgagctgacccagtctccatcctcctgtctgcaaccgtggganacagtgtcaccatcacttgcggcaagtcgaacattgacacctattaaatggtatcaacatagaccagggaccgaccctaagcctcctaaatctaatgctgcactcctagtttcgactaaaggtcggggtacccagtcgtaggttcaggtcggctaggtgtactcgtgggactaggtattcactctcactatcgaagtactctgactaacgtataacgtattttcgaacttaacttacttaacgtagtaaccaacgtaataacttaactaagttcggtttacgacgtaacggactaacgtaactaataaacgtaaacgtacgtagtacgactagacccgtactacttacttcgttaccttactacttcccgttaccctacctacttacgtacgttaacg

SEQ ID NO: 138031 - DNA, 553 bp, Homo sapiens
  misc_feature: GYAE6OF01B9VOL.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacactatttaaatgtatcaacatagaccagggacggccctaagctcctaatctatgctgcatcctagtttgactaaaggtgggtcccagtcgaggttcagtggcagtggatcgtgggacagtatttcactctcaccatacagtaatctgacaacgtgtaagtatttagactaacttattactagtacaactagtaattaactaattcgtttacggacgtaaggactaacgtaactaaactaaagttaacgaacgttgtacgtctacgactacctattacgttgtaccttactacttccttacccgacctactccgtagtaac

SEQ ID NO: 138032 - DNA, 720 bp, Homo sapiens
  misc_feature: GYAE6OF01ATY91.46.67.G01.1.454.CMB.1.raw
  modified_base (192)..(192): a, c, t, g, unknown or other
  misc_feature (192)..(192): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgcctgatgtgacatcgagctgacccagtctccatcctccctgtctgcaaccgtggganacagtgtcaccatcacttgccgggcaagtcggaacattgacacctatttaaattggtatcaacatagaccagggacgccctaagctacctaatctatgctgcactccagtttgacgtaaaggtcgggtcccagtcgaggttcagtggcaggtggatcgtagggactaggtactttcacttccttaccacctattacgtaagttaacttcgtacgaccgtaaacggttagtaaacgttacgtttttacggaacctttaaaccgttttaacgtttaaccgttacggttaaaccctaaaacgtaaacgtttaaaacttttaaccgtaaacggtttttacgggtttttaacccgggaaacccgtaaacgggggtaacccttaaacccggtaaacctttaaaaccgtaaaacgtttaaaccggtaacgttacgggtacggtaccttaacggaccgtaacccttagttccgttacgttacctttacctaacgtttccccttaccccggaccttaacgttcccgtagttaacccg

SEQ ID NO: 138033 - DNA, 641 bp, Homo sapiens
  misc_feature: GYAE6OF01EANIV.46.67.G01.1.454.CMB.1.raw
  modified_base (198)..(198): a, c, t, g, unknown or other
  misc_feature (198)..(198): n is a, c, g, or t
  modified_base (216)..(216): a, c, t, g, unknown or other
  misc_feature (216)..(216): n is a, c, g, or t
  modified_base (226)..(226): a, c, t, g, unknown or other
  misc_feature (226)..(226): n is a, c, g, or t
  modified_base (249)..(249): a, c, t, g, unknown or other
  misc_feature (249)..(249): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtntcaccatcacttgccggnaagtcgaacnttgacacttattaatgtatcaanatagaccagggaccgccctaagctacctaatctatgctgcatccagtttgactaaaggtcgggtcccagtcgtaggttcagtggcagtggatcgtagggacagtatttcactctcaccatctagtatctagacaacgtagtaagtatttgactaacttattacttagtactaatataattaataattcgttttacggacctaagggaacctaacggtaaccttaaacgtaaaacgtttaaaccgtaacgttacggttacgggtacctacggtaacccgtaacccgttaacgtttacccgtttacgtttacccttttaacccgttaaccgttttacccccgtttaccccccggttaacccctttaaacgtttcccgttaacggtttaaacccg

SEQ ID NO: 138034 - DNA, 517 bp, Homo sapiens
  misc_feature: GYAE6OF01C6ITU.46.67.G01.1.454.CMB.1.raw
  modified_base (192)..(192): a, c, t, g, unknown or other
  misc_feature (192)..(192): n is a, c, g, or t
  modified_base (217)..(217): a, c, t, g, unknown or other
  misc_feature (217)..(217): n is a, c, g, or t
  modified_base (302)..(302): a, c, t, g, unknown or other
  misc_feature (302)..(302): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccgggnaagtcggaacattgacacctatttaaatgtatcaacatagaccagggacggccctaagctcctaatctatgctgcatccagtttncaaagtgggtcccagtcgaggttcagtggcagtgatcgtggacagatttcatctcacatcagtaatctgactacgtagtaagtatttgactaacttatactgtacaactagtaattacaattgtttacgacgtaacggactacgaactaactaaattaacgaactgtacgctagacctactatctcgttactctactcctaccgctactctgtac

SEQ ID NO: 138035 - DNA, 623 bp, Homo sapiens
  misc_feature: GYAE6OF01EH6BR.46.67.G01.1.454.CMB.1.raw
  modified_base (192)..(192): a, c, t, g, unknown or other
  misc_feature (192)..(192): n is a, c, g, or t
  modified_base (432)..(432): a, c, t, g, unknown or other
  misc_feature (432)..(432): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcacatcacttgccgggcaagtcgaacattgacactattaattgtatcaacatagacgaggaccgccctaagctacctaatctatgctgctactcctagtttgactaaaggtcgggtacccagtcgtaggttcgagtggacagtggactcgtagggactagtacttcactctacacctatcaagtaactctagactaacgtgtaagtatttagactaacttattactgtacaanagtaattactagttgtttaccggacgtaaagggtacctaacgtaacttaaacgtaaaacgttaaacgaacgttagggttacggtacgtacggtaaccctaacccgttatttacccgttcggttacccttttaacctaccgtttaccccgtttacccccggtaaccttaaccttaccgttacgtttaaaccg

SEQ ID NO: 138036 - DNA, 524 bp, Homo sapiens
  misc_feature: GYAE6OF01APYK9.46.67.G01.1.454.CMB.1.raw
  modified_base (413)..(413): a, c, t, g, unknown or other
  misc_feature (413)..(413): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggccctaagctcctaatctatgctgcatccagtttgcaaagtgggtcccatcgaggttcagtggcagtgatcgtgggacagatttcactctcaccatcagtaatctgcaacgtgaagtatttgactaactttattactgtacaanagtaattacaattgtttacgacaagggtaccaacgtaactaacaaattaaacgacttagtgactagactactattctgttcttactacttccttacccgactactctgtac

SEQ ID NO: 138037 - DNA, 702 bp, Homo sapiens
  misc_feature: GYAE6OF01CB5KH.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccgcagcctcccgaggggaagggctgggaatacattggaagttgtctctcatagtggaggttcctattacacgtccgtctctcaagagtcgagtcaccatatctctggacacgtcagacaatctacgttttccagaaagattgagttctaggtcgaccgccgctgacgtacggtcgtttattactgtgacgagacgacggtacttattagttgttagtttttaggtagttaggtttactttacggtaactacccgttagacgtcgggtacggggtccgtccggtaccccggtacggggacccgtaaggggtaacgttaaccgttcggttacccgtacccgttacccgttacccgttaaccgtccccgttacccgaaacccggaaacccgggggtacccctaaaccggttccccgggtttcccccgtttaccccccccgttacggtcccccctaaacccccgtttaccccgtacccgtaaaccggaccggtaacccc

SEQ ID NO: 138038 - DNA, 564 bp, Homo sapiens
  misc_feature: GYAE6OF01E522P.46.67.G01.1.454.CMB.1.raw
  modified_base (251)..(251): a, c, t, g, unknown or other
  misc_feature (251)..(251): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtancaacatagaccagggacggccctaagctcctaatctatgctgcatccagtttgcaaagtgggtcccatcgaggttcagtggcagtggatcgtgggactagtatttcactctcacatcagtaatctgcaacgtgtaagtattttagactaactttattactagtacaaactagtaattactaagttcggttttacggaccaaagggtaccaacgaacttaaactaaaagttaaaccgaacgttggtaggtacctacgaccacctattccttgttacctttaccacttcccttaccccgactaacttatgtaaac

SEQ ID NO: 138039 - DNA, 568 bp, Homo sapiens
  misc_feature: GYAE6OF01BJA9Z.46.67.G01.1.454.CMB.1.raw
  modified_base (336)..(336): a, c, t, g, unknown or other
  misc_feature (336)..(336): n is a, c, g, or t
  modified_base (341)..(341): a, c, t, g, unknown or other
  misc_feature (341)..(341): n is a, c, g, or t
  modified_base (532)..(532): a, c, t, g, unknown or other
  misc_feature (532)..(532): n is a, c, g, or t
  modified_base (546)..(546): a, c, t, g, unknown or other
  misc_feature (546)..(546): n is a, c, g, or t
  modified_base (565)..(565): a, c, t, g, unknown or other
  misc_feature (565)..(565): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggcagctcccgagggaggggctggaatacagttggaagtgtctctcatagtggaggttcctattacagtccgtctctcaagagtcgagtcaccatatctctggacacgtccagcaatctagttttccngaagntgagttctgtcgaccgccgtctcgacgccgggtacgtttattacgtgtgacgagaggacggtcttagttattgttagttttgggagtttggtttactttcgacctacccgtagacgtcgggacggggtctccggacccgtggggaccgagggtactacgtgtccaccgtctcctcgcctccacgacggccncgtccgtcctcccnggtccaccctccaccagcnccg

SEQ ID NO: 138040 - DNA, 583 bp, Homo sapiens
  misc_feature: GYAE6OF01BJRTU.46.67.G01.1.454.CMB.1.raw
  modified_base (226)..(226): a, c, t, g, unknown or other
  misc_feature (226)..(226): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccggcaagtcgaacntgacactatttaaatggtatcaacatagacagggacgccctaagctctaatctatgctgcatccgtagtttcgactaaaggtcgggtcccaagtccgaggttcagtggacagtggtatcgtgggactagacttcactctcacatcagtatctgactaacgtgaacgtatttgaactaattagtactagtacaataagtaatactaagttcgtttaccggaactaagggaacctaacgtaaccttaaacgtaaacgttaaacgtaaccgtaggtcggtacttacggacctaacgtattaccgttacgttcctttaaccaacgttcccgttacccgtacctaacgttccgtcgtaaacg

SEQ ID NO: 138041 - DNA, 569 bp, Homo sapiens
  misc_feature: GYAE6OF01B6ZSH.46.67.G01.1.454.CMB.1.raw
  modified_base (288)..(288): a, c, t, g, unknown or other
  misc_feature (288)..(288): n is a, c, g, or t
  modified_base (339)..(339): a, c, t, g, unknown or other
  misc_feature (339)..(339): n is a, c, g, or t
  modified_base (438)..(438): a, c, t, g, unknown or other
  misc_feature (438)..(438): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctcgtggggctgggtccgcagctcccgaggggaagggctggaatacattggaagtgtctctcatagtggaggttcctattacagtccgtctctcaagngtcgagtcaccatatctctggacacgtccagcaatctagttttcccagaanatgagttctgtcgaccgccgctcgactacgggtctttattacgtgtgcgagagacggtctattatgttagttttggagttgttatttcgactacctagntcggacggggtctccggacccgtgggccgaagggactacgtcggtcaccgtctccttacgcctccgaccgaacggtcccagtccggtcccttccccgtcggccctacccctacctaccaacggcgtacccg

SEQ ID NO: 138042 - DNA, 567 bp, Homo sapiens
  misc_feature: GYAE6OF01BC8MF.46.67.G01.1.454.CMB.1.raw
  modified_base (291)..(291): a, c, t, g, unknown or other
  misc_feature (291)..(291): n is a, c, g, or t
  modified_base (337)..(337): a, c, t, g, unknown or other
  misc_feature (337)..(337): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggcagcctcccgaggggaagggctggaatacattggaagtgtctctcatagtggaggttcctattacagtccgtctctcaagngtcgagtcaccatatctctggacacgtccagcaatcagttttcccngaagatgagttctgtgaccgccgctgacgacgggtcgtttaattactgtgcgagagacggctattatgtatttttggagttggtttatttcgaccaccctagatcggacggggctcgacccgtgggccagggatacgtggtccaccgtctccttagccctcccaccgaacgggcccactcccggtcccttccccccgtcggccctaccccttaccctccaagcgtacccg

SEQ ID NO: 138043 - DNA, 734 bp, Homo sapiens
  misc_feature: GYAE6OF01D9289.46.67.G01.1.454.CMB.1.raw
  modified_base (189)..(189): a, c, t, g, unknown or other
  misc_feature (189)..(189): n is a, c, g, or t
  modified_base (197)..(197): a, c, t, g, unknown or other
  misc_feature (197)..(197): n is a, c, g, or t
  modified_base (297)..(297): a, c, t, g, unknown or other
  misc_feature (297)..(297): n is a, c, g, or t
  modified_base (713)..(713): a, c, t, g, unknown or other
  misc_feature (713)..(713): n is a, c, g, or t
tcagactagcagtacacgaccggtgctcgatttagagtatacatattgggtttgggtagtctcggtcaggacacagcatggacatgagggtccccgctcagctcctgggctcctgctactctggctcgagtgccagatgtgacatcgagctgaccagtctccatcccgcctgtctagcaaccgtggganctaaggtntcaccatcacttgccgggcaagtccggaacattggacacgttattaaatcgtatcaacatagacctaaggaccgacctaagactacctaatcctaagtcnctagtacacttcctacgtttacgcgtaaacggttcgggtccccaagttaccgaggttaccgaagttggaaccgtagggtaggtactaccggtaggggtaactaacggttagttttaccaaaccgtttctaaccaacccgtaattacgtaaaccggttaaattccgtaacggtacccttaaaggtataaacggttattttaccgaacgttaaaacgttttaccttaattccggttaaaccaaacgtaaggtttaaatttaaccctaaggtttacgttttaccgggaaccttaaagggaacccttaacggaacctttaaaggaaaaaacccttttaagaacccggttgttacggaaccttagaaacccgtaccctaattcccgttacggttacttaccgaactttccgttaacccccncttaaattccggtaaacctag

SEQ ID NO: 138044 - DNA, 586 bp, Homo sapiens
  misc_feature: GYAE6OF01CRDZJ.46.67.G01.1.454.CMB.1.raw
  modified_base (193)..(193): a, c, t, g, unknown or other
  misc_feature (193)..(193): n is a, c, g, or t
tcagactagcagtacacgaccggtgctcgatttagagtatacatattgggtttgggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttggccgggcaagtcggaacattgacacttatttaaattgtatcaacatagaccagggaccgccctaagcctactaatctatgctgcatcctagtttgacgtaaggtcgggtcccagtcggaggttcagtggctaggtggatcgtgggactagtactttcacttctaccacctactacagttaacttctgactaacgtagtaaagttatttacgacttaactttacttactgtactaactaagtaaactttaactaagtttacgtttacggaccgtaacgggaactaacgtaactaactaaacttaacgaacgtgtacgctacgactacctattcgttcgttccttactacttcccttacccacctactcgtgtaac

SEQ ID NO: 138045 - DNA, 546 bp, Homo sapiens
  misc_feature: GYAE6OF01DN4VI.46.67.G01.1.454.CMB.1.raw
  modified_base (520)..(520): a, c, t, g, unknown or other
  misc_feature (520)..(520): n is a, c, g, or t
  modified_base (540)..(540): a, c, t, g, unknown or other
  misc_feature (540)..(540): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggcagctcccagggaaggggctggaatacattggaagtgtctctcatagtggaggttcctattacagtccgtctctcaagagtcgagtcaccatatctctggacacgtccagcaaatcagttttccctgaagatgagttctgtgaccgcgctgacacgggcgtttattactgtgcgagagacggctattatgtatttttggagttggttatttcgacaccctagatcgacgggggctcgacccctggggcccagggaatactggtcaccgtctcctagcctccaccgaagggcccatccggtcttcccccgnggtcccaccctcctccaagngacccg

SEQ ID NO: 138046 - DNA, 672 bp, Homo sapiens
  misc_feature: GYAE6OF01CAEG5.46.67.G01.1.454.CMB.1.raw
  modified_base (341)..(341): a, c, t, g, unknown or other
  misc_feature (341)..(341): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctcgtggggctgggtccgcagctccgaggggaagggctggaatacgattggaagtgtctctcatagtggaggttcctattacagtccgtctctcaagagtcgagtcacctatactctctggacacgtccagcaatctacgttttccagaanatgagttctggtcgaccgccgctgaccgtacgggtctttatacgtgtcgacgagtagacggtctattatgtagttttggagttggtttacttcgtaaccacccgtagtacgtacggggaccggggtcctacccggaccccggtacggggtacccgtaaggggtaaacgttaccggtcgggtaccctacccggttccgttacccgttaaccggccccttaacccgaacccggtaacccggggtacccctaccggttaccccggttcccccgtttccccccgtacgggtacccctacccccttcccgtaacccgaaacggtcccgtaccccgg

SEQ ID NO: 138047 - DNA, 562 bp, Homo sapiens
  misc_feature: GYAE6OF01ANVD6.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacgccctaagctcctaatctatgctgcatccagtttgcaaagtgggtcccatcgagttcagtggcagtgatctgggacagtatttcactctcaccatcagtatctgactaacgtgaagtatttagactaactttattactgtacaacagtaattaactaagtttggttttaccggaccgtaaacgggactaacgtaacttaaactaaacgttaaacgaacttggtacggtactacgaccacccgtattcctcgttaccttacacgttacccttaccccgacctacttcgtgtaacg

SEQ ID NO: 138048 - DNA, 571 bp, Homo sapiens
  misc_feature: GYAE6OF01DTZ3M.46.67.G01.1.454.CMB.1.raw
  modified_base (338)..(338): a, c, t, g, unknown or other
  misc_feature (338)..(338): n is a, c, g, or t
  modified_base (367)..(367): a, c, t, g, unknown or other
  misc_feature (367)..(367): n is a, c, g, or t
tcagactagcagtacacgaccggtgctcgatttagagtatacatattgggtttgtcctcctgctggtggcagccccccctccagatgggtcctgtccctggtgcaactgcaggagtcgggcccacgactggtgaggccttcggagaccctgtccctcacctgcgctgtctctggtgcctcatcagtagtggtttctcgtggggctgggtccgcagctccgaggggagggctggaatacattggaagtgtctctcatagtggaggttcctattacagtccgtctctcaagagtcgagtcaccatatctctggacacgtccagcaaatctagttttcccngaacgatgagttctgtgaccgcgctgacncgggtcgtttactacgtgtgcgagagacggtctattatgtattttggagttggttatttcgactacccgtagacgtcggacggggctcggacccgtgggccagggtactcgtcgtcaccgtctcctagccctccgaccgaacgggtcccacgtcccggtccttcccccgtcggtccctacccctcctcccgaagtcggtacccg

SEQ ID NO: 138049 - DNA, 592 bp, Homo sapiens
  misc_feature: GYAE6OF01DBTGG.46.67.G01.1.454.CMB.1.raw
  modified_base (218)..(218): a, c, t, g, unknown or other
  misc_feature (218)..(218): n is a, c, g, or t
  modified_base (228)..(228): a, c, t, g, unknown or other
  misc_feature (228)..(228): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaaccggtgggagacagtgtcaccatcacttgccggganaagtcgaacnttgacactatttaatgtatcaacatagaccagggacggccctaagcctcctaatctatgctgcatccctagttttgactaaggtcggggtcccatcgaggtttcagtgcagtggatcgtgggacagtactttcactctcactatacagtaattctcgactaacggtagaacgttattttacgaacttaactttatttacgttgtacaactaagtaacttaactaagtttgtttaccggaccgtaaacgggaacctacgaaccttaaactaaatttaaccgaacttggtacgacgttacgacctaacctatttccttcgttactttcccatttccccttaccccgtacctacttcgtgttaaccg

SEQ ID NO: 138050 - DNA, 674 bp, Homo sapiens
  misc_feature: GYAE6OF01CMO9N.46.67.G01.1.454.CMB.1.raw
  modified_base (234)..(234): a, c, t, g, unknown or other
  misc_feature (234)..(234): n is a, c, g, or t
tcagactagcagtacacgaccggtgctcgatttagagtatacatattgggtttgggggagtctcggtcaggacacagcatggacatgagggtccccgctcagctcctggggctcctgctactctggctccgaggtgccagatggtgacatcgagtctgacccagtctcatcctcctgtctgcgaaccggtgggagacaggtgtcaccagtcacttggccggcgaagtcggaacnttgactacctatttaaatggtatcaacatagaccaggaccgaccctaagctctaatctatgactgcactccagtttggacgtaaagtcgggtacctagtcggagttcagtggactaggtagtagtcgtagggaactaggtactttacactactaccaactagtacgtagttaactcgtacgaccgtaacggtagaaagttacttttacgaaaccttaactttaactaccttaggtaacctaactaaggtaaactttaactaaacgtttacggttttaccggaaccgtaaacgggtacctaacgtaaccgttaaaacgtaaacgttaaaccgtaaacggtaggttacggacttacggtaacctaacccgtagttaccgttaggtaccgttaccgtaaccgtttcccgttaacccgaccctaaacgttcgtaggttaaaccg

SEQ ID NO: 138051 - DNA, 642 bp, Homo sapiens
  misc_feature: GYAE6OF01CPZ8I.46.67.G01.1.454.CMB.1.raw
  modified_base (290)..(290): a, c, t, g, unknown or other
  misc_feature (290)..(290): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctcgtggggctgggtccgcagctccgaggggaagggctggaatacagttggaagtgtctctcataggtggaggttcctatacgagtccgtctctacaagngtcgagtcacatactctcgtgacacgtcagtcaatctacgttttccagaagtatgtagttcgtgtacgacccgcgcgtaggaccgtacgggtctttatacgtgtgacgagagacggtctatagttgttagttttggagttggttactttcgacttacccgtagtagtcggacggggtctacccggaccccgtggggacccgaagggtaacgttacggtacggttaccgaccggttacctccgttaccgccctaccccgaacccggtaaccgggtcccctaacggttcccggtttaccccgttcccccgtcggtacccctaccccgtacccgtaccgaacgtaccgtaccccg

SEQ ID NO: 138052 - DNA, 652 bp, Homo sapiens
  misc_feature: GYAE6OF01CCY6Z.46.67.G01.1.454.CMB.1.raw
  modified_base (194)..(194): a, c, t, g, unknown or other
  misc_feature (194)..(194): n is a, c, g, or t
tcagactagcagtacacgaccggtgctcgatttagagtatacatattgggtttggggaggtctcggtcaggacacagcatggacatgagggtccccgctcagcctcctggggctcctgcgtactctggctccgaggtgccagatgtgacatcgagctcgacccagtcctccatcctccctgtctgcacgtggancagtgtcacatcacttcggccgggactaagtccggaactagttgacctaaccttatttaaagtggttaatacaactataacgaaccaacgggaccgaccctaagctacctaatctatcgctgctactccgtagtttagacgtaacggtcgggtacccagtcggaggttacgaggtggcgtaggtacggtagtcgtagggtaactagtactttcacttctcacctatcaagtactctacgacgtaacgtagaacgtatttagactaacttactacgtagtacctaactaagtaacttaacgtaacgtttacggtttaccggaaccgtaaacgggtaccgtaacgtaacgtaaacgtaaacttaaacggtaacgtaggtacggtacgtacgtaccgtacgtacttacgttcgttaccttaccttaaccttcccttaccccgtacctacttcgtcgtaacc

SEQ ID NO: 138053 - DNA, 521 bp, Homo sapiens
  misc_feature: GYAE6OF01DW163.46.67.G01.1.454.CMB.1.raw
  modified_base (345)..(345): a, c, t, g, unknown or other
  misc_feature (345)..(345): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacggccctaagctcctaatctatgctgcatccagtttgcaaggtgggtcccatcgaggttcagtgcagtggatctggganagatttcactctcaccatacagtaatctgcaacgtagaagtattttgactaactttattactagtacaacagtaattacaattcgtttacgacctaagggacacgtactaacaattaacgaactgtcgactagtcacctatcttgtcttctacttccttaccgacctatctgtaac

SEQ ID NO: 138054 - DNA, 541 bp, Homo sapiens
  misc_feature: GYAE6OF01ERL82.46.67.G01.1.454.CMB.1.raw
  modified_base (488)..(488): a, c, t, g, unknown or other
  misc_feature (488)..(488): n is a, c, g, or t
  modified_base (505)..(505): a, c, t, g, unknown or other
  misc_feature (505)..(505): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtgggagacagtgtcaccatcacttgccgggcaagtcggaacattgacacttatttaaattgtatcaacatagaccagggaccgccctaagctcctaatctatgctgcatcctagtttgacgaaaggtcggggtacccagtcggaggttcgagtggacaggtggatcgtgggacagtatttcactctacacctatactaagttaactcgtacgactaacgtgtaaagtattttcgactaactttattactgtacaactagtaactttacaattcgtttacggacgaaggactacgaactaanaaattaacgatgtacgntgacactatctgtctcattcctaccgctatctgtac

SEQ ID NO: 138055 - DNA, 670 bp, Homo sapiens
  misc_feature: GYAE6OF01BOENP.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatccctccctgtctgcaaccgtgggagacagtgtcaccatcacttgccgggcaagtcggaacattgacaccttatttaaatggtatcaacatagaccgagggaccgccctaagcctcctaatctatgctgcatcctagtttgactaaaggtcgggtcccagtcgtaggttcaggtggcaggtgatcgtggactagtacttcactctcaccatcaagtatctagacgaacgtgaagttatttgacttaacttattactcgtaactaacgtaagtaactttaactaagtttcggtttaccggaacgtaaacggggtacctaaccggtaaacctttaaaccgtaaaacgtttaaaccggaacgttcgggttacggtaccgttaaccgggtacccttaacccgttaacgtttacccggttaccggttttaaccctttaccccgtaacccgttttacccccgtttaccccccgtaaccccttacgtttaccccgttaggttaaaccccg

SEQ ID NO: 138056 - DNA, 620 bp, Homo sapiens
  misc_feature: GYAE6OF01CSFK1.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccggcaagtcgaacattgacacctatttaaattgtatcaacatagacagggacggccctaagctcctatctatgctgcatccagtttgctaaagtcgggtcccatcgaggttcagtggcagtgatctgggacagatttcactctcacatcagtaatctgcaacgtgaaagtattttagactaactttattacttgtacaacagtaaatttaactaagttagttttaccggaccgtaaacgggtactaaccggtaaaccttaaacgtaaaaacgtttaaaccgtaaacgttacggtacggtacctacgtacccgtaacccgtaagtttacccgttcggtttacctttaccgttaactttacccccgttttaacccccggtacccttaacctttaccgttaggttaaaccg

SEQ ID NO: 138057 - DNA, 521 bp, Homo sapiens
  misc_feature: GYAE6OF01CF06N.46.67.G01.1.454.CMB.1.raw
  modified_base (407)..(407): a, c, t, g, unknown or other
  misc_feature (407)..(407): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcgaacattgacacctattaaatggtatcaacatagaccagggacggccctaagctcctaatctatgctgcatccagtttgacaaagtggggtcccagtcgaggttcagtggcagtggatcgtgggacagtatttcactctcaccatcagtaatctagcaagtgaatatttgactaactttatactntacaatagtaattacaattcgttttacgaccaagggacctaacgactaaactaaacttaacgaatgtggactgacacctatctgtacttcacttccttcccgactactcgtgta

SEQ ID NO: 138058 - DNA, 688 bp, Homo sapiens
  misc_feature: GYAE6OF01C7HXY.46.67.G01.1.454.CMB.1.raw
  modified_base (171)..(171): a, c, t, g, unknown or other
  misc_feature (171)..(171): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtncctccatcagtagtggtttctcgtgggctgggtccgcagctcccgaggggaaggggctaggaatacagttggaagtgtctctcagtagtggaggttcctattacagtccgtctctcaagagtcgagtcaccatatctctggacacgtcagacaatctacgttttcccagaagtactgtaagtttctggtcgacccgccggtctcggaccgacggggtcttttaagtacgtggtcggacgaggtaggacggtaccttaagttagttagttaagtttttagggtaggtttaggttttactttaccgtaacccgtaccgtaaggtacgttaccgggacgggggtacctccggaccccggttacggggcccgtaacggggtaactacgtcggttaccctaccggttccttacccggttacgccccgtacccgaacccgtaaccggggccccttaaggtccccggttcccttccccccgtcggtacccctaccccttcccgtacccgaagtaccgtaccccg

SEQ ID NO: 138059 - DNA, 640 bp, Homo sapiens
  misc_feature: GYAE6OF01CQJ0N.46.67.G01.1.454.CMB.1.raw
  modified_base (171)..(171): a, c, t, g, unknown or other
  misc_feature (171)..(171): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtncctcatcagtagtggtttctcgtggggctgggtccggcagcctacccgaagggggaaggggcctaggaaactacagtttgggaagttgttcctctacagtaggtggtaggtttcctaattacagtccgtctctcaaagtagtcgagtcacatatctctggacacgtcagacaatctagtttccagaagatgagttctggtcgaccgcgctacggaccgacggggttctttaatacgtggtacgcgagaggacggtactattagtgttagttttggagttggtttattcgaacctaccgtagacgtcgggacgggtcgtcccggaacccgtggggaccaagggtaactacgttcggtacctacccgttctaccgttacgccctacccaaccggtaaccgggccctaacggttcccggtccctttcccccgaccggtccctaccccttccctaacccgaagtccgtacccg

SEQ ID NO: 138060 - DNA, 500 bp, Homo sapiens
  misc_feature: GYAE6OF01AXH86.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacgccctaagctcctaatctatgctgcatccagtttgcaaagtgggtcccatcgaggttcagtggcagtgatctgggacagattcactctcaccatcagtaatctgcaacgtgaagtattttgactaactttattactgtacaacagtaattacaattgtttcgacctaaggacacgactaacaaattaacgaactgtagctagcacatctgtcttcatctcccacatctgtac

SEQ ID NO: 138061 - DNA, 599 bp, Homo sapiens
  misc_feature: GYAE6OF01ADQI7.46.67.G01.1.454.CMB.1.raw
  modified_base (209)..(209): a, c, t, g, unknown or other
  misc_feature (209)..(209): n is a, c, g, or t
  modified_base (233)..(233): a, c, t, g, unknown or other
  misc_feature (233)..(233): n is a, c, g, or t
  modified_base (299)..(299): a, c, t, g, unknown or other
  misc_feature (299)..(299): n is a, c, g, or t
  modified_base (328)..(328): a, c, t, g, unknown or other
  misc_feature (328)..(328): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagacccctgtccctcacctgcgctgtctctggtgcctccatcagtagtggtttctctggggctgggtccgnagctccagggagggctggaatacnttggaagtgtctctcatagtggaggttcctattacagtccgtctctcaagagtcgagtcaccatanctctggacacgtcagcaatcagttttccngaacgatgagttctgtcgaccgcgctgacacgggtctttatacgtgtggcgagagacggtctattctgtattttgggagttggttatttcgacacccgtagtacgtcggacggggtccttacggaccccgttggggacccaggggtaacttacgtgggtcctaccgtcttaccgtagccccgttaccacccgaacgggtcccctaagtcccgggttcccttcccccgtcgggtaccctaccccttcccgtaccgtaaacggtcgtaccccg

SEQ ID NO: 138062 - DNA, 619 bp, Homo sapiens
  misc_feature: GYAE6OF01AG019.46.67.G01.1.454.CMB.1.raw
  modified_base (346)..(346): a, c, t, g, unknown or other
  misc_feature (346)..(346): n is a, c, g, or t
  modified_base (401)..(401): a, c, t, g, unknown or other
  misc_feature (401)..(401): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggcagcctcccgaggggagggctggaatacgattggaagtgtctcgtcatagtggaggttcctattacagtccgtctctcaagacgtcgagtcaccatatctctggacacgtccagcaatctagttttccctgaagtntgtagttctgtgaccgccgctgacgacgggtcgtttatactgtgcgagagacggntattagtgtattttaggagttgttatttcgacctaccgtagacgtcggacggggtcctacgccccgtggggacccgaggggtaactacgttcggtccgtacccgttcctaccgttacgtcccgtaccgacccgaaccgggtcccctacggttcccgggttccctttaccccccgtcgggtcccctaccccgtacccctaccgaacggtccgtaccccg

SEQ ID NO: 138063 - DNA, 644 bp, Homo sapiens
  misc_feature: GYAE6OF01EEY6V.46.67.G01.1.454.CMB.1.raw
  modified_base (227)..(227): a, c, t, g, unknown or other
  misc_feature (227)..(227): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccggcaagtcggaacnttgacactatttaaatgtatcaacatagaccaggacgccctaagctacctaatctatgctgcatcctagtttgactaaaggtcgggtcccagtcgtaggttcagtggcagtgatcgtggacagtattcactctcaccatcagtaatctagactaacgtagtaaagttattttagacttaaactttattaactagtaacaaactaagtaaatttaacgaagtttcgttttaccggaaccgtaaacggggtaccaacggttaaaccttaaactaaaaacgttaaaccggtaaacgttggttacggtaccgttacgtaaccctaaccgttaatttacccgtttcggttaaccctttaccttaaacccgttttccctttaccccccggaaccctttaacgtttacccgtacgttaaacccg

SEQ ID NO: 138064 - DNA, 614 bp, Homo sapiens
  misc_feature: GYAE6OF01EGSOW.46.67.G01.1.454.CMB.1.raw
  modified_base (192)..(192): a, c, t, g, unknown or other
  misc_feature (192)..(192): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccgggcaagtcggaacattgacaccttatttaaattggtatcaacatagaccagggacgccctaagctacctaatctatgctgctactcctagtttgacgtaaaggttcggggtacccagtcggtaggttcgaggtggcaggtggatcgtgggacagtacttcactctcacctatacagttaactcgtacgacgtaacggtagtaaacgttattttacgacttaaactttattactagtacctaaatagtaatttaactaagtttcggtttaccggaccgtaagggtactaacgtaaactaactaaaacttaaacgaacgttaggtcggtacctaggtacctaaccgtattacgttacgttccttaccacctttcccttacccgaccctattccgtagtaacc

SEQ ID NO: 138065 - DNA, 600 bp, Homo sapiens
  misc_feature: GYAE6OF01AVW1K.46.67.G01.1.454.CMB.1.raw
  modified_base (193)..(193): a, c, t, g, unknown or other
  misc_feature (193)..(193): n is a, c, g, or t
  modified_base (218)..(218): a, c, t, g, unknown or other
  misc_feature (218)..(218): n is a, c, g, or t
  modified_base (226)..(226): a, c, t, g, unknown or other
  misc_feature (226)..(226): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtggganacagtgtcaccatcacttgccgggnaagtcganttgactactatttaaatggtatacaacatagaccagggaccgccctaagctcctaatctatgctgcatccgagtttgactaaaggtcggggtacccagtcgaggttcgagtggctaggtggagtcgtagggactagtactttcactctacactatctaagtatctagactacgtagtaagttatttagactaactttattactgtactaacagtaactttacgtaagtttcgtttaccggaaccgtaagggtacctaacgtaaaccttaaactaaacgtttaaacgacgttggtacggtacctacgtacctaaccgtattcgtacgtttccttacgtaccttacccgttaccccgtactactttcgtacgtaac

SEQ ID NO: 138066 - DNA, 551 bp, Homo sapiens
  misc_feature: GYAE6OF01A6YQX.46.67.G01.1.454.CMB.1.raw
  modified_base (399)..(399): a, c, t, g, unknown or other
  misc_feature (399)..(399): n is a, c, g, or t
  modified_base (435)..(435): a, c, t, g, unknown or other
  misc_feature (435)..(435): n is a, c, g, or t
  modified_base (523)..(523): a, c, t, g, unknown or other
  misc_feature (523)..(523): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctcgtggggctgggtccggcagctcccgagggaaggggctggaatacattggaagtgtctctcatagtggaggttcctattacagtccgtctctcaagagtcgagtcaccatatctctggacacgtccagcaaatcagttttcccagaagatgagtttctgtcgaccgccgctgacgtacgggtcgttttatactggtgcgagagacgntattatgtattttggagttgttattcgacacctagntcggacgggctcgcccgtgggccagggtactacgtgtcaccgtctccttagcctaccgaccgacgggcccagtccggtccttcccccnggccctacccctccctccaagcgacccg

SEQ ID NO: 138067 - DNA, 615 bp, Homo sapiens
  misc_feature: GYAE6OF01AEP28.46.67.G01.1.454.CMB.1.raw
  modified_base (337)..(337): a, c, t, g, unknown or other
  misc_feature (337)..(337): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagacccctgtccctcacctgcgctgtctctggtgcctccatcagtagtggtttcttctggggctgggtccgcagctcccaggggaaggggctggaatacagttggaagtgtctctcatagtggaggttcctattacagtccgtctctcaagagtcgagtcaccatatctctggacacgtccagcaatctagttttcccngaagatgagttctgtcgaccgccgctgacgacgggtcgttttatactgttgcgagagacggctattatgttattttggagttggtttactttcgacctacccgttagacgtcgggacggggtcctccggaccccgtcggggacccgaaggggtaactacgtcggtccaccggtccttcctacgtccctacccgacccgaacgggtccccacgttcccggttccccttccccccgtgggtacccccaccccgttcccgtacccaaacggccgtaccccg

SEQ ID NO: 138068 - DNA, 548 bp, Homo sapiens
  misc_feature: GYAE6OF01DZF8E.46.67.G01.1.454.CMB.1.raw
  modified_base (212)..(212): a, c, t, g, unknown or other
  misc_feature (212)..(212): n is a, c, g, or t
  modified_base (369)..(369): a, c, t, g, unknown or other
  misc_feature (369)..(369): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtcccctcacctgcgctgtctctggtncctcatcagtagtgttctcgtggggctgggtccgcagctcccagggagggctggaatacattggaagtgtctctcatagtggaggttcctattacagtccgtctctcaagagtcgagtcaccatatctctggacacgtccagcaatcagttttcccngaagatgagttctgtcgaccgcgctgacacgggtcgttttatacgtgtcgacgaggtagacggtctaagttatgtatttttggagttggtttatttcgactaccctagactcgggaccggggctccggaccccgtggggccagggaactcgtcggtcaccgttctcccttgcctacccg

SEQ ID NO: 138069 - DNA, 560 bp, Homo sapiens
  misc_feature: GYAE6OF01DNAGR.46.67.G01.1.454.CMB.1.raw
  modified_base (211)..(211): a, c, t, g, unknown or other
  misc_feature (211)..(211): n is a, c, g, or t
  modified_base (233)..(233): a, c, t, g, unknown or other
  misc_feature (233)..(233): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtncctcatcagtagtgtttctcgngggctgggtccgcagcctccgagggaagggctggaatacattggaagtgtctctcatagtggtaggttctattacagtccgtctctcaagagtcgagtcaccatactctctgacacgtcagcaatctacgttttccctagaatatgtagttctgtgaccgcgtctgacgacggtcgtttatactgtgcgagagacgtctattagtgtagttttggagttgttatttcgactaccgtagcgtcggccggggtctaccggtcccggtggggccgtaagggtacgtacgtacggtacctacccgtaccttcccgtacgtccctaacccgg

SEQ ID NO: 138070 - DNA, 600 bp, Homo sapiens
  misc_feature: GYAE6OF01DKEHG.46.67.G01.1.454.CMB.1.raw
  modified_base (333)..(333): a, c, t, g, unknown or other
  misc_feature (333)..(333): n is a, c, g, or t
tcagactagcagtacacgaccggtgctcgatttagagtatacatattgggtttgggtgacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagttggtttcttcgtgggctggggtccggcagcgtcccgagggaaggggctgggaatacattggaagtgtctctcatagtggaggttcctattacagtccgtctctcaagngtcgagtcaccatatctctgacacgtccagcaatctagttttcccagtaagtattgtagtttcgtgttacgacccgtccgcgtacgacgtacgggtacgttttagttaccgttgtgcggagacgacggtcttattagtgttagtttttgggagttggtttatttcgacctaccgtagacgtacggtacggggtccgtcccggtaccccggtggggaccgaagggtaacttaccgttcggtacgacccgttcttaccgtcgtaccccg

SEQ ID NO: 138071 - DNA, 628 bp, Homo sapiens
  misc_feature: GYAE6OF01ANAQB.46.67.G01.1.454.CMB.1.raw
  modified_base (152)..(152): a, c, t, g, unknown or other
  misc_feature (152)..(152): n is a, c, g, or t
  modified_base (192)..(192): a, c, t, g, unknown or other
  misc_feature (192)..(192): n is a, c, g, or t
  modified_base (220)..(220): a, c, t, g, unknown or other
  misc_feature (220)..(220): n is a, c, g, or t
  modified_base (233)..(233): a, c, t, g, unknown or other
  misc_feature (233)..(233): n is a, c, g, or t
  modified_base (467)..(467): a, c, t, g, unknown or other
  misc_feature (467)..(467): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcganctgacccagtctccatcctccctgtctgccaacgtggganacagtgtccaccatcacttcggccgggnaaggtcggaaacnttcgacaccttatttaaacgtgtatacaacatagacctaggaccgccctaagcctccgtaatacctatgtactgctactccgtattttgactaaaaggttcggggtacccagtaccggtaggtttcgaggtggaccgaggtggtatcgttcgggactagtcgttacactcgtacaccgtatcgaagttatctcactaaccgtgtaaagtgtttaagccttaattattaacgttnttacctaaatacggtaatttaactaagtttacgtttacgaaccggtaacggactaacggtactaacgtaataaaccgtaacgtagtacgactagacctaactagttacttcgtactttaccaccgttccttacccggtcttacgttccgttagttaacccg

SEQ ID NO: 138072 - DNA, 558 bp, Homo sapiens
  misc_feature: GYAE6OF01DIUCJ.46.67.G01.1.454.CMB.1.raw
  modified_base (217)..(217): a, c, t, g, unknown or other
  misc_feature (217)..(217): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggnaagtcggaacattgacacctatttaaatggtatcaacatagaccaggacggccctaagctcctaatctatgctgcatccagtttgacaaaggtgggtcccatcgaggttcagtgcagtggatcgtgggacagatttcacttctcaccatcagtaatctgacaacgtagaagtatttagactaactttattactgtacaactaagtaattactaattcgttttaccggacctaaacgggacctaacgaacttaaactaaaacttaaacgaaacttagtaggactgacgtaacctattacttcgttacttctacttcctttaccccgacctaactctgtaacc

SEQ ID NO: 138073 - DNA, 731 bp, Homo sapiens
  misc_feature: GYAE6OF01EKPCG.46.67.G01.1.454.CMB.1.raw
  modified_base (217)..(217): a, c, t, g, unknown or other
  misc_feature (217)..(217): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggnaagtacggcctattgacaccttatttaaaattggtatcaacatacgaccaagggccggaccctaagcctcctaatctatgctgcatacctagttcgacgtaaaggtcggggtccccagttaccggtacggttacgtacggtacggtacggtaggtacggtacgttacggtacgggtaacgtaacgttaacgtttacctaccgttacctaccgtaacctaacgttacgttaacgttaacgttacgttacgtacgtaaacggttaacggtaaacgttaacgtttacgttaaccgtaactttaactttaacttacgtaccgtaacgtaacgttaacttaacgttaacgtttacggtttaccggtaccggtaaacgggtaaaccgtaaccgtaaaccgttaaacgtaaaacgttaaaaccgttaacgtacggttacggtacgtacgtacctaacctaacttacgttacgttacgttaccgttaccgttacccttaccccgtaccctacgttacgtacg

SEQ ID NO: 138074 - DNA, 571 bp, Homo sapiens
  misc_feature: GYAE6OF01BJ5HT.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatgtatcaacatagaccaggacgccctaagctcctaatctatgctgcatccagtttgcaaaggtgggtcccatcgaggttcagtggcagtgatctgggacagtatttcgacttctacacctatcagtaactctgactaacgtagtaaagtatttgactaaacttattactgtactaaacagttaaacttacaagtttcgtttacggaccgtaaagggaccaacggtaacttaaactaaagttaaaccgaactaggtacggtactaggacctaacctaattctagttaccttacgaacttcccttaccccgacctaattccgtgtaacg

SEQ ID NO: 138075 - DNA, 537 bp, Homo sapiens
  misc_feature: GYAE6OF01CNULH.46.67.G01.1.454.CMB.1.raw
  modified_base (287)..(287): a, c, t, g, unknown or other
  misc_feature (287)..(287): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccaggacgccctaagctcctaatctangctgcatccagtttgcaagtgggtcccatcgagttcagtggcagtggatcgtgggacagagttttcactctacacctagtcaagtaacttctagacaacgtagaagtatttgactaacgtttattactagtacaactaagtaattactaattgttttcggacctaagggactacgaactaaactaaagttaacgaactgtgtactcgacacctatctgttacttcgacttccttaccactactctgtaac

SEQ ID NO: 138076 - DNA, 559 bp, Homo sapiens
  misc_feature: GYAE6OF01DEMOW.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacactatttaatgtatcaacatagaccagggacggccctaagctctaatctatgctgcatccagtttgcaaagtgggtcccatcgaggttcagtgcagtgatcgtgggacagatttcacttcgtcaccatcagttaatctagactaacgtagtaagtattttagactaactttatacttagtacaacaagtaattaactaattgttttaccggaccaaagggtacctaacggaacttaaacgtaaacttaacgaacgttggtacggacttagacctaacctattccttagttacttctaacttcccttacccgctactcgttagtaac

SEQ ID NO: 138077 - DNA, 616 bp, Homo sapiens
  misc_feature: GYAE6OF01CKDS5.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatccctccctgtctgcaaccggtgggagacagtgtcaccatcacttggccgggacaagtcggaacatttcgaacctaccttaatttaaagttggtatacaacatagaccagggaccgccctaagctcctaatctatgctgctactcctagtttgacgtaaaggtcgggtacccagttcggtaggttcaggtggcagtggatcgtagggacagtactttcactctacactatactagtaactctagactaacgttagtaattacgttttagactaatttattaacgtagttaccaaagtagtaaatttaacgtaagtttcggtttaaccgaccggtaaaggaccctaaacgttaaacttaaacgtaaaattaaaccgaagttggtacggcttagacctaacctagttccttgttcccttataccttcccttacccgacttatcttagtacc

SEQ ID NO: 138078 - DNA, 577 bp, Homo sapiens
  misc_feature: GYAE6OF01ENOAV.46.67.G01.1.454.CMB.1.raw
  modified_base (376)..(376): a, c, t, g, unknown or other
  misc_feature (376)..(376): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggaccggccctaagctcctaatctatgctgcatcctagtttgactaaaggtgggtccccagtcgtaggttcaggtggcgaggtggatcgtggacagtatttcactctcaactntacagtaatctagactaacgtagtaagtattttagacttaactttattactgtactaacagtaattactaagtttcggtttacggaccgtaagggactaaccggtaacttaaacgtaaattaaacgaacgtggtacgtctacgaccgtacctattccttgttacttcctacttcccttaccccgactaagttcctagtaac

SEQ ID NO: 138079 - DNA, 555 bp, Homo sapiens
  misc_feature: GYAE6OF01DNTHM.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggcctttcggagaccctgtccctcacctgcgctgtctctggtgcctccatcagttagtggtttcttcgtggggctgggtccgcagctccgagggaaggggctgggaatacagtttggaagtgtctctcatagtggaggttcctattacagtccgtctctcaagagtcgagtcaccatatctctggacacgtccagcaatctagtttttcccagaatatgtagttctgtgccgcgctgacgacgggtctttattactgtgcgagagacggcttattatgttagttttggagttgtttatttcgactacctagcgtcgacgggggtctccggcccgttggggaccagggtaactacgtcggtccaccgttctccttcgcccgtacccg

SEQ ID NO: 138080 - DNA, 512 bp, Homo sapiens
  misc_feature: GYAE6OF01CI4YD.46.67.G01.1.454.CMB.1.raw
  modified_base (474)..(474): a, c, t, g, unknown or other
  misc_feature (474)..(474): n is a, c, g, or t
  modified_base (491)..(491): a, c, t, g, unknown or other
  misc_feature (491)..(491): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacactatttaaatggtatcaacatagacagggacgccctaagctctaatctatgctgcatccagtttgcaagtggggtcccagtcgaggttcagtggcagtggatcgtgggacagatttcactctcaccatactagtaatctagcaacgtgtaaagtattttgactaactttattactgtacaacataattactaattgtttcgacgtaagggacacgtaactaacaaattaacgaactgtgntgacacatctcgtcttnacttcttcccactatctgtac

SEQ ID NO: 138081 - DNA, 500 bp, Homo sapiens
  misc_feature: GYAE6OF01AOZVH.46.67.G01.1.454.CMB.1.raw
  modified_base (410)..(410): a, c, t, g, unknown or other
  misc_feature (410)..(410): n is a, c, g, or t
  modified_base (477)..(477): a, c, t, g, unknown or other
  misc_feature (477)..(477): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggccctaagctcctaatctatgctgcatccagtttgcaaagtgggtcccatcgaggttcagtgcagtggatcgtggacagattcactctcaccatcagtatctgacaacgtgaagtatttgactaacttattactgtacaanagaattacaattgtttcgaccaaggacacgactaacaataacgactgtgctgcacctatctgttctnacttccttcccgactatctgtac

SEQ ID NO: 138082 - DNA, 507 bp, Homo sapiens
  misc_feature: GYAE6OF01AYU2E.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggccctaagctcctaatctatgctgcatccagtttgcaaagtgggtcccatcgaggttcagtggcagtggatctgggacagatttcactctcaccatcagtaatctgcaacgtgaagtattttgactaacttattactagtacaacagaattactaattgtttacgacctaaggacacgtaactaactaaattaacgaactgtggctgcacatctgtcttcatcttcccgcatctgtac

SEQ ID NO: 138083 - DNA, 548 bp, Homo sapiens
  misc_feature: GYAE6OF01EXEB2.46.67.G01.1.454.CMB.1.raw
  modified_base (403)..(403): a, c, t, g, unknown or other
  misc_feature (403)..(403): n is a, c, g, or t
  modified_base (530)..(530): a, c, t, g, unknown or other
  misc_feature (530)..(530): n is a, c, g, or t
  modified_base (538)..(538): a, c, t, g, unknown or other
  misc_feature (538)..(538): n is a, c, g, or t
  modified_base (542)..(542): a, c, t, g, unknown or other
  misc_feature (542)..(542): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccgagggaaggggctggaatacattggaagtgtctctcatagtggaggttcctattacagtccgtctctcaagagtcgagtcaccatatctctggacacgtccagcaatcagttttcccagaacgatgagtttctgtgacccgccgcgtgaactacggggtcgtttattacgtgtgacgagagacggntattatgtattttggagttgttatttcgactaccgtagatcggacggggctccggacccgtgggccgagggtatacgtggtcacgtctcgtacgcctccacgacgcgactcgtccctccctccgtcnccctaccnccancgtacc

SEQ ID NO: 138084 - DNA, 595 bp, Homo sapiens
  misc_feature: GYAE6OF01D12Z7.46.67.G01.1.454.CMB.1.raw
  modified_base (171)..(171): a, c, t, g, unknown or other
  misc_feature (171)..(171): n is a, c, g, or t
tcagactagcagtacacgaccggtgctcgatttagagtatacatattgggtttgtcctcctgctggtggcagctcccagatgggtcctgtccctggtgcaactgcaggagtccgggcccagactggtgaggccttcggagaccctgtccctcacctgcgctgtctctggtncctcatcagtagttgtttctcgtggggctgggtccgcagcctccgaggggaagggctaggaatacagttggaagtgtctctcagtagtggtaggttcctattacagtcccgtctctcaagagtcgagtcaccatatctctggacacgtccagcaatctacgttttccccagaacgatgagttctgtcgaccgccgctcgacgtacgggtctttatacgtgtgcgagagacggctaagttatgttattttggagttggtttattcgacctacctagtagtcggacggggtcctcgaccccggtgggaccgagggaactacgtcggtcctaccgtcctaccgtaccgcctacccgaccgaccggccctacggtcccgttacccgttcccccgtcggtccctacccctcctaccgaacgtcgacccg

SEQ ID NO: 138085 - DNA, 614 bp, Homo sapiens
  misc_feature: GYAE6OF01AJUGS.46.67.G01.1.454.CMB.1.raw
  modified_base (331)..(331): a, c, t, g, unknown or other
  misc_feature (331)..(331): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctcatcagtagtggtttctcgtggggctgggtccggcagctcccgagggaagggctggaatacattggaagtgtctctcataggtggtacggttcctattacagttccgtctctcaagngtcgagtcaccatatctctggacacgtccagcatctacgttttccctagaagtatgtagttcgtgtcgaccgccgtcgtcgacgtacgggtcgttttatacgtgtgacgagaggacgtacttagttattgttagttttggagttagtttatttcgacctacccgtagtacgtcgggaccgggggtccgtccggtaccccggtggggtacccggaagggtaacttaccggttcggttacccgtacccggttacccgttcccgttacggtccccgtaacccccgg

SEQ ID NO: 138086 - DNA, 631 bp, Homo sapiens
  misc_feature: GYAE6OF01A6VCK.46.67.G01.1.454.CMB.1.raw
  modified_base (306)..(306): a, c, t, g, unknown or other
  misc_feature (306)..(306): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtggagacagtgtcaccatcacttgccgggcaaggtcggaacattgactaccttatttaaatggtatcaacatagaccaggaccggccctaagctcctaatctatgctgcatccagtttnacgtaaaggtcgggtacccagtcgaggttcaggtggacagtggatcgtgggactagtacttcactctcacctatcaagtatctagactaacgtagtaagtatttcgacttaattacttacgtagtacctaaataagtaaattacgtaagtttcggtttaccggaaccgtaagggaacctaacggtaaaccttaaacgtaaaacgttaaaccgaacgttggtacggtaccttacgaccgtaaccttaagttccgttacgttaccctttacctaacccgttttacccttacccccggtaaccttactttacccgttagttaaacccg

SEQ ID NO: 138087 - DNA, 674 bp, Homo sapiens
  misc_feature: GYAE6OF01AJG19.46.67.G01.1.454.CMB.1.raw
  modified_base (492)..(492): a, c, t, g, unknown or other
  misc_feature (492)..(492): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctcatcagtagtgtttctcgtggggctgggtccggcagctcccgagggaaggggctaggaatacagttggaagtgtctctcataggtggacggttcctattacagtccgtctctacaagtcgtcgagtcacctatactctcgtggacaccgtcagacaattccgtacgtttttcccagtaaacgtattggtacgtttcgtgtacggacccgccgtcgttacggaccgtacgggtacgtttttagtaccgttggttacggacggtagtacggtaccggttnttaacgtttagttagttaggtttttagggaggttttagggtttactttccgaacctacccgttagtacggtccgggtacgggggtccctacccggtaccccgggtgggggacccgtaagggtaaccgtaccgggttggtaccccgaccgttcccttacccgttaccgtccccgtaaccccgg

SEQ ID NO: 138088 - DNA, 640 bp, Homo sapiens
  misc_feature: GYAE6OF01C3U4Z.46.67.G01.1.454.CMB.1.raw
  modified_base (262)..(262): a, c, t, g, unknown or other
  misc_feature (262)..(262): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagttggtttcttcgtggggctgggtccggcagcctcccgaaggggaaggggctaggaatacagttgggaagtgtctctanagtaggtggtaggttcctattacagtccgtctctacaagagtcgagtcaccatatctcgtaggacacgtccagactaatctacgtttttccagaaaggtatgtacgttcgtgtacggacccgcgcttgaacgtacgggttctttatactgtgtacgagagtacggcttagttagtgttagttttggagtttggttacttcgactacccgtagtacgtcgggacggggcctccggacccgtcggggaccgaaggggtaacttacggtcggtacctaccgttccgttacctacgtccctaccgaccgaacggtcccctacgttcccggtcccttccccccgcggtacccctaccccgtacctacccgaaggccgtacccg

SEQ ID NO: 138089 - DNA, 638 bp, Homo sapiens
  misc_feature: GYAE6OF01CS7B5.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtgggagacagtgtcaccatcgacttggccgggcaagtcggaacattgaccaccttatttaaagtggtatcaacatagaccgagggaccgccctaagcctcctaatctatgctgctatccagtttgacaaaggtgggtcccagtcgaggttcagtgcagtggatcgtgggactagtatttcacgttctacacctatactagtaactcgtacgactaacggtacgtaagttacttttacgaacctaactttactaacgttagttacaaactaaggtaactttaacgtaaagttcggttttaccggaaccggtaacgggtaacctaacggtaaccttaaacgtaaaacgttaaacgtaaacgttggtacggtacgtagtacccgaaccgtacttaccgttcgtttacccttacttaaccttcccgttaccccgtaccttacttccgtgtaaacg

SEQ ID NO: 138090 - DNA, 601 bp, Homo sapiens
  misc_feature: GYAE6OF01AQN6Q.46.67.G01.1.454.CMB.1.raw
tcagactagcagtacacgaccggtgctcgatttagagtatacatattgggtttggggagtctcggtcaggacacagcatggacatgagggtccccgctcagctcctgggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggccctaagctcctaatctatgctgcatccagtttgcaaagtgggtcccatcgaggttcagtggcagtggatcgtgggactagtatttcgactctcaccactcagtaatctgacaacgtagaagtagttttagactaactttacttacttagtactaactaagtaaattactaattacgtttttaccgggaccgtaagggtaaaccaaccggtaaactaaacctaaaacgttaaacgtaaacctaggttaggtacctggtaaccctacctaacgttacctgttacctttactaccttacccgtttaccccgcctaacttctaggttaaaccg

SEQ ID NO: 138091 - DNA, 529 bp, Homo sapiens
  misc_feature: GYAE6OF01BIFKC.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacgccctaagctcctaatctatgctgcatccagtttgcaaaggtcgggtcccagtcggaggttcaggtggcagtgatcgtgggacagtatttcactctcaccatcagtaatctgactaacgtgaagtatttgactaactttattactagtacaactagtaattactaagttcgtttcggaccgtaaggactaacgtaactaactaaattaacgaactgtagctgacactatctgtctactacttcctcccgactactctgtac

SEQ ID NO: 138092 - DNA, 503 bp, Homo sapiens
  misc_feature: GYAE6OF01AMTM9.46.67.G01.1.454.CMB.1.raw
  modified_base (464)..(464): a, c, t, g, unknown or other
  misc_feature (464)..(464): n is a, c, g, or t
  modified_base (496)..(496): a, c, t, g, unknown or other
  misc_feature (496)..(496): n is a, c, g, or t
  modified_base (500)..(500): a, c, t, g, unknown or other
  misc_feature (500)..(500): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggccctaagctcctaatctatgctgcatccagtttgcaaaggtgggtcccatcgaggttcagtggcagtggatcgtgggacagatttcactctcacatcagtaatctgcaagtgaagtatttgactaacttattactgtacaataagaattaacaattgtttcgaccgaaggactacgactaacaattaacatagngctgcacatctcgtcttcactcttcccgactntctntac

SEQ ID NO: 138093 - DNA, 564 bp, Homo sapiens
  misc_feature: GYAE6OF01EADGP.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacactattaaatggtatcaacatagaccagggacgccctaagctcctaatctatgctgcatccagtttgcaaagtgggtcccatcgagttcagtggcagtggatcgtgggacagtattcactctcacatcaagtaatctgcaacgtgaaagtattttgactaactttattactgtacaactaagtaacttacaagtttgttttacggacctaagggtaccaacggtaacttaactaaaacgtttaaacgaacgttagtacggtaccttaggacctaaccctaattccttacgtacctttacacttcctttacccgacctacttccgtagtaac

SEQ ID NO: 138094 - DNA, 563 bp, Homo sapiens
  misc_feature: GYAE6OF01C1PNX.46.67.G01.1.454.CMB.1.raw
  modified_base (212)..(212): a, c, t, g, unknown or other
  misc_feature (212)..(212): n is a, c, g, or t
  modified_base (250)..(251): a, c, t, g, unknown or other
  misc_feature (250)..(251): n is a, c, g, or t
  modified_base (371)..(371): a, c, t, g, unknown or other
  misc_feature (371)..(371): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggcctttcggagaccctgtccctcacctgcgctgtctctggtncctccatcagtagtgtttcttctggggctgggtccggnngctccagggagggctggaatacattggaagtgtctctcatagtggaggtttcctattacagtccgtctctcaagagtcgagtcaccatatctctggacacgtcagcaatctagttttccngtaagatgagttctgttcgaccgccgctcgactacgggtcttttagttactggtgcgagagacggtctattatgtatttttgggagttggttatttcgactacctagacgtcggacggggtcctcggaaccccgtgggggaccaggggtaacttacggtcgttaccgaccgttcttccgttagccctacccg

SEQ ID NO: 138095 - DNA, 708 bp, Homo sapiens
  misc_feature: GYAE6OF01E1GRK.46.67.G01.1.454.CMB.1.raw
  modified_base (221)..(221): a, c, t, g, unknown or other
  misc_feature (221)..(221): n is a, c, g, or t
  modified_base (248)..(248): a, c, t, g, unknown or other
  misc_feature (248)..(248): n is a, c, g, or t
  modified_base (276)..(276): a, c, t, g, unknown or other
  misc_feature (276)..(276): n is a, c, g, or t
tcagactagcagtacacgaccggtgctcgatttagagtatacatattgggtttgggggacctcctgtgcaagaacatgaagcacctgtggtttgtcctcctgctggtggcagctcccagatggggtccctcgtccgtggtgaccaacgtgacgaggtacggtcccgggacccacgtacgtgggtggacggtcccgttcgggaccgtaccccgtcgtccccnctaccgtgccgtctcgtctcgtggtcnccctcatctagttgttcggtttctcggnggggtcgtcggggtccgcacgtccgtaccggaaggggaacgggctagggaactactagtaggaagttcgtctctctaataggtgggtacgttccttattaccgtacgttcccgtcttcctactaagttacgtcggtacgtaccaacctatacttctcgtacggaccgtaccgtaccacgactaactcgtttaccgttttcccgaggaacgtgtaggtacgtttctacggtacgaccccgccgtcgtacggaccggtacggttacgttttaacgtacgtggtcgacgaggtacgtacgtacttagttagttcgtttagttttggaggtttagtttacttacgacctaccgtagtcgcgggaccgggtcctcccggacccggtgggaccgagggtactcggttcgtcctaccgttctccgtacgcccgtacccg

SEQ ID NO: 138096 - DNA, 626 bp, Homo sapiens
  misc_feature: GYAE6OF01A4YQ1.46.67.G01.1.454.CMB.1.raw
  modified_base (292)..(292): a, c, t, g, unknown or other
  misc_feature (292)..(292): n is a, c, g, or t
  modified_base (340)..(340): a, c, t, g, unknown or other
  misc_feature (340)..(340): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtcgcctccatcagtagtggtttctcgtggggctgggtccgcagcctcccgaggggaagggctaggaatacgagttggaagtgtctctcatagtggagttcctattacagtccgtctctcaagngtcgagtcaccatatctctggacacgtccagcaatctacgttttcccngaactagtcgagttctgtcgaccgcgctgacgcgggtatttatacgtgtgacgagacgacgcttatagtgtattttgggagtttagttactttacgtactaccgtagcgtacggacggggtcctccgggtaccccgtggggaccgtacgggtactaccgttggtaccgtaccgtccgttaccgttcgtcccgtaccgaaccggtacgggcccctaaggttcccggttacccttccccccggtcggtacccctaccccgttccccaacccgtaacgtcccgtacccg

SEQ ID NO: 138097 - DNA, 576 bp, Homo sapiens
  misc_feature: GYAE6OF01AV677.46.67.G01.1.454.CMB.1.raw
  modified_base (192)..(192): a, c, t, g, unknown or other
  misc_feature (192)..(192): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccgggcaagtcggaacattgacacctatttaaattggtatcaacatagaccagggacgccctaagctacctaatctatgctgcatccagtttgactaaaggtcggggtcccagtcggtaggttcaggtcggacagtggatcgtagggacagtatttcactctcaccatcaagtactctgacaacgtgaagtatttgactaacttatttactgtacaacagtaattataagttgtttacggaacctaagggacctaacggtaaccttaaactaaaacgttaaaccgaacttggtacgtactagaccctaacctattaccgttgttacccttacgtaaccttcccttccccgactacttcctgtaac

SEQ ID NO: 138098 - DNA, 700 bp, Homo sapiens
  misc_feature: GYAE6OF01ASUEP.46.67.G01.1.454.CMB.1.raw
  modified_base (294)..(294): a, c, t, g, unknown or other
  misc_feature (294)..(294): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccgcagctcccgaggggaaggggctgggaatacagttggaagtgtctctcagtagtggtaggttcctattacagtccgtctctcaagngtcgagtcacctatactctcgtaggacaccgtccagacaacttctacgtttttcccagtaacgtatagtacgttccgtcggtcggaacccggtcccgtacgtacggaaccggtacgggtacgttttagttacgtggttacgcggtaagtaggtaccggtacttagttagttaggttaagtttttggtaggtttaggttacgtttcggaaccgtacccgttagacgtacgggtaccggggtaccgtacccggtacccggtacggggaccgtagggtaacgtacgtacgtccgtaccgttccttccgttacgaccctacccgaaccggtaccgggtccctaccggtcccggttcccctacccccgtacggtcccctaccccgtaccctaccgaaccggtcctacccgg

SEQ ID NO: 138099 - DNA, 547 bp, Homo sapiens
  misc_feature: GYAE6OF01D2XK3.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctcgtggggctgggtccgcagctcccgagggaaggggctggaatacattggaagtgtctctcatagtggaggttcctattacagtccgtctctcaagagtcgagtcacatatctctggacacgtcagcaatctacgttttccctagaagatgtagttctgtcgaccgcgcgtgacgtacgggtcgtttatactgtgcgagagacggtctattatgttagttttggagttggtttactttcgactaccgtagagtcggacggggtctccggacccgtggggccagggactagtcggtcacgtctccgtgccctacccg

SEQ ID NO: 138100 - DNA, 749 bp, Homo sapiens
  misc_feature: GYAE6OF01C3C23.46.67.G01.1.454.CMB.1.raw
  modified_base (261)..(261): a, c, t, g, unknown or other
  misc_feature (261)..(261): n is a, c, g, or t
  modified_base (299)..(299): a, c, t, g, unknown or other
  misc_feature (299)..(299): n is a, c, g, or t
  modified_base (318)..(318): a, c, t, g, unknown or other
  misc_feature (318)..(318): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgccctccatcagtagtggttttcttcgtggggctgggtccggcagcctcccgaggggaaggggctaggaatacgagttgggaatgtctctnagtagtggaggttcctattacagtccgttctctcaagngtcgagtcaccatatctcngacacgtccagctaatctacgttttcccagaagtatgtagttctgtcgacccgccgcgttcgacggtacgggtacgttttaacttacgtggtacgacggtaagacggtacggtacttaagttagtagtttagttttttagggagtttaggtttaactttaccggtaacctacccgtaaggacgttccgggaacggggtcccgtacccgggaaccccggttcgggggacccgtaaggggtaaccgtaccggttacgggtaccctacccggttccttacccgttaacccgcccgttaccccgaaacccggtaacccggggtaccccctaaccggtttccccgggtttacccccgtttccccccccggttacgggtacccccttaacccccccgttacccccgtaaccccgaaacgggtccccgtaacccccgg

SEQ ID NO: 138101 - DNA, 605 bp, Homo sapiens
  misc_feature: GYAE6OF01ENAMP.46.67.G01.1.454.CMB.1.raw
  modified_base (211)..(211): a, c, t, g, unknown or other
  misc_feature (211)..(211): n is a, c, g, or t
  modified_base (248)..(248): a, c, t, g, unknown or other
  misc_feature (248)..(248): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtncctccatcagtagtgtttctcgtggggctgggtccgnagcctccgagggagggctggaatacagttggaagtgtctctcagtagtggaggttcctattacagtccgtctctacaagtacgtcgagtcaaccatactctcgtggactacgtcagctaatcgtacgttttcccagaacgtatagtacgttctggtacgaccgtcgtcgtacgacgtacgggttctttacgttcgtggtcgacgagtacggacggtcttaagttagttcgttagttttagggagttggtttacttcgactacccgtaggtcgtacgggcggggtcctaccggtaccccggtgggaccgagggtaacttcggtcggtcctacccgtcttacccgtcgcccgtaacccg

SEQ ID NO: 138102 - DNA, 567 bp, Homo sapiens
  misc_feature: GYAE6OF01A6K1H.46.67.G01.1.454.CMB.1.raw
  modified_base (288)..(288): a, c, t, g, unknown or other
  misc_feature (288)..(288): n is a, c, g, or t
  modified_base (334)..(334): a, c, t, g, unknown or other
  misc_feature (334)..(334): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctctggggctgggtccggcagctcccgagggaaggggctggaatacattggaagtgtctctcatagtggaggttcctattacagtccgtctctcaagngtcgagtcaccatatctctggacacgtccagcaatcagttttcccngaagatgagttctgtgaccgccgctgacacgggtctttatactgtgcgagagacggctattatgtattttgggagttggtttatttcgactacccgtagtacgtcggacggggctccggaccccgtggggccgagggtaactacgtggtccaccgtctccttacgcctccaccgacgggcccacgtccggttccttcccccgtggtcccacccctccctccaacgcgtacccg

SEQ ID NO: 138103 - DNA, 680 bp, Homo sapiens
  misc_feature: GYAE6OF01DLCTP.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactgggtgaggccttcggagaccctgtccctcacctgcgctgtctcgtggtcgcctcatcgagttagttggtttcttcgtggggtctgggtccgcagcctccgagggagggctggaatacagttggaagtgtctctcagttagtggtacggttccttagttacgtagtcccgtctctacaagtagtcgagtcacctatactcgtcgtacggtactacgtcagactaactcgtacgttttcccagaagtagtagtacgttcgtgtcgaccgcgtctacgtaccgacgggttctttagttactggtacgacgagacggtacggtcttagtttacgttggtttaacgtttttgggtaagtttggtttaactttccgaacctacccgttaaggtaccggttaccggggtaccgggggtccttcccgggtaccccgggtcggggtacccggtaaggggtaaccgttaccggttccggttaccgtaccccggtttcccttacccgttccgccccgttaaccccgg

SEQ ID NO: 138104 - DNA, 543 bp, Homo sapiens
  misc_feature: GYAE6OF01DGCT5.46.67.G01.1.454.CMB.1.raw
  modified_base (192)..(192): a, c, t, g, unknown or other
  misc_feature (192)..(192): n is a, c, g, or t
  modified_base (217)..(217): a, c, t, g, unknown or other
  misc_feature (217)..(217): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccgggnaagtcggaacattgacactatttaaatgtatcaacatagaccagggacgccctaagctcctaatctatgctgcatccagtttgcaaaggtcgggtcccatcgagttcagtgcagtggatcgtgggacaggtatttcactctacaccatacaagtatctgacaacgtgaagttattttagactaactttattactgtacaactagtaattactaagttcggtttacgacgtaagggactacgtaactaactaaattaacgaacgttacgtaggtactacgacctaactattctcgttacttcacttccttacccgactactctgtac

SEQ ID NO: 138105 - DNA, 669 bp, Homo sapiens
  misc_feature: GYAE6OF01BEYQ8.46.67.G01.1.454.CMB.1.raw
  modified_base (193)..(193): a, c, t, g, unknown or other
  misc_feature (193)..(193): n is a, c, g, or t
  modified_base (218)..(218): a, c, t, g, unknown or other
  misc_feature (218)..(218): n is a, c, g, or t
  modified_base (229)..(229): a, c, t, g, unknown or other
  misc_feature (229)..(229): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtggganacagtgcaccatcacgttgccgganaaggtcgaacntgacactattaatgtatacaacatagaccgagggaccgcctaagctacctaatctatgctgcatccgtagtttcgacgaaaggtcggggtacccagtcggtaggttccaggtggactaggtggtagtacgtgggaacgtaggtactttacgacttccgtactaacctataccgtaagttaacttccgtaggtaaccgtaacggttaagtaaagttacgtttacgtaacttaaaccgtttattaacgttagttaccaaacgttaagtaacttaacgtacgtttaggttttaccgggaacgtaaacgggtactaacgtaaacttaaacgtaaacgttaaacggaaccgttaggtacggactacgaccgtaacctagttacgttacgttactttaccgtaccttcccgttaaccccgtacttaaccgttacgttgttaaaccg

SEQ ID NO: 138106 - DNA, 951 bp, Homo sapiens
  misc_feature: GYAE6OF01BWRGH.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctcgaggtgccagatgtgacatcgagctgacccagtctccatcctccctgtctgcaaccggtgggagacagtgtcaccatcacttggccgggacaaggtcggaaactagttacgaactaacctttaagttttaaaagttggttaacttacaaactacgttaacgaaccgaaggggacccggtaccctaaaggtaccttacccttaaattccttaagtacggtcttagacctacgttacccgtaaggttttcgaaccgtaaaagggttccggggtacccctaggttaccggtaagggttttccgaagggtttcggggaccgtaacgggttagggaaacgtttccgggaacggggtaaaccgtacgttaacgtttttacccgaaacgtttccgttaacccaacccttaaagttaacccgtaaaggtttaaaccttccgttaacggtaaccgtaaaccgggtttaagttaaaacgggttaacttttttaacgggaaaccttttaaaaccttttacgttttaaaccggtttcggttaaaaccctaaaagttaacgtttaaaaacgttttaacgttaaaaccgtttttaccggggtttttaaaccccgggaaccggttaaaaaccggggtaaacccgttaaaacccggttaaaaccgtttaaaaacccgttaaaaacgttttaaaacccgggtaaaccgtttagggttaacggtaccgttaacgtacccgttaaacccttagttaccggtttacgttacccgtttaaccgttaaacccgtttccccgtttacccccggaaccctttaacgttcccgttaacggttaacccg

SEQ ID NO: 138107 - DNA, 565 bp, Homo sapiens
  misc_feature: GYAE6OF01B3EFU.46.67.G01.1.454.CMB.1.raw
  modified_base (204)..(204): a, c, t, g, unknown or other
  misc_feature (204)..(204): n is a, c, g, or t
  modified_base (207)..(207): a, c, t, g, unknown or other
  misc_feature (207)..(207): n is a, c, g, or t
  modified_base (227)..(227): a, c, t, g, unknown or other
  misc_feature (227)..(227): n is a, c, g, or t
  modified_base (237)..(237): a, c, t, g, unknown or other
  misc_feature (237)..(237): n is a, c, g, or t
  modified_base (262)..(262): a, c, t, g, unknown or other
  misc_feature (262)..(262): n is a, c, g, or t
  modified_base (403)..(403): a, c, t, g, unknown or other
  misc_feature (403)..(403): n is a, c, g, or t
  modified_base (453)..(453): a, c, t, g, unknown or other
  misc_feature (453)..(453): n is a, c, g, or t
  modified_base (470)..(470): a, c, t, g, unknown or other
  misc_feature (470)..(470): n is a, c, g, or t
tcagactagcagtacacgaccggtgctcgatttagagtatacatatttggggttttggggagtctcggtcagggtacacagcattggacatgagggtccccgctcagctcctggggctcctgctactcgtggcctccgaggtgccaggatcgtgaacattcgagctgacccagtctccatcctcctgtactgccaaccgtgganacngtcgcacatcactgccgggnaagtcggacntgactacctattaaatggtatcaanatagaaccagggtaccgccctaagcctactaatctatgcgtcgctactcccaggtttcgaccgtaaaggtcggggtaccctaagttccggaacgtttaccaagtaggactagtggatacgtagggacagtacttcactacncacatacaagtatctagctaagtgtaagtatttagataacttattacgtntactaacagtaattaanattgtttaccggactaaggactacgactaacgtaaactaacgacgtgtagctagtcacgtatcgtcacttcacttctcccgtactctcgtcgtac

SEQ ID NO: 138108 - DNA, 627 bp, Homo sapiens
  misc_feature: GYAE6OF01C99Q5.46.67.G01.1.454.CMB.1.raw
  modified_base (194)..(194): a, c, t, g, unknown or other
  misc_feature (194)..(194): n is a, c, g, or t
  modified_base (218)..(218): a, c, t, g, unknown or other
  misc_feature (218)..(218): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtcctccatcctccctgtctgcaaccggtggganacagtgtcaccatcacttgccggnaagtcggaacattgacactaatttaaatgtatcaacatagacaggacgccctaagctcctaatctatgcttgacatcctagtttgaccgaaaagtcggggtcccattcggaggtttcgagtggacagtggatcgtagggactaagtactttcactctacaacctatccaagtaatctgacaacgtagtaagtaacttttagtactaaacttattaaccgtgttaaccaaactaagtaaatttaactaaacgtttggttttaacccggaaccgttaaacgggaacctaaacgtaaaccgttaaacttaaaacgttaaaacgtaaccgtagttacggacctacgactaaccaagtttcttaggttaccttacgtacttcccgtttaccccgaccctattcctaggttaacc

SEQ ID NO: 138109 - DNA, 596 bp, Homo sapiens
  misc_feature: GYAE6OF01BTHSW.46.67.G01.1.454.CMB.1.raw
  modified_base (192)..(192): a, c, t, g, unknown or other
  misc_feature (192)..(192): n is a, c, g, or t
  modified_base (228)..(228): a, c, t, g, unknown or other
  misc_feature (228)..(228): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccgggcaagtcggaacnttgacacctatttaaatggtatcaacatagaccagggaccggccctaagctcctaatctatgctgcactccagtttgctaaaggtcggggtcccatcgaggttcaggtggcaggtggatcgtgggactagtatttcactctcaccatcagtaatctagcaacgtgtaagtatttcgactaactttattactgtacaaactagtaactttaactaatttggtttaccggaaccaacggggtacctaacggtacctaaactaaacgtttaaaccggaacgttcggtacggtacttacggtaccaaccctattccgttcgttccctttactacctttccccttacccccgtaccctacttcccgttgtaac

SEQ ID NO: 138110 - DNA, 600 bp, Homo sapiens
  misc_feature: GYAE6OF01CBDVZ.46.67.G01.1.454.CMB.1.raw
  modified_base (192)..(192): a, c, t, g, unknown or other
  misc_feature (192)..(192): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccgggcaagtcggaacattgactacctatttaaatgtatcaacatagaccagggacgccctaagctcctaatctatgctgcatccagtttgactaaaggtcggggtacccagtcgaggttcaggtggcagtggatcgtgggacagtattcactctcaccatacagtaatctgcaacgtagaagtatttgactaactttattactagtacaaactagtaaacttaactaatttcggttttaccgaccgtaaacgggaacctaacggaaaccttaaacgtaaaacgttaaaccgtaacgttaggtacggtaccgtacgaccgtacctaacttcgttacgttcctttaccgtacgttaccctttaccccgaccttacttccgttagttaacg

SEQ ID NO: 138111 - DNA, 577 bp, Homo sapiens
  misc_feature: GYAE6OF01CTZ0V.46.67.G01.1.454.CMB.1.raw
  modified_base (230)..(230): a, c, t, g, unknown or other
  misc_feature (230)..(230): n is a, c, g, or t
  modified_base (253)..(253): a, c, t, g, unknown or other
  misc_feature (253)..(253): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtgggagacagtgtcaccatcacttggccgggcaagtcggaacnttgacactatttaatgtatcaanatagaccagggacgccctaagctctaatctatgctgctatccagtttgactaaaggtcggggtcccagtcgaggttcagtggcagtggatcgtgggactagatttcactctacaccatcagttaatctgacaacgtagtaagttattttcgaactaactttattactagtacaactaagtaacttaataatttggttttaccggaccgtaaacgggtaactaacgtaacttaaacgtaaaacttaaccgtaacgtagtcggacgtcgacctacctattcgttgttcttctacgttcccttacccgtaccacttccgtgtaaccg

SEQ ID NO: 138112 - DNA, 736 bp, Homo sapiens
  misc_feature: GYAE6OF01EGRR1.46.67.G01.1.454.CMB.1.raw
  modified_base (195)..(195): a, c, t, g, unknown or other
  misc_feature (195)..(195): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctcgacccagtcctccactcctccctgtctgcaaccggtgganacagtcgtcacatcacgttcggaccggacaaggtcggaactagttacgaacctaactttaatttaaaagttggtaactacgaaactacgtaacgaccggtacgggaacccgtaccctaagccttacctaacttcgttatcgcgtacgtacctacgttaccgtagtttacggaacggtaaacgggttccggggtaccctaaggttccggtaggttacgaacgggtcgtacgtaggtaggtactcggtaggggaactacgttactttcgactcctaaccatactcgtaagtactctaaggacgtaagtagtaacgtttacttacgtaacttaatttacgtacgttacgtaactaaacgtacgtaaactttaacgtaacgttttcgggtaaccgaacgggtaaaaccggtctaaaccgtaaaactttaactaaaaacgtttaaccggacgtttacgggactcccgtaacgacccgttaactcgttaccgtttacgtcccgttaagacccctttcccggtactaaccgtctttcggattaaccgg

SEQ ID NO: 138113 - DNA, 522 bp, Homo sapiens
  misc_feature: GYAE6OF01DHMAP.46.67.G01.1.454.CMB.1.raw
  modified_base (226)..(226): a, c, t, g, unknown or other
  misc_feature (226)..(226): n is a, c, g, or t
  modified_base (352)..(352): a, c, t, g, unknown or other
  misc_feature (352)..(352): n is a, c, g, or t
  modified_base (367)..(367): a, c, t, g, unknown or other
  misc_feature (367)..(367): n is a, c, g, or t
  modified_base (510)..(510): a, c, t, g, unknown or other
  misc_feature (510)..(510): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaaccgtggagacagtgtcaccatcacttgccgggcaagtcggaacnttgacacctatttaaatggtatcaacatagaccaggacggccctaagcctctaatctatgctgcatccagtttgcaaagtgggtcccatcgagttcagtgcagtgatctgggatagatttcactcncacatcagtaactcngactaacgtgaagtattttgactaactttattacttgtacaactagaattacaattggttttaccgaccaagggactacgtaactaactaaacttaacgaactagttagactgaccaactattctgttcttcattcttacccnctaatctgtaac

SEQ ID NO: 138114 - DNA, 561 bp, Homo sapiens
  misc_feature: GYAE6OF01D8FDE.46.67.G01.1.454.CMB.1.raw
  modified_base (211)..(211): a, c, t, g, unknown or other
  misc_feature (211)..(211): n is a, c, g, or t
  modified_base (248)..(248): a, c, t, g, unknown or other
  misc_feature (248)..(248): n is a, c, g, or t
  modified_base (383)..(383): a, c, t, g, unknown or other
  misc_feature (383)..(383): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtncctcatcagtagtggtttctcgtggggctgggtccgnagctccgagggagggctaggaatacagttggaagtgtctctcagtagtggtaggttcctattacagttcccgtctctcaagagtcgagtcacatactctctaggacacgtcagctaatctagtttcccagtaagntgagttctgtcgaccgccgtctacgacgtacgggtcgtttaattcgtgtgacggtagacggacggacttattactgttagttttggagttggtttattcgacctacctagacgtcggacgggctccgacccggtgggaccgagggacttagacgtccacgttcctctcgtccctaccg

SEQ ID NO: 138115 - DNA, 628 bp, Homo sapiens
  misc_feature: GYAE6OF01D6H25.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccaggacggccctaagctctaatctatgctgcatccagtttgactaaaggtcgggtcccagtcggtaggttcagtggcaggtggatcgtgggactagtacttcactctacacatactagtaatctagacaacgtagtaagtattttagacgtaaactttattactagtaccaaagtacgtaaatttaactaagttcggttttacggaaccgtaaagggtaacctacggtaaccttaaacgtaaaacgtttaaacgaacgttaggtacggtacctacgtaccgtaaacccttagttaccgtttagttaccctttaccgtaaccgtttccccgtttacccccgtaacccttacttccgttacgttaaaccg

SEQ ID NO: 138116 - DNA, 520 bp, Homo sapiens
  misc_feature: GYAE6OF01B0LAL.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattgtatcaacatagaccagggacggccctaagctcctaatctatgctgcatccagtttgcaaagtgggtcccatcgagttcagtggcagtggatcgtgggacagatttcactctacacctatacagtaatctagcaacgtgaatattttagactaaactttattacttgtacaacagtaaattacaattgtttacgacctaagggactacgaactaacaaattaaacgaactgtggactagacacctatctgtcttcatcttacccgcatctgtac

SEQ ID NO: 138117 - DNA, 613 bp, Homo sapiens
  misc_feature: GYAE6OF01E3SVF.46.67.G01.1.454.CMB.1.raw
  modified_base (294)..(294): a, c, t, g, unknown or other
  misc_feature (294)..(294): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggcagcctcccgaggggaaggggctaggaatacagttggaagtgtctctcatagtggaggttcctattacagtccgtctctcaagngtcgagtcaccatatctctggaccacgtccagcaatctacgttttcccagaagatgagttctgtcgacccgcgctgacgtacgggtcttttatacgtgtgcgagagtacggcttaattatgttagttttggagttaggttatttcgactacccgtagtacgtccgggacggggtcctaccggaccccgtggggacccgaggggtaacttacgtcgggtacctaccgttctccgttacgccctacccgaaccgacgggcccctacgtcccggtcccttcccccgcggtacccctaccccgtccctaccaagtcgtacccg

SEQ ID NO: 138118 - DNA, 554 bp, Homo sapiens
  misc_feature: GYAE6OF01EU4VH.46.67.G01.1.454.CMB.1.raw
tcagactagcagtacacgaccggtgctcgatttagagtatacatattgggtttgggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacggccctaagctacctaatctatgctgcatcctagtttgacgtaaaggtcggggtcccagtcgtaggttcagtggcagtggatcgtagggactagtattcactctacacatcagtatctgacaacgtgaagtatttgactaacttattactgtacaacataattacaattcgtttacgaccgaagggactaacgtaactaacgtaaacttaaacgaactggtagtactagaccgtacctattcgttcgttccttactacgttacccttacccgactactctagtaac

SEQ ID NO: 138119 - DNA, 509 bp, Homo sapiens
  misc_feature: GYAE6OF01ALLFI.46.67.G01.1.454.CMB.1.raw
  modified_base (424)..(424): a, c, t, g, unknown or other
  misc_feature (424)..(424): n is a, c, g, or t
  modified_base (480)..(480): a, c, t, g, unknown or other
  misc_feature (480)..(480): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacactattaaattgtatcaacatagaccagggacgccctaagctcctaatctatgctgcatccagtttgacaaagtgggtcccagtcgaggttcaggtgcagtggatcgtgggacagatttcactctcacatcaagtatctagacaacgtgaagtatttagactaacttattactagtacaactagtaattanaattgtttcgactaaggactacgaataacaaataacgatgtgctagacactatctntacttcacttcctccgacctatcgtgtac

SEQ ID NO: 138120 - DNA, 623 bp, Homo sapiens
  misc_feature: GYAE6OF01BGEWK.46.67.G01.1.454.CMB.1.raw
  modified_base (289)..(289): a, c, t, g, unknown or other
  misc_feature (289)..(289): n is a, c, g, or t
  modified_base (341)..(341): a, c, t, g, unknown or other
  misc_feature (341)..(341): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctcgtggggctgggtccgcagctcccgagggaaggggctggaatacagttggaagtgtctctcatagtggaggttcctattacagtccgtctctcaagngtcgagtcaccatatctctggacacgtccagcaatctacgttttccagaagntgagttctgtcgaccgcgctgactacgggtctttatactgtgcgagagacggtctattatgttagttttggagttaggttactttcgactacccgtagtacgtcggacggggtcctaccggtaccccgtggggacccgaaggggtaacttaccgtcggttaccaccgttccgttacccgttacgccctacccgaaccggaacgggtcccctaacgttcccgggttccccttccccccgtcggtacccctacccccgtacccgaccctaacggcccgtacccg

SEQ ID NO: 138121 - DNA, 583 bp, Homo sapiens
  misc_feature: GYAE6OF01CDI9V.46.67.G01.1.454.CMB.1.raw
  modified_base (217)..(217): a, c, t, g, unknown or other
  misc_feature (217)..(217): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggnaagtcggaacattgacactatttaaatggtatcaacatagacagggacggccctaagctcctatctatgctgctatcctagtttgactaaaggtcggggtacccagtaccggaggtttcacggttggcgaggtggactcgtagggacagtatttcgactctcaccatacagtaatctagacaagtagaatatttgaacttaacttatttactatacgaactaagtaaacttaataacttcgttttacgaaccgtaacgggaactaacgtaacttaaacgtaaacttaaacgaacttgtagactacgacctaacctatacttcgttccttacgtacttaccttacccgacctactcgtacgtaaccg

SEQ ID NO: 138122 - DNA, 676 bp, Homo sapiens
  misc_feature: GYAE6OF01B7EGZ.46.67.G01.1.454.CMB.1.raw
  modified_base (220)..(220): a, c, t, g, unknown or other
  misc_feature (220)..(220): n is a, c, g, or t
tcagactagcagtacacgaccggtgctcgatttagagtatacatattgggtttggggagtctcggtcaggacacagcatggacatgagggtccccgctcagctcctggggctcctgctactctggctccggaggtgccagatgtgacatcgagctgacccagtctccatcctccctgtctgcaaccggtgggagacagtgtcaccatcacttggccgggnaagtcggaacattgacactatttaaatgtatcaacatagaccagggaccgaccctaagctacctaatcttatcgctgcactccgtagtttgacgtaaaggtcggggtaccccagttcggtaggttacgaggtgggacgtaggtcggtatcggtaggggactaagtactttacgacttaccgtacacctattacgtagttaatccgtaggactaacgtagtaaacggttattttacgaacttaacgtttattacgttagtaactaaacgtaagtttaaactttactaaaggtttcggttttaaccggaacgtaaacggggtaacctaaaccgtaacgttaaaactaaacgttaaaccgtaagttcggtacggtactacggacctaccgtaactttcgttacgttaccctttactacccgttacccgtttaccccacctttacgtccgtagttaaccg

SEQ ID NO: 138123 - DNA, 524 bp, Homo sapiens
  misc_feature: GYAE6OF01CLK2R.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacgccctaagctcctaatctatgctgcatccagtttgcaaagtgggtcccatcgaggttcagtgcagtggatcgtgggacagtatttcactctcaccatcagtaatctgactaacgtgaagtattttgactaactttatactgtacaacagtaatttacaagttgttttacggacctaagggaactaacgtaactaacaaattaacgaactggtagctagaccactatctgtcttcactccttacccgctatctgtac

SEQ ID NO: 138124 - DNA, 518 bp, Homo sapiens
  misc_feature: GYAE6OF01AIL23.46.67.G01.1.454.CMB.1.raw
  modified_base (217)..(217): a, c, t, g, unknown or other
  misc_feature (217)..(217): n is a, c, g, or t
  modified_base (486)..(486): a, c, t, g, unknown or other
  misc_feature (486)..(486): n is a, c, g, or t
  modified_base (514)..(514): a, c, t, g, unknown or other
  misc_feature (514)..(514): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggnaagtcggaacattgacacctatttaaattggtatcaacatagaccagggacgccctaagctcctaatctatgctgcatccagtttgcaaagtggggtcccatcgaggttcagtggcagtgatctgggacagtatttcactctcaccatcagtaatctagcaacgtgaagtattttagtaactttattactgtacaatagtaattacaattgtttacgcgtaagggacacgtactaacaaattaacgaactgtagtctgcaccgattctntcttactacttccttcccgctatctgtntacg

SEQ ID NO: 138125 - DNA, 520 bp, Homo sapiens
  misc_feature: GYAE6OF01C74CJ.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacactatttaaatggtatcaacatagaccagggacgccctaagctcctaatctatgctgcatccagtttgcaaagtgggtcccatcgaggttcagtgcagtggatctgggacagatttcactctcaccatcagtaatctgcaacgtagaagattttagactaacttattactgtacaaacagaaattaactaattgttttacggccaaagggacacgaactaacaaattaaacgaactagtaggctagcaaccatctgttacttcaatcttacccgctaactctgtaac

SEQ ID NO: 138126 - DNA, 835 bp, Homo sapiens
  misc_feature: GYAE6OF01B1ZT1.46.67.G01.1.454.CMB.1.raw
  modified_base (242)..(242): a, c, t, g, unknown or other
  misc_feature (242)..(242): n is a, c, g, or t
tcagactagcagtacacgaccggtgctcgatttagagtatacatattgggggtttgggggacctcctcgtgcaagaacgattgaaggctaccctgtgggtttgtcctcctgctggtggcagctcccagatcgggtcctggtcccttgggtgcaactgcgtaggtagttccgggccctacgtactagggtgacggcctttcgggagacccgtgtccctcacctggcgctgtcgtcgtgggtcncctccatcgaggttaggttcgtttctcgtggggtctcgggtccggcacgtccgtcccgagggggtaacggggtctacgggtaactacgtaggttagggaagttgttctcgtcgtagtacgggtacgggtacggttacctacgtttaaccggacggttccggtctcggtacgtaaggtgtcgtagttacctaacttatacttcgttacgtacggaactaccgtaccagacctaacgttccgttacggttttccagggtaaacttacgtacggtacgttcgttcggtaccgtaccggccgtactacggtaaccggtacgggttacgtttacgtttacgttcggttacgacgtaagtacggtaacggtcttaaggtttacgttggtttaacggtttttagggtaacggttttacgggttttacggtttacccgtaaccgttaacccgttagggtacggtaccggggtaaccgggggttcccttaacccgggtaccccggttacggggacccgggtaaaggggtaccgttaccgggttaccgggtaacccttacccggtttacccgtccggtttaacccggtcccggtaaaccccgg

SEQ ID NO: 138127 - DNA, 638 bp, Homo sapiens
  misc_feature: GYAE6OF01DSG1I.46.67.G01.1.454.CMB.1.raw
  modified_base (192)..(192): a, c, t, g, unknown or other
  misc_feature (192)..(192): n is a, c, g, or t
  modified_base (217)..(217): a, c, t, g, unknown or other
  misc_feature (217)..(217): n is a, c, g, or t
  modified_base (254)..(254): a, c, t, g, unknown or other
  misc_feature (254)..(254): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaaccggtggganacagtgtcaccatcacttggccggnaagtcggaacattgacacttatttaaatgtatacaanatagaccgagggaccgccctaagcctacctaatctatgctgctatcctagtttacgacgtaaaggtcgggtaccctagtacggtaggttcgaggtggcgtagtggtatcgtgggaactaggtactttcacttctacgacctatacgaagtaacttcgtacgacctaacggtagtaaagttatttacgtacttaactttacgttaacttacgtaactaacgtaagtaactttaactaagtttcggttttaccggaaccggtaacgggtaacctaacgtaacttaaactaaacgttaaacgtaacgttacgtacggtactacgtacgtacctaattccttcgttacgttacctacgttacccttacccgacttactcgtagttaac

SEQ ID NO: 138128 - DNA, 581 bp, Homo sapiens
  misc_feature: GYAE6OF01BWB95.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctattaaatggtatcaacatagaccaggacgccctaagctcctaatctatgctgcatccagtttgcaaagtgggtcccatcgaggttcagtggcagtgatcgtgggacagtatttcactctcacatcagtaatctagacaacgtgtaagtatttgactaactttattactagtacaactagtaacttactaattcggttttacgaccgtaaagggtacctaaccgtaaaccttaaactaaaagttaaaccggtaacgttaggttacggtactacggtacctaacccgtattaccgttcgttacctttacctaacgttcccttacccggaccctattcctagtaacc

SEQ ID NO: 138129 - DNA, 545 bp, Homo sapiens
  misc_feature: GYAE6OF01DMR4Z.46.67.G01.1.454.CMB.1.raw
  modified_base (510)..(510): a, c, t, g, unknown or other
  misc_feature (510)..(510): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcgaacattgacacctatttaatgtatcaacatagaccagggacggccctaagcctcctaatctatgctgcatccagtttgcaagtcgggtcccatcgaggttcagtggcagtggatcgtgggactagatttcactctcacatcagtaatctagcaacgtgaagttatttagactaacttattactgtacaacgagtaactttactaatttcgttttaccggaccgtaagggtaccacgtaaacttaactaaaagttaaccgtaactagtaggtactcgaccacgtactnttacgttcttcacttccttacccgctatctgtaac

SEQ ID NO: 138130 - DNA, 576 bp, Homo sapiens
  misc_feature: GYAE6OF01CKLHS.46.67.G01.1.454.CMB.1.raw
tcagactagcagtacacgaccggtgctcgatttagagtatacatattggggtttgggggagtctcggtcaggacacagcatggacatgagggtccccgctcagctcctggggctcctgctactctggctcgaggtgccagatgtgacatcgagctgacccagtctccatcctccctgtctgcaaccggtgggagacagtgtcaccatcacttgccgggcaagtcggaacattgacacctatttaaattggtatcaacatagaccagggacggccctaagctctaatctatgctgcatccagtttgactaaggtcggggtcccagtcgaggttcagttggcaggtggatcgtgggacagtatttcactctcactatctataatctgctaacgtgaagtatttgactaacttattactagtacaaactaaggtaacttaactaagttggttttaccggaaccgaacggggaacctaacgaacttaaacctaaaagtttaaacgaacgttagtacggcttacgacctacctattccgtgttaccttcaacttcccttaccccgactacttcgtgtaacg

SEQ ID NO: 138131 - DNA, 548 bp, Homo sapiens
  misc_feature: GYAE6OF01CFLQ5.46.67.G01.1.454.CMB.1.raw
  modified_base (335)..(335): a, c, t, g, unknown or other
  misc_feature (335)..(335): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactgggtgaggccttcggagagcctgtccctcacctgcgctgtctctggtgcctccatcagtagtggtttcttctggggctgggtccggcagctcccgagggaggggctggaatacattggaagtgtctctcatagtggaggttcctattacagtccgtctctcaagagtcgagtcaccatatctctggacacgtccagcaatcagttttcccngaagatgagttctgtcgaccgccgctgacacgggtcgtttatactgtgcgagagacggctattatgtagtttttggagttggttatttcgactaccctagatcggacggggctccgacccgtggggaccagggaatacgtcgtcaccgtctcctcgcctccacgacggcccactccggtccttcccccgtcgccaccctccctcctaagaccg

SEQ ID NO: 138132 - DNA, 564 bp, Homo sapiens
  misc_feature: GYAE6OF01CLPIL.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgacaaccggtgggagacagtgtacaccatcacgttggccgggacaaggtaccggaacattgaacctaaccttaattttaaattggtatcaaacatagaaccgagggaccggaccctaagctacctaatctatgctgcatccagtttgacaaagtgggtcccagtcgaggttcagtgcgagtggatcgtgggacagtatttcactctcacatcagtatctgacaagtgtaagtatttgactaattatactgtacactaagtaattacaagttcgtttacgaccgtaacgggactaacgaactaactaaagttaacgaacttggtagacttagaccgtacattactcgttacttactacttcccgttacccacctactcgttgtaac

SEQ ID NO: 138133 - DNA, 585 bp, Homo sapiens
  misc_feature: GYAE6OF01CDQEE.46.67.G01.1.454.CMB.1.raw
  modified_base (193)..(193): a, c, t, g, unknown or other
  misc_feature (193)..(193): n is a, c, g, or t
  modified_base (374)..(374): a, c, t, g, unknown or other
  misc_feature (374)..(374): n is a, c, g, or t
  modified_base (522)..(522): a, c, t, g, unknown or other
  misc_feature (522)..(522): n is a, c, g, or t
  modified_base (560)..(560): a, c, t, g, unknown or other
  misc_feature (560)..(560): n is a, c, g, or t
tcagactagcagtacacgaccggtgctcgatttagagtatacatattgggtttggggagtctcggtcaggacacagcatggacatgagggtccccgctcagctcctggggctcctgctactctggctccggaggtgccagatgtgacatcgagctgacccagtctccatcctcctgtctgcaaccggtggganacagtgtcaccatcacgttggccgggacaaggtcggaaactatttcgaacctaaccttattttaaaagtggtatacaaacatagaccgagggaccggaccctaagcctcctaatctatgctgcatcctagtttgacgaaaggtcgggtacccagtcggagttcgaggtggcagtggatcgnggactagatttcactctcacatgtaataatctagacgtaacgtgaagttatttagaactaactttataactagtacaaacgtaagtaaattaactagtttcggtttacggaaccgtaagggaactaacgaacttaaataaacgttaanacgtagtacgactagacctactattactcgttacttanacttcctacccgctactctgtaacg

SEQ ID NO: 138134 - DNA, 621 bp, Homo sapiens
  misc_feature: GYAE6OF01COA1I.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatgtatcaacatagaccagggaccgaccctaagctcctaatctatgctgcatccagtttgacaaaggtcgggtcccagtcgaggttcagtggcagtgatcgtgggactagtatttcactctacacctatacaagttaactctagactaacgtagtaagttattttagacttaactttattacttgtacaactaagtaaattaactaagtttcgttttaccggaaccgtaaagggacctaacgtaaccttaaactaaaacgttaaacgtaaacgttggtacgtacctacggacctaacccgtatttacccttggtttaccctttaccgttaacctttcccgtttacccccgtaccttaaccttccgttacgttaaaccg

SEQ ID NO: 138135 - DNA, 582 bp, Homo sapiens
  misc_feature: GYAE6OF01CKIKB.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggcagctcccgaggggaagggctggaatacattggaagtgtctctcatagtggaggttcctattacagtccgtctctcaagagtcgagtcaccatatctctggacacgtccagcaatctagttttcccagaacgtatgagttctgtcgacccgcgctgacgacgggtcgtttattacgtgtgcgagagacggctattatgtagttttggagttggttatttcgactacccgtagacgtcggacgggctccggacccgtggggaccgagggtactacgtcggtcaccgtctccgttacgccctcccaaccgacggcccacgttcccggttcccttcccccgtggtccccacccctccctcccgaacgcgtacccg

SEQ ID NO: 138136 - DNA, 500 bp, Homo sapiens
  misc_feature: GYAE6OF01ALLPX.46.67.G01.1.454.CMB.1.raw
  modified_base (354)..(354): a, c, t, g, unknown or other
  misc_feature (354)..(354): n is a, c, g, or t
  modified_base (467)..(467): a, c, t, g, unknown or other
  misc_feature (467)..(467): n is a, c, g, or t
  modified_base (475)..(475): a, c, t, g, unknown or other
  misc_feature (475)..(475): n is a, c, g, or t
  modified_base (479)..(479): a, c, t, g, unknown or other
  misc_feature (479)..(479): n is a, c, g, or t
  modified_base (483)..(483): a, c, t, g, unknown or other
  misc_feature (483)..(483): n is a, c, g, or t
  modified_base (493)..(493): a, c, t, g, unknown or other
  misc_feature (493)..(493): n is a, c, g, or t
  modified_base (497)..(497): a, c, t, g, unknown or other
  misc_feature (497)..(497): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggccctaagctcctaatctatgctgcatccagtttgcaaagtggggtcccatcgaggttcaggtggcagtggatcgtgggacagtntttcactctcaccatcagtatctgcaacgtgaagtattttgctaactttattactgtacaacagtaattacaattgtttcgactaaggactacgactaacaaattaacgatgngctgcacntctntctnctctcccgantctntac

SEQ ID NO: 138137 - DNA, 693 bp, Homo sapiens
  misc_feature: GYAE6OF01AZB6F.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgcccagtctccatcctccctgtctgcaaccgtgggacacagtgtcaccatcacttgccggcaagtcggaacattgacactatttaaatgtatcaacatacgacgagggacgaccctaagctacctaatctatgctgcatcctagtttgactaaaggtcgggtacccagtacgaggtttcaggtggacgagtggtatcgtgggaacagtagtttcactcgtaccaccgatcgaatatcgtagacaacgtacgtaaagtagttttacgaccttaaacgtttacttacttacggtaactaaacgtaacttaaactttaacgtaacgtttcggttttaacccgggaaccgtaaacgggggtaaaccctaaacggttaaacctttaaaaccgtaaaaacgtttaaaaacccggtaacgtttaccggttaaggtaccccgtttagaacccggtaaacctacgtttaccggtttacttacccgtttaccttaacccttacccggtttccccccgtaaccttaacgttacccgtttagttaaacccg

SEQ ID NO: 138138 - DNA, 662 bp, Homo sapiens
  misc_feature: GYAE6OF01ESZL6.46.67.G01.1.454.CMB.1.raw
  modified_base (172)..(172): a, c, t, g, unknown or other
  misc_feature (172)..(172): n is a, c, g, or t
  modified_base (293)..(293): a, c, t, g, unknown or other
  misc_feature (293)..(293): n is a, c, g, or t
tcagactagcagtacacgaccggtgctcgatttagagtatacatattgggtttgtcctcctgctggtggcagctcccagatgggtcctgtccctggtgcaactgcaggagtccgggcccacgactggtgaggccttcggagaccctgtccctcacctgcgctgtctctggtncctccatcagtagtggtttctcgtgggctgggtccgcagctcccgaggggaagggctaggaatacagttggaagtgtctcgtcagtaggtggaggttcctattacagtccgtctctcaagngtcgagtcaccatatctctggacacgtccagcaatctacgttttcccagaacgatgtagttctgtcgaccgccgtctcgacgtacgggttctttattacgtgtcgacgtagacgtacggtcttaagtttatgttagttttggagtttagtttagtttcgaacctacccgtagtacgtcggaccggggtctaccggacccggtggggaccgaaggggtaacttacggttcggtacccacccggttcttacccgttaccgtccctacccgaaccggtaaccgggtcccctaacggttccccggttccccttccccccggtggtaccccctacccccgttacccgtaacccgtaaacggcccgtaaccccgg

SEQ ID NO: 138139 - DNA, 562 bp, Homo sapiens
  misc_feature: GYAE6OF01B2R8P.46.67.G01.1.454.CMB.1.raw
  modified_base (392)..(392): a, c, t, g, unknown or other
  misc_feature (392)..(392): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccgcagctcccagggagggctggaatacattggaagtgtctctcatagtggaggttcctattacagtccgtctctcaagagtcgagtcaccatatctctggacacgtccagcaatctagttttcccagaagatgagttctggtcgaccgccgctgacgacgggtctttatactgtgcgagagacggntattatgtattttggagttggtttattcgacacctagagtcggacggggtctacggcccgtgggccgagggactacgtcggtcaccgtcctccgtacgccctccaccgacgggcccacgtccggtcccttccccgcggtacccacccctccctacccgaagccgtacccg

SEQ ID NO: 138140 - DNA, 591 bp, Homo sapiens
  misc_feature: GYAE6OF01D4EYB.46.67.G01.1.454.CMB.1.raw
  modified_base (251)..(251): a, c, t, g, unknown or other
  misc_feature (251)..(251): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacactattaatggtatcaanatagaccagggacggccctaagctcctaatctatgctgcatccagtttgactaaaggtcgggtcccagtcgtaggttcagtggcaggtgatcgtgggacagtattcactctcaccatcaagtaactctgacaacgtgtaaagttatttcgactaaactttattacttgtacaaactaagtaatttaacaagtttgttttaccggaccgtaaagggaacctaacggtaacctaactaaaacgttaaaccgaacgttcggtaggccgtagaccgtaacctattacttcgttacctttactaacgtttccccttaccccggtacctaacgttctggttaaacc

SEQ ID NO: 138141 - DNA, 580 bp, Homo sapiens
  misc_feature: GYAE6OF01DQGLL.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcacatcacttgccgggcaagtcggaacattgacactatttaaatgtatcaacatagaccagggacgccctaagctcctaatctatgctgcatccagtttgcaaagtcggggtcccagtcgaggttcagtggcaggtgatcgtgggacagtactttcactctcaccatacaagtaatctagactaagtgaagttattttagactaacttattactagtaccaataagtaaattactaagtttgtttaccggaacgtaacggactaacgtaactaaactaaaagttaacgtaaacgttggtacggactacggtaccaacctacttcttcgttacctttactaacctttcccttaccccgaccttaacttccgttagttaaccg

SEQ ID NO: 138142 - DNA, 594 bp, Homo sapiens
  misc_feature: GYAE6OF01AN5CT.46.67.G01.1.454.CMB.1.raw
  modified_base (217)..(217): a, c, t, g, unknown or other
  misc_feature (217)..(217): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggnaagtcggaacattgacacctatttaaatggtatcaacatagaccagggacgccctaagctcctaatctatgctgcatccagttttgcaaaggtcgggtcccagtcgaggtttcaggttggcaggtggatcgtgggacagtatttcactctcaccatcagttaatctagcaacgtgaagtatttgactaacttattacttgtactaactaagtaatttaactaagtttacgttttacggaaccgtaagggaacctaacggtaaccttaaacgtaaaacttaaacggaaccgttaggtacgggtacctacggacctaacccgtattaccgttcgttaccttactaacttcccttaccccgacctacttcgttacgtaac

SEQ ID NO: 138143 - DNA, 511 bp, Homo sapiens
  misc_feature: GYAE6OF01EDW1V.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccaggacggccctaagctcctaatctatgctgcatccagtttgcaaagtgggtcccatcgaggttcagtggcagtgatctgggacagatttcactctcaccatcagtaatctgcaacgtgaagtatttagactaacttattactgtacaacagtaattacaattcgttttcgacctaaggacacgaactaacaaattaacgaactgtagctagcacatctgtcttcacttccttacccgactactctgtac

SEQ ID NO: 138144 - DNA, 626 bp, Homo sapiens
  misc_feature: GYAE6OF01C9SIR.46.67.G01.1.454.CMB.1.raw
  modified_base (226)..(226): a, c, t, g, unknown or other
  misc_feature (226)..(226): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaaccgtgggagacagtgtcacatcacttgccgggcaagtcggaacnttgacacctatttaatgtatcaacatagaccagggacgccctaagctcctaatctatgctgcatccagtttgactaaggtcgggtcccagtcgacggttcagtggcaggtggatcgtagggacagtactttcacttctcacctatactagtaatcctagtactaacgtagaagttagttttacgacttaacttattactagttaccaactaagtaaactttacgtaagtttcggttttaccggaaccgtaaacgggtaacctaacgtaaccgttaaactaaaacgtttaacggaaacttaggttacggacttacggacctaaccgttagttccgttacggttaccctttacgtaacctttcccttaacccccggacctttaaccgtcgttaacgtaaccg

SEQ ID NO: 138145 - DNA, 580 bp, Homo sapiens
  misc_feature: GYAE6OF01BEX8O.46.67.G01.1.454.CMB.1.raw
  modified_base (301)..(301): a, c, t, g, unknown or other
  misc_feature (301)..(301): n is a, c, g, or t
  modified_base (392)..(392): a, c, t, g, unknown or other
  misc_feature (392)..(392): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccggcaagtcggaacatgacactatttaaattgtatcaacatagaccagggacgccctaagctacctaatctatgctgcactccagtttnactaaaggtcgggtaccagtcgaggttcagtggcagtgatcgtggacagtattcactctacacatcaagtactctgactaacgtgtaaatntttagactaactttattactagtacaacgtaagtaaactttacaagtttcgtttaccggaccgtaacgggaactaaccgtaactaaactaaaacgttaaaccgtaacgtacgttaggtaccttagaccgtaaccctagttacttacgttaccttactacttccccttacccgtacacttcgttgtaac

SEQ ID NO: 138146 - DNA, 525 bp, Homo sapiens
  misc_feature: GYAE6OF01D6PP4.46.67.G01.1.454.CMB.1.raw
  modified_base (413)..(413): a, c, t, g, unknown or other
  misc_feature (413)..(413): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacggccctaagctcctaatctatgctgcatccagtttgcaaaggtgggtcccagtcgaggttcagtggcagtgatctgggacagatttcactctcaccatcagtaatctagcaacgtgaaagtatttagtaacttattactgtacaanagtaattactaattcgtttcgaccgaagggactaacgtaattaactaaattaacgaacgtgtggtctagacacctatctagttcttctatccttcccgactattctgtatac

SEQ ID NO: 138147 - DNA, 565 bp, Homo sapiens
  misc_feature: GYAE6OF01DH1UY.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcgaacattgacactattaatgtatcaacatagaccagggacggccctaagctctaatctatgctgcatccagtttgacaaaggtcgggtcccagtcggtagttcgagtggctaggtgatcgtagggactaggtactttacactcctactacctatacgtagtaactctgaactaacggtagtaagttattttacgacttaactttattacttgtaccaagtagttaacttactaagtttgtttaccgacggaacggtactacgtaactaactaaattacgaacgttgtagactcgacgtaccagttctcgttacttctacttccctacccgcctactcgtgtac

SEQ ID NO: 138148 - DNA, 550 bp, Homo sapiens
  misc_feature: GYAE6OF01E4CCL.46.67.G01.1.454.CMB.1.raw
  modified_base (386)..(386): a, c, t, g, unknown or other
  misc_feature (386)..(386): n is a, c, g, or t
  modified_base (432)..(432): a, c, t, g, unknown or other
  misc_feature (432)..(432): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggcagctcccgagggaaggggctggaatacattggaagtgtctctcatagtggaggttccattacagtccgtctctcaagagtcgagtcaccatatctctgacacgtccagcaatctagtttccctgagatgagttcngtgaccgccgctgactacgggcgttttatacgtgtgcgagagacgnttagtatgtattttggagttggtttattcgactacccgtagatccggaggggcctacggaccccgtgggggaccagggaacgtacgtggtccacgttcctccttacgccctaccccgg

SEQ ID NO: 138149 - DNA, 571 bp, Homo sapiens
  misc_feature: GYAE6OF01BMQ18.46.67.G01.1.454.CMB.1.raw
  modified_base (232)..(232): a, c, t, g, unknown or other
  misc_feature (232)..(232): n is a, c, g, or t
  modified_base (246)..(246): a, c, t, g, unknown or other
  misc_feature (246)..(246): n is a, c, g, or t
  modified_base (327)..(327): a, c, t, g, unknown or other
  misc_feature (327)..(327): n is a, c, g, or t
  modified_base (382)..(382): a, c, t, g, unknown or other
  misc_feature (382)..(382): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtcgcctcatcagtgtgttctcgnggggctgggtccgnagctccgagggagggctggaatacagttggaagtgtctctcagtagtggtaggttcctattacgagtccgtctctacaagngtcgagtcaccatactctctggacacgtcagcaatcttacgtttcccagaacgtntgtagttctgtcgaccgccgctagacgtacgggtctttagttacgtgtgcgagaggacggtcttattagtcgttagttttggagttagttattcgaacctaccgtagtcgtcgggacgggtctccggtacccggtgggaccgaagggacttacgtcggtactccgtacttaccgttccgccctacccgg

SEQ ID NO: 138150 - DNA, 582 bp, Homo sapiens
  misc_feature: GYAE6OF01D1F2H.46.67.G01.1.454.CMB.1.raw
  modified_base (336)..(336): a, c, t, g, unknown or other
  misc_feature (336)..(336): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccgagggaaggggctggaatacattggaagtgtctctcatagtggaggttcctattacagtccgtctctcaagagtcgagtcaccatatctctggacacgtccagcaatcacgttttcccngaagatgagttctgtcgacccgccgctgacgacgggtcgtttatactgtgcgagagacgctattatgtattttggagttggtttatttcgaccacccgtagactcggacggggctcggaccccgtggggaccgaggggtaactacgtggtccaccgttctccgttacgccctaccgacccgaacgggccctacgtcccggtacccttcccccgtcgtcccacccctccctacccaaggcgtacccg

SEQ ID NO: 138151 - DNA, 701 bp, Homo sapiens
  misc_feature: GYAE6OF01D7QEZ.46.67.G01.1.454.CMB.1.raw
  modified_base (195)..(195): a, c, t, g, unknown or other
  misc_feature (195)..(195): n is a, c, g, or t
tcagactagcagtacacgaccggtgctcgatttagagtatacatattgggtttggggagtctcggtcaggacacagcatggacatgagggtccccgctcagctccgtggggctcctgctactctggctccggaggtgccagatgtgacatcgagctgacccagtctccatcctccctgtctgcaaccggtggganacagtgtccaccatcacgttcggccgggacaaaggtccggaactattgacctaaccttaattttaaagttggtaatacaactatacggaccgagggaccggacccctaagcctacctaatctatcgctgctactcctagtttcgacgtaaaggtcgggtacccagtcggtaggttcgaggtggacgtaggtggtactcggtagggactagtactttcgactctacacctataccgtaagtaattcgtagaccgtaacggtagtaaagttacgtttacgaacttaaacgttttattaccgtagtactaaacgtaagtaaactttaactaagttttcggtttaccggaaccgtaacgggtaacctaaccggttaaaccttaaactaaaacgttaaaccggtaacgttacggttacggtacctacgtacctacccgttattcccgtttacgttaccttacccgtacctttaccccgttacccgtaccttacgttccgttagttaacccg

SEQ ID NO: 138152 - DNA, 678 bp, Homo sapiens
  misc_feature: GYAE6OF01ECW5D.46.67.G01.1.454.CMB.1.raw
  modified_base (173)..(173): a, c, t, g, unknown or other
  misc_feature (173)..(173): n is a, c, g, or t
  modified_base (348)..(348): a, c, t, g, unknown or other
  misc_feature (348)..(348): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgagggccttcggagaccctgtccctcacctgcgctgtctctggtcncctccatcagtagttggtttcttcgtgggctgggtccggcagctccgaggggaagggctaggaatacgagttggaagtgtctctcataggtggtaggttcctattacagtccgtctctcaagtagtcgagtcaccatactctcgtggacacgtccagctaatctacgttttcccngaacgtatgtagttctgtcgaccgtccgctacgacgtacgggtcgttttatacgtgtcggcgtagagaccggtacttagtttagttagtttagtttttaggagtttggtttaacgtttccgtaactacccgttagtacgtacggggtaacggggtactacccgggaccccggttggggacccgtaaggggtaactacggttcggtaccgtacccgttccttacccgtacgtccctacccgaaccggtacgggtacccctacggttcccggttaccccttcccccgtacggtcccctaccccgttacccgtacccgaacgccgtaccccgg

SEQ ID NO: 138153 - DNA, 558 bp, Homo sapiens
  misc_feature: GYAE6OF01CRJ6L.46.67.G01.1.454.CMB.1.raw
  modified_base (336)..(336): a, c, t, g, unknown or other
  misc_feature (336)..(336): n is a, c, g, or t
  modified_base (341)..(341): a, c, t, g, unknown or other
  misc_feature (341)..(341): n is a, c, g, or t
  modified_base (364)..(364): a, c, t, g, unknown or other
  misc_feature (364)..(364): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggcagctcccgaggggaaggggctggaatacattggaagtgtctctcatagtggaggttcctattacagtccgtctctcaagagtcgagtcaccatatctctggacacgtcagcaatcagttttcccngaagntgagttctgtgaccgcgctgacncgggtctttatactgtgcgagagacggctattatgtagttttggagttggtttatttcgactacccgtagacgtcggacggggtcctcggaccccgtggggccgagggtatacgtggtccaccgtctccgtacgccctcgaccgacggcccagtccggttccttccccgtcgcccaccctcctccagcgtcccg

SEQ ID NO: 138154 - DNA, 548 bp, Homo sapiens
  misc_feature: GYAE6OF01DTJN8.46.67.G01.1.454.CMB.1.raw
  modified_base (334)..(334): a, c, t, g, unknown or other
  misc_feature (334)..(334): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggcagctcccgagggaggggctggaatacattggaagtgtctctcatagtggaggttcctattacagtccgtctctcaagagtcgagtcaccatatctctggacacgtcagcaatcagttttcccngaagatgagttctgtgaccgccgctgacgacgggtctttattactgtgcgagagacggctattatgtatttttggagttggttatttcgactaccctagatcgacggggctcgaccctgggccagggatctgtcaccgtctcctagcctccaccgaacggcccatccggtacccttccccctcggtcccacccctccctacccaagcgtacccg

SEQ ID NO: 138155 - DNA, 538 bp, Homo sapiens
  misc_feature: GYAE6OF01ALBCQ.46.67.G01.1.454.CMB.1.raw
  modified_base (192)..(192): a, c, t, g, unknown or other
  misc_feature (192)..(192): n is a, c, g, or t
  modified_base (228)..(228): a, c, t, g, unknown or other
  misc_feature (228)..(228): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccgggcaagtcggaacnttgacacctatttaaatgtatcaacatagaccagggacggccctaagctcctaatctatgctgcatccagttttgcgaaagtcgggtcccatcgaggttcagtggcagtggatcgtgggacagtatttcactctacaccatcagtaatctagcaacgtgaatagtttagactaacttattactgtacaatagtaattactaattgtttacgacctaaggtactaacgaactaactaaacttaacgaacgtgtacgtacgtagacacctattctcgttcttacgtacttcctacccgacctctctgtaacg

SEQ ID NO: 138156 - DNA, 601 bp, Homo sapiens
  misc_feature: GYAE6OF01CHYEM.46.67.G01.1.454.CMB.1.raw
  modified_base (310)..(310): a, c, t, g, unknown or other
  misc_feature (310)..(310): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctcatcagtagtggtttctcgtggggctgggtccgcagctcccgaggggaagggctggaatacattggaagtgtctctcatagtggaggttcctattacagtccgtctctcaagagtcgagtcaccatatctctgacncgtcagcaatctagttttcccagaagtatgtagttctggtcgaccgccgctggacgtacgggtactttacttacgtgtcgacgagagacggtcttattatgttattttggagttggttattcgtactaccctagtacgtcggacgggtctccggacccgtgggacccgaagggtactacgtcggtcctaccgtcttccgttacgtccctaccgacccgtaacgggccctacgttcccggttacccgttcccccctcgggtcccaccccttcctacccgaaagccgtacccg

SEQ ID NO: 138157 - DNA, 683 bp, Homo sapiens
  misc_feature: GYAE6OF01BSVPD.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctcgtgggctgggtccgcagctcccgaggggagggctggaatacattggaagtgtctctcagtagtggaggttcctattacacgtccgtctctcaagagtcgagtcacatatctctggacacgtcagcaatctacgttttcccagaagtagtgtagtttctggttcgacccgccgtcgtgacgtaccgggtcgttttaactacgttggtaggacggaggaggacggtcttagtttacgttagttagtttttagggtaggtttaggtttactttacgtaaccgtacccgtagtacgtaccgggtaccggggtcctcccggaccccggtggggaccgaacggggtaacgttaccgtcgttaccgtacccgttccttacccgttaccgtccctacccaacccgggtaccgggtacccctacggttccccggttaccccttccccccggtacggtccccctaccccgttaccccgtaccgtaaccgccggtaccccg

SEQ ID NO: 138158 - DNA, 684 bp, Homo sapiens
  misc_feature: GYAE6OF01E43F7.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccgcagctcccgagggaagggctggaatacattggaagtgtctctcagtagtggaggttcctattacagtccgtctctcaagagtcgagtcaccatatctctggacaccgtcagcaatctacgttttcccagaagatgtacgttctgtcgaccgccgtctgacacgggtctttatacgtgtcgcgagagtacggtcttaatttataggttagttttagggtaggtttacggtttacgtttacgtaaccgtacccgtaaggtacgttaccgggtaccggggggtcctacccgggtaccccggtcggggacccggtaagggggtaaacttaccggttcgggttacccgtacccggttaccgttaccgttaccgtccccgtacccgaacccggtaaccggggtacccctaacggttcccggttaccccgttcccccgtacggtcccctaccccgttaccctaacccgacgtaaccgtcccg

SEQ ID NO: 138159 - DNA, 907 bp, Homo sapiens
  misc_feature: GYAE6OF01E1BRD.46.67.G01.1.454.CMB.1.raw
tcagactagcagtacacgaccggtgctcgatttagagtatacatattggggttggggagtctcggtcagggacacctagccagtggacaagtcgtacgggtccccgtcgtcagcctccgtggggcctcctgcctaacctcgtggcctccggaggtgccgaagtaggtgtggacattcggttacgtcttcggaccctagtttccgtaccgacttccctccgttggtctaggccaaccggtgggacgacgtaggtgtccgaccggtatccgtacggttccggccgggtacgtaacggggtccgaaactagttcgaacctaacctttaagtttaaacgttggtaactacctaaacgtagtaacgtaacccgtaacggggtacccggtacccttaaaggtccgttaacccgttaagttaccggttaacggtcggaccggttacggtacccgtaacgttacccggttaaggggtttacggaaccggttaaacggggtaccggggtaccccgtaggtacccggtaagggtttcgaagggttacgggtacgtaagggttagggaacgttaacggtagggtaaaccttaggttaactttccgtaacgttccgtaccgtaaccgtaacgtaccgggtaactttaacgtccgttaacgtaaccgttaaccgtaggttaaaacgttacgtttaaccggaacctttaaacctttaagttacctttaagtaaccctaaagttaattaaaccgttaaacgtaggtttacggtttaccggaaccgtaaagggacctaaccgtaaacgttaaaccgtaaacgttaaaccgtgtaagttcggtacctaagtccgtacgtaacggttccgtacggttactacgtccgttacccggttaccccgagtttacgtccgtaacgtaccg

SEQ ID NO: 138160 - DNA, 546 bp, Homo sapiens
  misc_feature: GYAE6OF01D21D8.46.67.G01.1.454.CMB.1.raw
  modified_base (228)..(228): a, c, t, g, unknown or other
  misc_feature (228)..(228): n is a, c, g, or t
  modified_base (385)..(385): a, c, t, g, unknown or other
  misc_feature (385)..(385): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacnttgacacctatttaaattgtatcaacatagaccagggacgccctaagctctaatctatgctgcatccagtttgcaagtgggtcccatcgaggttcagtgcagtgatcgtgggacagtatttcactctcaccatcagtaatctgacaacgtgaacgtntttagactaactttattactgtacaaactagtaatttacaatttggttttacgaccgtaaagggacacgtaactaacaaagttaacgacttaggtcgctagcctaacctattcttcgttaccttacgtacttccccgttacccgacctacttccgtgtaac

SEQ ID NO: 138161 - DNA, 502 bp, Homo sapiens
  misc_feature: GYAE6OF01B19TE.46.67.G01.1.454.CMB.1.raw
  modified_base (483)..(483): a, c, t, g, unknown or other
  misc_feature (483)..(483): n is a, c, g, or t
  modified_base (492)..(492): a, c, t, g, unknown or other
  misc_feature (492)..(492): n is a, c, g, or t
  modified_base (495)..(495): a, c, t, g, unknown or other
  misc_feature (495)..(495): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggccctaagctcctaatctatgctgcatccagtttgcaaagtgggtcccatcgaggttcagtggcagtggatcgtgggacagattcactctcaccatcagtaatctgcaacgtgaagtatttgactaacttattactgtacaacagtaattacaattgtttacggaccaagggacacgactaacaattaacgactgtgctgcactatctgtcttnactctcccnccntctgtac

SEQ ID NO: 138162 - DNA, 718 bp, Homo sapiens
  misc_feature: GYAE6OF01CEMAD.46.67.G01.1.454.CMB.1.raw
  modified_base (192)..(192): a, c, t, g, unknown or other
  misc_feature (192)..(192): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggancagtgtcaccatcacgttgccgggacaagtcggaacattgacacctatttaaatgtatcaacatagaccagggaccgccctaagctctaatctatgctgcatcctagtttgacgtaaaggtcggggtaccccaagttccggtagggtttacaggttcgggacgtaggtcggtaagtccgtagggaactaggtaacttttcaaccttcctacctaaccctattacctaagttaactacgttacgacgtaacggttagaaacgtttagttttacgaacttaaaccttttatttaccgttacgttaaccaaacgttaagtaaacttttaacgtaaatttcggtttttaccggaacccgtaaagggtaaccgtaaccggtaaaccttaaaacgtaaaactttaaaccggtaaaccgttaggtaccgggtaccgttacggtaccctaaaccggtattaccgtttacgttacccgtttacttaaccgtttcccgtttaccccggaacccttaacttaccgttagttaaaccg

SEQ ID NO: 138163 - DNA, 615 bp, Homo sapiens
  misc_feature: GYAE6OF01DEPRF.46.67.G01.1.454.CMB.1.raw
  modified_base (251)..(251): a, c, t, g, unknown or other
  misc_feature (251)..(251): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaaccggtgggagacagtgtcaccatcacttgccgggacaagtcgaacattgacactatttaatgtatcaanatagaccgagggaccgccctaagctactaatctatgctgctatccgtagtttcgactaaaggtcgggtacctagtcgtaggttcaggtggcaggtggatcgtgggacagtattcacttctacactatactaagtaactctagactaaacgtgtaaagttattttacgaacttaacgtttattaactacgttaacaactaagtaactttactaagtttcgtttaccgacgtaaacgggactaaccgtaactaaactaaacgttaacgtaacgttagttaggacctaggaccctaacctattcctttacggttaccctttacttaaccgttccccttaccccgaccttaacttccgttagtaaccg

SEQ ID NO: 138164 - DNA, 570 bp, Homo sapiens
  misc_feature: GYAE6OF01CGTB1.46.67.G01.1.454.CMB.1.raw
  modified_base (336)..(336): a, c, t, g, unknown or other
  misc_feature (336)..(336): n is a, c, g, or t
  modified_base (340)..(340): a, c, t, g, unknown or other
  misc_feature (340)..(340): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccgcagctcccgaggggaagggctggaatacagttggaagtgtctctcatagtggaggttcctattacagtccgtctctcaagagtcgagtcaccatactctctggacacgtcagcaatctagttttccngaanatgtagttctgtcgaccgcgctgacgcgggtctttattacgtgtgcgagagacggtctattagtgttagttttggagtttggttatttcgaactaccgtagacgtcgggacggggctccggcccgtggggaccgagggtatacgtgtaccaccgtctccgttacgccctaccgaccgacggccctagtcccggtcccttccccgtgccctacccctccaccagcgtcccg

SEQ ID NO: 138165 - DNA, 611 bp, Homo sapiens
  misc_feature: GYAE6OF01DCQGH.46.67.G01.1.454.CMB.1.raw
  modified_base (407)..(407): a, c, t, g, unknown or other
  misc_feature (407)..(407): n is a, c, g, or t
  modified_base (413)..(413): a, c, t, g, unknown or other
  misc_feature (413)..(413): n is a, c, g, or t
  modified_base (474)..(474): a, c, t, g, unknown or other
  misc_feature (474)..(474): n is a, c, g, or t
tcagactagcagtacacgaccggtgctcgatttagagtatacatattgggtttgtcctcctgctggtggcagctcccagatgggtcctgtccctggtgcaactgcaggacgtcgggcccacgactggtgaggccttggagaccctgtccctcacctgccgctgtctctggtcgcctccatcagtagtggtttctcgtgggctgggtccgcagcctaccgaggggaagggctaggaatacagttggaatcgtctctcagtgtggtaggttctattacagtccgtctctacaagagtcgagtcacatactctcgtggacacgtccagactaactcgtaacgttttccaagaatatagtattctgtacgaccgtcgctagacgtacggtcgtttaatcgtgtggacgagngacgtnttaatagttgttagttttggagttggtttacgttcgactacctagacgtcgggacgggtcnccggtaacccgtggggaccgtaagggaacttccgagttccgaccgttctaccgttacgaccctaccgaacccgtacggccctacgttcccggttcccttccccggtcgaccctaccccgcctaccgaagcgtacccg

SEQ ID NO: 138166 - DNA, 514 bp, Homo sapiens
  misc_feature: GYAE6OF01B0X4C.46.67.G01.1.454.CMB.1.raw
  modified_base (489)..(489): a, c, t, g, unknown or other
  misc_feature (489)..(489): n is a, c, g, or t
  modified_base (504)..(504): a, c, t, g, unknown or other
  misc_feature (504)..(504): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacgccctaagctcctaatctatgctgcatccagtttgcaaagtgggtcccagtcgagttcagtggcagtggatcgtgggacagatttcactctcaccatcagtaatctgacaacgtgaagtattttgactaactttattactgtacaactaagtaattacaattgtttacggaccgaagggtacacgaactaacaaattaacgaactgtgactgacacatctntcttcactcctaccnctctctgtac

SEQ ID NO: 138167 - DNA, 596 bp, Homo sapiens
  misc_feature: GYAE6OF01AIQN8.46.67.G01.1.454.CMB.1.raw
  modified_base (192)..(192): a, c, t, g, unknown or other
  misc_feature (192)..(192): n is a, c, g, or t
  modified_base (228)..(228): a, c, t, g, unknown or other
  misc_feature (228)..(228): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccgggcaagtcggaacnttgacacctatttaaattggtatcaacatagaccagggaccgccctaagctcctaatctatgctgctatccagtttcgacaaggtcggggtcccagtcgtaggttcaggtggacagtggtatcgtaggggactaggtatttcactctactacagtactaagtaactcgtagtactaacgtagtaacgtagttttgaccttaactttaattacttagtactaacgtaataactttactaagtttgtttacggaaccgtaaggtaactacgtaaacttaactaaaacgtttaaacgaacgttaggttacgacgttacgactaacctattacttcgttacttctaccttccttaccgacctatcgtgtaac

SEQ ID NO: 138168 - DNA, 533 bp, Homo sapiens
  misc_feature: GYAE6OF01EOWK2.46.67.G01.1.454.CMB.1.raw
  modified_base (233)..(233): a, c, t, g, unknown or other
  misc_feature (233)..(233): n is a, c, g, or t
  modified_base (524)..(524): a, c, t, g, unknown or other
  misc_feature (524)..(524): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatccgagctgacccagtcgtccagtcctcccgtgtctagcgaaccgtgggagacagtgcaccatcacttgccgggcaagtcggaacntgacactattaaatggtatcaacatagaccaggacggccctaagctcctaatctatgctgcatccagtttgacctaaagtggggtcccagtcgaggttcagtggcagtgatcgtgggacagatttcactctcacatcagtaatctgctaacgtagaagtatttgactaaccttattactgtaccaatagtaattactaattgtttacggaccgaagggactaacgtactaactaaattaacgaactgtagctgacaccgtatctgttacttcacttcccttacccgacctntcgtgtaac

SEQ ID NO: 138169 - DNA, 665 bp, Homo sapiens
  misc_feature: GYAE6OF01CT7U0.46.67.G01.1.454.CMB.1.raw
  modified_base (217)..(217): a, c, t, g, unknown or other
  misc_feature (217)..(217): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttggccggnaagtcggaacattgactacttatttaaatgtatcaacatagaccagggaccgccctaagctacctaatctatgctgcatccgtagtttgacgtaaggtcgggtacccagtcggtaggttcaggttcggactaggtggtagtcgtagggaactaggtactttacgactacctaccgtaacctagttacctaaggttaactcgtacggtaaccgtaacggttaaggtaaagtttacgttttacggaacctttaaactttacgtttaacgttacggtaactaaacgtaagttaaacttaacgtaacgtttcggtttaaccggaacgtaacgggtacctaacgtaaacctaaactaaacgttaacgtaacgtaggtacggacttacgaccgtaactacgttcttacggttccttactaccgttcccttacccgactacttccgtagtaaccg

SEQ ID NO: 138170 - DNA, 499 bp, Homo sapiens
  misc_feature: GYAE6OF01B77MD.46.67.G01.1.454.CMB.1.raw
  modified_base (192)..(192): a, c, t, g, unknown or other
  misc_feature (192)..(192): n is a, c, g, or t
  modified_base (418)..(418): a, c, t, g, unknown or other
  misc_feature (418)..(418): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccgggcaagtcggaacattgacacctatttaaatgtatcaacatagaccagggacggccctaagctcctaatctatgctgcatccagtttgcaaagtggggtcccatcgaggttcagtggcagtggactctgggacaggatttcactctcaccatcagtaatctgacaacgtgaagattttgactaactttattactgtacaactanaattacaattgtttcgacaaggacacgactacaaataacaactgtgctagcacatctgtctcatctacccgctatctgtac

SEQ ID NO: 138171 - DNA, 659 bp, Homo sapiens
  misc_feature: GYAE6OF01B11D2.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatccctccctgtctgcaaccggtgggagacagtgtcaccatcacttggccgggcaagtcggaacattgactaccttatttaaatggtatacaacatagaccgagggaccgaccctaagcctacctaatctatgctgctatcctagtttcgactaaggtcgggtaccctagtcggtaggttcaggtggacgtaggtggatcgtggactagtacttcactctacacctatacaagtaactcgtagtacgtaacgtagtaacgttagtttacgaacttaactttacttacgttagtaacctaaacgtaagttaaactttaagtaacgtttcggttttaccggaacgtaaacgggtaacctaaccggtaaaccttaaaacgtaaaacgttaaacgaacgttacggtaagtaacgtacgaaccgtaacctaagttaccgtttcgttaccttaccttacgttaccccttacccggtaccttaacttccgtagttaaccg

SEQ ID NO: 138172 - DNA, 595 bp, Homo sapiens
  misc_feature: GYAE6OF01DYCCR.46.67.G01.1.454.CMB.1.raw
  modified_base (211)..(211): a, c, t, g, unknown or other
  misc_feature (211)..(211): n is a, c, g, or t
  modified_base (233)..(233): a, c, t, g, unknown or other
  misc_feature (233)..(233): n is a, c, g, or t
  modified_base (246)..(246): a, c, t, g, unknown or other
  misc_feature (246)..(246): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtncctcatcagtagtgtttctcgngggctgggtccgnagctccgagggagggctggaatacagttggaagtgtctctcagttagtggtaggttcctaattacagttcccgtctctacaagagtcgagtcacctatactctcgtgacacgtccagactaatctacgttttcccagaagtatgtagttcgtgtacgaccgccgtctacgacgtacgggtctttaattacgtgtcgacgtagacgtacggtacttaattagtgttagttttggagttgtttacttcgactacccgtagacgtcgggtaccggggtcctccggtacccggtggggacctaagggaacttacgtcggtacctacccgttcttacccttagcccctaacccg

SEQ ID NO: 138173 - DNA, 574 bp, Homo sapiens
  misc_feature: GYAE6OF01EGGKX.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgactacctatttaaattggtatcaacatagaccagggacgccctaagctcctaatctatgctgcatcctagtttgacaaaggttgggtcccagtcgtaggttcagtggcaggtgatcgtggacagtatttcactctcactatcagtatctagacaacgtgtaagtatttacgctaaatttacttactagtactaagaagtaaatttacgtaatttcgtttacggaaccgtaaagggtacaacgtaactaaacgtaaacgttaaacgaacttggttacgacgtacgccgtaactagttacctgttaccttacgtacttccttacccgacctaagttcctagtaac

SEQ ID NO: 138174 - DNA, 582 bp, Homo sapiens
  misc_feature: GYAE6OF01BP45A.46.67.G01.1.454.CMB.1.raw
  modified_base (327)..(327): a, c, t, g, unknown or other
  misc_feature (327)..(327): n is a, c, g, or t
  modified_base (373)..(373): a, c, t, g, unknown or other
  misc_feature (373)..(373): n is a, c, g, or t
  modified_base (427)..(427): a, c, t, g, unknown or other
  misc_feature (427)..(427): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggaagggctggaatacattggaagtgtctctcatagtggaggttcctattacagtccgtctctcaagngtcgagtcaccatatctctggacacgtcagcaatctagttttcccngaagatgagttctgtcgaccgccgctgacgtacgggtctttatactgtgcgagngacggctattatgtattttggagttggtttattcgactaccctagtacgtcggtaccggggccttaccggaccccggttggggacccgtaggggaaacttaccggttacgggttcctacccggttccgttacccttacggccccgttaaccccgg

SEQ ID NO: 138175 - DNA, 586 bp, Homo sapiens
  misc_feature: GYAE6OF01DT0WY.46.67.G01.1.454.CMB.1.raw
  modified_base (194)..(194): a, c, t, g, unknown or other
  misc_feature (194)..(194): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatccctccctgtctgcaaccggtggganacagtgtcaccatcacttgccgggcaagtcggaacatgacactatttaaatgtatcaacatagaccaggaccgaccctaagctcctaatctatgctgcatcctagtttgcaaaggtcgggtcccaagtcgaggttcaggtggacgagtggatcgtgggacagtatttcactctcacctatctagtaatctagacgtaacgtagtaagttagttttagacttaaactttattacgtgtaacaaactagtaaactttataatttcggttttaccgacgtaaacgggactaaaccgtaactaaactaaaacttaaacggaacttggtacgcgtagacctaacctagttactcttcgttacacgttacccttaccccgacctagttcctggttaac

SEQ ID NO: 138176 - DNA, 627 bp, Homo sapiens
  misc_feature: GYAE6OF01CFG6N.46.67.G01.1.454.CMB.1.raw
  modified_base (211)..(211): a, c, t, g, unknown or other
  misc_feature (211)..(211): n is a, c, g, or t
  modified_base (333)..(333): a, c, t, g, unknown or other
  misc_feature (333)..(333): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtncctccatcagtagttgtttctcgtggggctgggtccggcagcctccgaggggaagggctggaatacagttggaagtgtctctcataggtggtacggttcctattacagtccgtctctcaagngtcgagtcacatatctctggacacgtccagcaattctacgttttcccagaaagtattcgagtttcgtgtacgtacccgtacgctagaccgtacggggtacttttacgtacctggttgacgtagaggtccggtattagtttagtgttagtttttgggagtttaggttattttacgaccgtacccgttaagtacgttacgggacggggtccgtacccggtccccggtggggacccgagggtaactccggttacgggtcctaacccggttccttaacccgttgccccttaaccccgg

SEQ ID NO: 138177 - DNA, 612 bp, Homo sapiens
  misc_feature: GYAE6OF01DQEG8.46.67.G01.1.454.CMB.1.raw
  modified_base (192)..(192): a, c, t, g, unknown or other
  misc_feature (192)..(192): n is a, c, g, or t
  modified_base (216)..(216): a, c, t, g, unknown or other
  misc_feature (216)..(216): n is a, c, g, or t
  modified_base (226)..(226): a, c, t, g, unknown or other
  misc_feature (226)..(226): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccggnaagtcgaacntgacactatttaatggtatcaacatagaccagggacgccctaagctactaatctatgctgcatcctagtttgactaaggtcgggtcccatcggaggttcagtggcaggtggatcgtagggacagtatttcacttctcacctatacagtaatctgactaacgtgaagttatttagacttaactttattactgtacaactaagtaatttactaagttttcggtttaccggaaccgtaaacgggacctaaccggtaacttaaaccgttaaaacgttaaaccgtaaacgttacggttacgtaccgttacgaccctaacccgtagttaccgttcgttacctttacctaccgtttccccgtttaccccgaccttaacttccgttaggtaacc

SEQ ID NO: 138178 - DNA, 589 bp, Homo sapiens
  misc_feature: GYAE6OF01BQD46.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtccgggcccacgactggtgaggccttcggagaccctgtccctcacctgcgctgtctctggtgcctccatcagtagttgtttcttcgtggggctgggtccggcagccgtcccgaggggaaggggctggaatacagttggaagtgtctctcataggtggaggttcctattacagtccgtctctacaagagtcgagtcaaccatactctctggacacgtcagacaatctacgtttcccagaagtatgtagttctgtcgccgcgctgacgacgggtcgtttatactgtgcgagagacgtctattagtgttagttttggagttggtttacttcgtacctacccgtagacgtacgggaccggggtccgtccggacccggtcggggaccgtaggggtaactacggtcggtacctacccggttcctcccgttacgcccgtaaccccg

SEQ ID NO: 138179 - DNA, 524 bp, Homo sapiens
  misc_feature: GYAE6OF01DNHAM.46.67.G01.1.454.CMB.1.raw
  modified_base (192)..(192): a, c, t, g, unknown or other
  misc_feature (192)..(192): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccgggcaagtcggaacattgacacctatttaaatggtatcaacatagaccagggacggccctaagctctaatctatgctgcatccagtttgcaaagtgggtcccatcgagttcagtggcagtgatctgggacagatttcactctcacatcagtatctgacaacgtgaaagtattttagactaactttattactgtacaacagtaattactaattgttttacggacctaagggtacacgtactaactaaattaacgaactgtaggctagctaacctattctgttcttctacttccttacccgcctatctgtaac

SEQ ID NO: 138180 - DNA, 581 bp, Homo sapiens
  misc_feature: GYAE6OF01AH8PR.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccggcaagtcgaacattgacacctatttaaattggtatcaacatagaccgagggaccggccctaagctacctaatctatgctgcatccagtttcgactaaaggtcggggtacccagtcgtaggttcaggtcggcgaggtggatcgtagggactaggtactttcacctctcacctatacaagttaactctcgacaacgtagtaaagttagtttagaacttaacttacttaactagtacctaaagtaagtaatttaactaacgtttacggtttaccgaaccgtaaagggacctaacgaaacttaaactaaactaacgaacttgtaggctagaccactatctgttactactacttctcccgactctcgtatac

SEQ ID NO: 138181 - DNA, 703 bp, Homo sapiens
  misc_feature: GYAE6OF01DSXF1.46.67.G01.1.454.CMB.1.raw
  modified_base (194)..(194): a, c, t, g, unknown or other
  misc_feature (194)..(194): n is a, c, g, or t
tcagactagcagtacacgaccggtgctcgatttagagtatacatattgggtttggggagtctcggtcaggacacagcatggacatgagggtccccgctcagctccgtggggctcctgctactctggctcggaggtgccagatgtgacatcgagctgacccagtctccatcctccctgtctgcaaccggtggganacagtgtcaccatcacgttcggccgggacaaaggtcggaactattacgaacctaacctttaattttaaaagttggtaactaccaaactagtaacgaaccgaacggggaccggtacccctaaagccttacctaattctatcgcttgactactccgtagtttgaacgtaaagggtcgggtacccaagtcggtacggtttcagggttcgacgtaggtggatccggtgggaactagtatttcacgtctacacctatacgtaagttactctagtaacgtaacgtagtaacgttatttacgaacttaactttaattacgtagtaaactaaacgtaattaaactttaacttaacgttacggttttaaccggaacgtaaacgggtaacctaaaccggtaaacttaaacgtaaaacgtttaacgaacgttacgggtacgtacctacgtaaccgttaactagttacgttcgttaccttacgtaaccgtttcccgttacccgtactactgtacgttaacg

SEQ ID NO: 138182 - DNA, 619 bp, Homo sapiens
  misc_feature: GYAE6OF01BNS75.46.67.G01.1.454.CMB.1.raw
  modified_base (337)..(337): a, c, t, g, unknown or other
  misc_feature (337)..(337): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgaatggtgaggccttcggagaccctgtccctcacctgcgctgtctctggtcgcctccatcagttagttggtttcttcgtggggtctggggtccgcacgctccgagggaaggggctggaatacagttggaagtgtctctcagttagtggaggttcctattacagtccgtctctcaagngtcgagtcaccatatctctaggacacgtccagactaactctacgttttcccagtaaacgtagttagtagtttcgtggtcgtacccgccgtctacgaacgtacgggttacgtttagttacgtggtcgacgagacggacggtacttattacgttgttagtttttggagtttgtttactttcgacctacctagtagtccgggacgggtcgtcccggtacccggtgggaccgaagggtacttacggtcggtccgtacccgttccgttcctccggtccctaccccgg

SEQ ID NO: 138183 - DNA, 563 bp, Homo sapiens
  misc_feature: GYAE6OF01EF36U.46.67.G01.1.454.CMB.1.raw
  modified_base (193)..(193): a, c, t, g, unknown or other
  misc_feature (193)..(193): n is a, c, g, or t
  modified_base (558)..(558): a, c, t, g, unknown or other
  misc_feature (558)..(558): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtggganacagtgtcaccatcacttgccgggcaagtcggaacattgactacttatttaaatgtatcaacatagaccagggaccgccctaagctcctaatctatgctgcatcctagttttgacgtaaaggtcggggtaccctagtcgtaggtttcaggtggcaggtggtatcgtgggacagtactttcactctcacctatacaagtaactctgacgaacgtagtaagtatttagactaacttattactagtacaactagtaattactaattcgtttacggaccaagggtaccacgtaactaaactaaacttaaacgagtgtagtactacgtacacctatcgttctaccttctacttccctcccgactctcgtntaacg

SEQ ID NO: 138184 - DNA, 580 bp, Homo sapiens
  misc_feature: GYAE6OF01DZ527.46.67.G01.1.454.CMB.1.raw
  modified_base (191)..(191): a, c, t, g, unknown or other
  misc_feature (191)..(191): n is a, c, g, or t
  modified_base (392)..(392): a, c, t, g, unknown or other
  misc_feature (392)..(392): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaaccgtggganacagtgtcaccatcacttggccgggcaaaggtcggaacattgactaaccttatttaaatgtatacaacatagaccagggacgccctaagctactaatctatgctgcatcctagttgacgaaagtcgggtcccagtcgagttcagtgcagtgatcgtaggacagtacttcacgtctacacatacagtactctagacaacgtnaagtatttagactaacgttatactgtacaaacgagtaaacttactagttacggtttacgaaccgtaacgggtaactaacgtaaaccttaaactaaaacgttaaacgtaacgttaggtacggacctaggacctaacctattacgtcgttaccttactaacttcccttacccgactacgttctagtaacc

SEQ ID NO: 138185 - DNA, 837 bp, Homo sapiens
  misc_feature: GYAE6OF01A4IKY.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgacggccttcggagaccctgtccctcacctgcgctgtctctggtgcctcatcagtagtggtttctcgtggggctgggtccgcgagcgtccgaggggaaggggcgtagtaagtactagttggtaagtagtcgttctctagtaggttgggtacggtttccgttaacttacgtacggtacccgttcgttcctactaaggagtacggtacgtacctaacccacgtaattccttccgtagggaaccgaacccgttaccaacggtactaaacgtacctttaaccgttttccccgttaaggaaagtaacgttaggtacggtttccttggaccgggtaaccccgccccggttagttaggtaaacccgtaaccgggggttcttttaactttcgttacgggtggtaccgggaacggtaagggacccgggttactttaaagttttacgtacggggttttatttttttacggggggaagttttaacgggtttttactttaacccggaccctaaacccggtttacggtaaggtttccccgggggaaaccggggggttcccgtttacccccgaacccccgggggttgggggaacccggtaacgggtaaaaacgtttcccgtcgggggtttaaccccccaacgttacccgttttaccccccgttaggttccccccaaaccccggg

SEQ ID NO: 138186 - DNA, 578 bp, Homo sapiens
  misc_feature: GYAE6OF01DL5TA.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtcctggtgcaactgcaggagtcgggcccacgactggtgaggccttcggagaccctgtccctcacctgcgctgtctctggtgcctccatcagtagtggtttctcgtggggctgggtccgcagctccgagggagggctggaatacattggagtgtctctcatagtggaggttctattacagtccgtctctcaagagtcgagtcaccatatctctggacacgtcagcaatctagttttccctagaagtatgtagttctgtcgaccgcgctgacgacgggtcgtttacttacgtgtgcgagagtacggcttattattgtagttttggtagttgttagtttcgactacccgtagtacgtacggacggggtcgtaccggtacccggtcggggaccggacggggtaactacgttacggttccgtacccggttcttcccttacgtccccgtaccccg

SEQ ID NO: 138187 - DNA, 764 bp, Homo sapiens
  misc_feature: GYAE6OF01D3LP1.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgagggccttcggagacccctgtccctcacctgcgctgtctctggtcgcctcatcagtagttggttctcgtgggctgggtccgcagctccgaggggagggctaggaatacgagttagggaagttgtcctctacagttaggtggtacggtttcctaagttacgtacggttcccgtctcctacgaaggtagttccggagttacccaaccgtattaactcttccgtcggaacctaccgtaccagcctaacgtcttacgttttacccaggaacgtatagtacgtttctagtcggacccgtccgcgtacggaccggtacgggttacgttttaagttcgttgtacgggaccggtaaggacggtaccggtattacgtttaagttggtttaggtttttagggtaggtttacggtttagtttaccgaccgttacccgtagtacggtcgggaccggggtcccgtacccggccccgggttacggggacccgtaggggtaacgttacggtccggttaccgtaccccgttccgtacccgttacgtccccgtacccaacccgggtaaccgggtcccctacggttccccggttaccccgttcccccggacggtaccccctcccttaccccgtaccgaacgtcccgtaccccgg

SEQ ID NO: 138188 - DNA, 659 bp, Homo sapiens
  misc_feature: GYAE6OF01ERXZ8.46.67.G01.1.454.CMB.1.raw
  modified_base (191)..(191): a, c, t, g, unknown or other
  misc_feature (191)..(191): n is a, c, g, or t
  modified_base (227)..(227): a, c, t, g, unknown or other
  misc_feature (227)..(227): n is a, c, g, or t
  modified_base (353)..(353): a, c, t, g, unknown or other
  misc_feature (353)..(353): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctcatcctccctgtctgcaaccgtggganacagtgtcaccatcacttgccggacaagtcggaacntgacacttatttaatggtatcaacatagaccagggacgccctaagctacctaatctatgctgactactcctagtttcgacgtaaaggtcggggtacccagtcgaggttcaggtggcaggtgatcgngggacagtattcactctacacgtatcgagttaactctacgactaacggtgaaacgttagttttacacgttaaactttactttacgtacgttaaccaaagtaacgtaaacgtttaactagtttacggttttaccgggaaccgtaaaggggtaccctaaccggtaaacttaaaacctaaaaggtttaaacccgtaaagttcggttacggtacctttaacggaccctaaccgttattacccggtttacgttaccctttacgtaaactttccccccgttacccggaacctttcttacccgttagtaaccg

SEQ ID NO: 138189 - DNA, 610 bp, Homo sapiens
  misc_feature: GYAE6OF01AHDB4.46.67.G01.1.454.CMB.1.raw
  modified_base (213)..(213): a, c, t, g, unknown or other
  misc_feature (213)..(213): n is a, c, g, or t
  modified_base (340)..(340): a, c, t, g, unknown or other
  misc_feature (340)..(340): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggttttcttcgtggggctggggtccggnagctcccgaggggaaggggctggaatacattggaagtgtctctcatagtggaggttcctattacagtccgtctctcaagagtcgagtcaccatatctctggacacgtccagcaatctagttttcccngaagatgagttctgtcgaccgccgctgacgacgggtcgtttattacgtgtgcgagagacggtctattagttgttagtttttggtaggtttaggtttacgtttcgtaacctacccgtagtacgtcggacggggtcctccggaccccgtcggggccgaagggtaactacgtggtacctaccgtcctccgttacgcctacccgaccgacggcccctacgttccggtcccttccccgtcggtaccctaccccgtccctacccgaagcgtacccg

SEQ ID NO: 138190 - DNA, 555 bp, Homo sapiens
  misc_feature: GYAE6OF01C6Z45.46.67.G01.1.454.CMB.1.raw
  modified_base (356)..(356): a, c, t, g, unknown or other
  misc_feature (356)..(356): n is a, c, g, or t
  modified_base (504)..(504): a, c, t, g, unknown or other
  misc_feature (504)..(504): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgcccagatgtgacatccgagctgacccagtctccatcctccctgtcctgcaaccgtggagacagtgtcaccatcacttgccgggcaagtcgaacattgacacctatttaatgtatcaacatagaccagggacgaccctaagctacctaatctatgctgcatccagtttgacaagtgggtccatcgagttcagtggcagtgatcgtgggacagatttcactcnctaccatcagtaatctgactacgtagaagtattttagttaacttagttactagtactaacataatttacaattcgttttacggaccgtaagggtacaacgtactaaacaaatttaaacgacgttagtcggactacgacaaccgtactnttacggttcttaccgtattacccgtttacccgaccttatctgtacgtaacg

SEQ ID NO: 138191 - DNA, 653 bp, Homo sapiens
  misc_feature: GYAE6OF01B15KD.46.67.G01.1.454.CMB.1.raw
  modified_base (179)..(179): a, c, t, g, unknown or other
  misc_feature (179)..(179): n is a, c, g, or t
  modified_base (216)..(216): a, c, t, g, unknown or other
  misc_feature (216)..(216): n is a, c, g, or t
  modified_base (355)..(355): a, c, t, g, unknown or other
  misc_feature (355)..(355): n is a, c, g, or t
tcagactagcagtacacgaccggtgctcgatttagagtatacatattgggtttgtcctcctgctggtggcagctcccagatgggtcctgtccctggtgcaactgcaggagtccgggcccacgactgggtgacggtccttcgggacgaccctgtccctcacctgcgctgtctcgtggtcncctccatcagtagttgtttctcgtgggctgggtccgnacgcctccgaggggagggctaggaatacgagttggagtgtctcatagtaggtggtacggttcctattacacgtccgtctctacaagcgtcgacgtcacatatctcgtcggacacgtcagctaatctacgtttccagacntgtattcgtgtcgaccgccgtctacgacgtacgggttactttaacgttacgtggtcgacggaagacggtacggtacttaagttgttagttacgtttttaggacggttttggtttacgtttaccgaccgtaccgttagtaccggtcggggtaccggggtccctaccggtacccggtacggggacccgtaagggtaacttacggtcggtacctaccgttccgttacctcgccctaccgaaccgtacggccctacgttcccggtccccttcccgcgtccctacccctacacgacgctcccg

SEQ ID NO: 138192 - DNA, 807 bp, Homo sapiens
  misc_feature: GYAE6OF01ASLGY.46.67.G01.1.454.CMB.1.raw
  modified_base (309)..(309): a, c, t, g, unknown or other
  misc_feature (309)..(309): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggcagctcccgaggggaaggggctggaatacattggaagtgtctctcatagtggaggttcctattacagtccgtctctcaagagtcgagtcaccatatctntggacacgtccagcaatctagttttccctagaacgtataggtagtttctggttcggaacccgccgctcggaacgtacggggtcgttttaattaaccgtggtacgccggtaaggacggtaacgggtacttaagtttagttacggttaagtttttttgggtaaggtttagggttttaacgttttaccggtaaacccgtaaccccgtttaacggtaacggttaccggggtaaccgggggggtcccgtacccgggtaaccccccgggttcggggggaccccgtaacgggggtaaacgttaaccggttcgggttacccgtacccggttaccccgttacccgtttaccggacccccgtttaccccgaaaccccggtaaacccggggtacccccgtaacggttcccccgggtttacccccgtttacccccccggttaccgggtacccccttaaccccccgttacccccgttaaccccgtaaaacgggtacccggtaaccccccgg

SEQ ID NO: 138193 - DNA, 834 bp, Homo sapiens
  misc_feature: GYAE6OF01DC5W8.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagcctccccagagtcgggtcctcgtcccgtggtgcaactgcgaggaggtccgggcccacgacgtgggtgacggtccgttacggacgtaccctcgtccctaccgaccgtgccgtcttcgtcctcgtcgggtcctccctccgtattcgtaaggttcggtttcggttttccgttcggtcgggggtccggttcggggtaccgcgtaccgccgtacccgggaggggtacgggtctaggtaatacgtgttagggacttcgtacctcgtatagttaggtcggtacgttaccttacgttaccgtcggttcccgttacctcgtaacctaagggtacgtacggtacctaccaaccgttatacgttctacggtacggaaccacccgtacgaacgtaccgttaacttccgttttaccgtttaccgaggtaaacgttcgtacggtttacgttcgtacggtaaccccggccggtccgttacggaccggttaccgggtaacggtttgtttaaacctcgggttacggacggaaggtagtaacgggtcctttaagttagttaggtttaacgtttttgggttaagttcgggtttaattttacccggtaaccgtacccgtagtacgggtccggtacccgggggtcccgttacccggtcccccggacggggttacgggacgttaacggtaccttcgggttacccgtacccgtacccgttctacccgtccgtccccgaaacccgg

SEQ ID NO: 138194 - DNA, 622 bp, Homo sapiens
  misc_feature: GYAE6OF01AHP8I.46.67.G01.1.454.CMB.1.raw
  modified_base (292)..(292): a, c, t, g, unknown or other
  misc_feature (292)..(292): n is a, c, g, or t
  modified_base (339)..(339): a, c, t, g, unknown or other
  misc_feature (339)..(339): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctggggtccggcagctcccgaggggaaggggctggaatacattggaagtgtctctcatagtggaggttcctattacagtccgtctctcaagngtcgagtcaccatatctctggacacgtccagcaatcacgttttcccngaagatgagttctgtcgaccgccgctgacgacgggtcgttttacttactgtgcgagagacggctattatgtattttggagttgttatttcgactaccctagacgtcggacggggtcctcggaccccgtcggggccgagggtaacttacgtcggtacctaccgttccgtcccgttagcccctacccgaacccgtaaccggggtacccctacggttcccgggtaccccttttcccccccgacgggtcccctacccccttacccgtaccctaaacggcgtaccccg

SEQ ID NO: 138195 - DNA, 601 bp, Homo sapiens
  misc_feature: GYAE6OF01EB7HR.46.67.G01.1.454.CMB.1.raw
  modified_base (194)..(194): a, c, t, g, unknown or other
  misc_feature (194)..(194): n is a, c, g, or t
tcagactagcagtacacgaccggtgctcgatttagagtatacatattgggtttgggggagtctcggtcaggacacagcatggacatgagggtccccgctcagctcctggggctcctgctactctggctccgaggtgccagatgtgacatcgagctgacccagtctccatcctccctgtctgcaaccggtggganacagtgtcaccatcacttgccgggcaagtcggaacattgactacttatttaaattggtatcaacatagaccgagggaccgccctaagctcctaatctatgctgcactccagtttgactaaaggtcgggtcccagtcgaggttcagtgcagtgatcgtgggacagtacttcactctcacctatcagtaatctgactaacgtagaagtatttagactaactttattactgtacaactagtaattaactaagttcgttttaccggacgtaaacgggtaacctaaccgtaacttaaactaaaacttaaaccggtaacttacggtacggtacgtacgtacccgtaactattaccttcgttaccttactactttccccgttaccccgacccttacgtttccgtgttaaacccg

SEQ ID NO: 138196 - DNA, 611 bp, Homo sapiens
  misc_feature: GYAE6OF01D8B10.46.67.G01.1.454.CMB.1.raw
  modified_base (173)..(173): a, c, t, g, unknown or other
  misc_feature (173)..(173): n is a, c, g, or t
  modified_base (278)..(278): a, c, t, g, unknown or other
  misc_feature (278)..(278): n is a, c, g, or t
  modified_base (336)..(336): a, c, t, g, unknown or other
  misc_feature (336)..(336): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactgggtgagggccttcggagaccctgtccctcacctgcgctgtctctggtncctccatcagtagtggttcttcgtgggctgggtccgcagctccgagggagggctggaatcattggaatgtctctcagtagtggaggttcctattacagttccgtntctcaagtgtcgagtcacatatctctgacacgtccagcaatctacgttttccagaagntgagttctgtcgaccgtcgctgacgtacgggtctttatactggtcgacgagacgtacggtcttaagtttgtgttagttttaggagttggtttattaccgactaccgtagcgtacgggacgggtctaccggaccccgtaggggaccgtaagggtaacttaccgtcgtaccgtaccggttcctccgttacgccctaccgaaccgtacggtcccacgttccggttccccttcccccggtacgtacccgtaccccttaccgaccctaaggcctacccgg

SEQ ID NO: 138197 - DNA, 818 bp, Homo sapiens
  misc_feature: GYAE6OF01CZQSP.46.67.G01.1.454.CMB.1.raw
  modified_base (251)..(251): a, c, t, g, unknown or other
  misc_feature (251)..(251): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctcgtgggctgggtccgcagctccgagggagggctaggaatacgagttggaagtgtctctnagtagtggagttcctattacagtccgtctctacgaagtcgtcgagtaccaaccatactctacgtggaccacgtccagactaatctacgttttcccagaagtatagtacgtttctaggtacgacccggtccgacgtacggaaccgtacggggttacgtttttaagttaccggtggttacgggacgtaaggtacggtaccgggtacttaagtttacgttaggtttaagtttttagggaaggtttaggtttaacgttttaccgaaccgttacccgttaaggtaccggttaccggggtaacgggggtcccgttaccccgggaacccccgggttacggggggacccgtaaaacggggggttaaccttaccggttacggggttaaccccgtaaccccgggtttccctttaccccggtttaaccggcccccctttaaacccggaaaccccggtaaccggggtaccccctaaccggtttcccccgggttacccccgttttcccccccggtaccggttacccccctaacccccgtttaccccgtaacccgtaaaccgggtcccgttaacccccggg

SEQ ID NO: 138198 - DNA, 597 bp, Homo sapiens
  misc_feature: GYAE6OF01BP1YS.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacaccttatttaaattggtatcaacatagaccagggacggccctaagctcctaatctatgctgcatccagtttgacgtaaaggtcggggtcccagtcgaggttcagtggcagtgatcgtgggacagtatttcactctcactatcagtaactctgacaacgtgtaagttattttgacttaaactttatttactacggttaccaaactaagtaaactttaacgtaaatttcggttttaccggaaccgtaacgggacctaacgtaaaccttaaacaaagtttaaacgaacttggtaggcctagacctaactattacgtcgtttaccttcgttaccttccctttaccccgaccttacttccgtagtaacc

SEQ ID NO: 138199 - DNA, 595 bp, Homo sapiens
  misc_feature: GYAE6OF01DMLQ7.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacgccctaagctcctaatctatgctgcatcctagttttgacaaaggtgggtcccagtcgaggttcagtggcagtgatcgtgggacagtatttcactctcacctatcagtaatctgacaacgtgaagtattttgactaactttattactgtacaactaagttaaattaactaatttcggtttttaccggaccgtaaagggtaccgtaaccgtaaccttaaacgtaaaacgtttaaaccgaaacgttaggtagggtacctacgaccgtaaccctattccttacgttacctttcctaacttcccttacccccgacctaacttcctggttaacc

SEQ ID NO: 138200 - DNA, 567 bp, Homo sapiens
  misc_feature: GYAE6OF01B1ZZ7.46.67.G01.1.454.CMB.1.raw
  modified_base (334)..(334): a, c, t, g, unknown or other
  misc_feature (334)..(334): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggaaggggctggaatacattggaagtgtctctcatagtggaggttcctattacagtccgtctctcaagagtcgagtcaccatatctctggacacgtccagcaatcagttttcccngaagatgagttctgtgaccgcgctgacacgggtcgtttattactgtgcgagagacggctattatgtattttggagttggttatttcgactacctagactcggacggggtctcggaccccgtggggcccgaggggaactacgtcggtctaccgtctcccttacgccctccaccgacgggccctacgtcccggtccttccccccgtggtcccaccccttccctccaagcgtcccg

SEQ ID NO: 138201 - DNA, 608 bp, Homo sapiens
  misc_feature: GYAE6OF01D9KBM.46.67.G01.1.454.CMB.1.raw
  modified_base (249)..(249): a, c, t, g, unknown or other
  misc_feature (249)..(249): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctctggggctgggtccggnagctccgagggaagggctggaatacattggaagtgtctctcagtagtggaggttcctattacagttccgtctctacaagagtcgagtcacatatctctggacacgtcagcaatctagtttcccagaagatgtagttctgtcgaccgcgctagactacgggtctttagttactgttgcgtagacggtacggtcttagttagtgttagttttcggagtttggttactttcgaactacccgtagtacgtaccgggaccggggtaccttcccgggtaccccgtagggggacccgaacggggtaacttacggttcggtacccgtaccggtaccctttcccgttaccgtccccttaaacccccgg

SEQ ID NO: 138202 - DNA, 547 bp, Homo sapiens
  misc_feature: GYAE6OF01B6QPP.46.67.G01.1.454.CMB.1.raw
  modified_base (334)..(334): a, c, t, g, unknown or other
  misc_feature (334)..(334): n is a, c, g, or t
  modified_base (523)..(523): a, c, t, g, unknown or other
  misc_feature (523)..(523): n is a, c, g, or t
  modified_base (537)..(537): a, c, t, g, unknown or other
  misc_feature (537)..(537): n is a, c, g, or t
  modified_base (543)..(543): a, c, t, g, unknown or other
  misc_feature (543)..(543): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggaaggggctggaatacattggaagtgtctctcatagtggaggttcctattacagtccgtctctcaagagtcgagtcaccatatctctggacacgtccagcaatcagttttcccngaagatgagttctgtgaccgccgctgacacgggcttttatactgtgcgagagacggctattatgtatttttggagttggttatttcgactaccctagatcggacggggctcgaccccgtggggccagggtaatacgtggtcaccgtctccttagcctccaccgacgggcccatccggtccttcccccgnggtccaccctcccnccaagngccc

SEQ ID NO: 138203 - DNA, 599 bp, Homo sapiens
  misc_feature: GYAE6OF01DQCAP.46.67.G01.1.454.CMB.1.raw
  modified_base (216)..(216): a, c, t, g, unknown or other
  misc_feature (216)..(216): n is a, c, g, or t
  modified_base (242)..(242): a, c, t, g, unknown or other
  misc_feature (242)..(242): n is a, c, g, or t
  modified_base (257)..(257): a, c, t, g, unknown or other
  misc_feature (257)..(257): n is a, c, g, or t
  modified_base (364)..(364): a, c, t, g, unknown or other
  misc_feature (364)..(364): n is a, c, g, or t
  modified_base (472)..(472): a, c, t, g, unknown or other
  misc_feature (472)..(472): n is a, c, g, or t
tcagactagcagtacacgaccggtgctcgatttagagtatacatattggggtttgggggacctcctgtgcaagaacatgaagcacctgtggtttgtcctcctgctggttggcagctccagatgggtcctgtccctggtgcaactgcaggagtcgggcccagactgggtgaggccttcggagaccctggtccctcacctgccgcttgtctctggtcnccctccatcagtagttggtttctcgnggggctgggtccggnaggccgtccgaggggaaggggcctggaatacgattggaagtgtctctcatagtggagttcctatacagtccgtctctcaagagtcgagtcaccatatctcgtggacncgtacagctaatctacgttttccctagaaacgtatacggagtttcctggttacgacccgtcgcttagaacgtacgggtcgttttaattacgtggtgcgagagacggtnttaagtatgttattttgggagttaggtttattcgtaactacccgtaagtacgtcggaccggggtctccggtacccggtgggaccctagggacttacgcggtccaccgttctccgttagccctacccg

SEQ ID NO: 138204 - DNA, 590 bp, Homo sapiens
  misc_feature: GYAE6OF01B32ZQ.46.67.G01.1.454.CMB.1.raw
  modified_base (394)..(394): a, c, t, g, unknown or other
  misc_feature (394)..(394): n is a, c, g, or t
tcagactagcagtacacgaccggtgctcgatttagagtatacatattgggtttggggagtctcggtcaggacacagaatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccaggacgccctaagctacctaatctatgctgcatccagtttgactaaaggtggggtcccagtcggaggttcagtggcagtggatcgtggacagtatttcactcctcacatacagtaatctgacaacgtgaatntttgactaatttacttacttagtacaaactagtaattaactaagtttcgtttacggaccgtaaagggtacaaccgtaactaaacctaaaagttaaaccgaacgttagtacggtacctaggacctaaccgtagttcttacggttcctttactacttaccccgtttacccggacccttaatccgttagtaacttaacg

SEQ ID NO: 138205 - DNA, 589 bp, Homo sapiens
  misc_feature: GYAE6OF01EMYHI.46.67.G01.1.454.CMB.1.raw
  modified_base (336)..(336): a, c, t, g, unknown or other
  misc_feature (336)..(336): n is a, c, g, or t
  modified_base (341)..(341): a, c, t, g, unknown or other
  misc_feature (341)..(341): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccaggggaaggggctggaatacattggaagtgtctctcatagtggaggttcctattacagtccgtctctcaagagtcgagtcaccatatctctggacacgtccagcaatctagttttcccngaagntgagttctgtcgaccgccgctgacgtacgggtcgtttatactgtgcgagagacggctattagtgtattttggagttggttatttcgactaccgtagacgtcggacggggtctccggaccccgtggggaccgtaggggaacttacgtcggtccaccgttctccgttacgccctacccgaccgaacgggtcccagttcccgggtaccttcccccgtcggtccctacccctccctaccgaacgcgtacccg

SEQ ID NO: 138206 - DNA, 565 bp, Homo sapiens
  misc_feature: GYAE6OF01DWYZP.46.67.G01.1.454.CMB.1.raw
  modified_base (442)..(442): a, c, t, g, unknown or other
  misc_feature (442)..(442): n is a, c, g, or t
  modified_base (447)..(447): a, c, t, g, unknown or other
  misc_feature (447)..(447): n is a, c, g, or t
  modified_base (452)..(452): a, c, t, g, unknown or other
  misc_feature (452)..(452): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtcgcctccatcagtagtggtttcttcgtggggctgggtccgcagctccgagggagggctggaatacattggaagtgtctctcatagtggtaggttcctattacagtccgtctctcaagagtcgagtcaccatatctctggacacgtccagcaatctacgttttcccagaagtatgtagttctggtcgaccgcgctagacgtacgggtcgtttattactggtgcgagagacgtntattntgttnttttaggagttggtttactttcgactaccgtagtacgtcggcggggtctccggacccggtggggacctagggtaactacgtcggtcctaccgtcctaccttcgcccgtacccg

SEQ ID NO: 138207 - DNA, 614 bp, Homo sapiens
  misc_feature: GYAE6OF01ED308.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggccccacgactggtgaggccttcggagacccctgtccctcacctgcgctgtctctggtgcctccatcagtagtggtttcttcgtggggctggggtccggcagcctcccgaggggaaggggctaggaatacattgggaagtgtctctcatagtggaggttcctattacagtccgtctctcaagagtcgagtcaccatatctctggacacgtccagcaatctagttttcccagaagtattgagtttctgtcgaccgtccgcgtgaccgtacgggtcgtttattactgtgcgagagcggtatatttatgttagttttggagtttggtttactttacgtacctacccgtagacgtcggacggggctccggacccggtcggggaccgtagggtaactacgtcggtccaccgttcctccgttacgccctaccaccgacgggtcccacggttccggtccccttcccccgtacgtcccctaccccttccctacctaacgcgtaccccg

SEQ ID NO: 138208 - DNA, 673 bp, Homo sapiens
  misc_feature: GYAE6OF01C4674.46.67.G01.1.454.CMB.1.raw
  modified_base (172)..(172): a, c, t, g, unknown or other
  misc_feature (172)..(172): n is a, c, g, or t
  modified_base (293)..(293): a, c, t, g, unknown or other
  misc_feature (293)..(293): n is a, c, g, or t
  modified_base (349)..(349): a, c, t, g, unknown or other
  misc_feature (349)..(349): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtcncctccatcagtagtggtttctcgtggggctgggtccgcagcctccgaggggagggctaggaatacagttggaagtgtctctcagtagtggtaggttcctattacagtccgtctctacaagngtcgagtccaaccatatctctggaccacgtcagtcaatcgtacgttttccagaatntgtagttcgtgtcgaccgccgtctacgacgtacgggttactttagtacgtggtacgcgagacgacgtactatttagtagtttagttttagggagtttaggtttatttaccggtacctaccgttaggtacgtacgggacggggtcctaccggaccccggtggggaccgaagggtactacggtcggtacctaccggttctcccgttacgaccccgttaccgaaacccggtaccgggtacccctacggtttccccgggttacccctttccccccggtcgggtacccctacccccttacccgtacccgaaacggtccggtaacccccg

SEQ ID NO: 138209 - DNA, 663 bp, Homo sapiens
  misc_feature: GYAE6OF01E0PGB.46.67.G01.1.454.CMB.1.raw
  modified_base (287)..(287): a, c, t, g, unknown or other
  misc_feature (287)..(287): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccgcagctccgaggggagggctggaatacattggaagtgtctctcatagtggaggttcctattacagtccgtctctcaagngtcgagtcaccatatctcgtggacacgtccagcaattctacgttttcccagaagtatgtagtttctggtcgacccgccgtctcgaacgtaccgggtcgttttaattacgtggtcgacggtaggacgacggtacttagtttatggttaagttttgggagtttggtttacttcggtaacctacccgttagtacgtccgggacgggggtcctacccggaccccggtggggacccgtagggtaaccttacggtcggtccgtacccgttccttaccttaccggtccctacccgaacccgaaccgggtcccctaggttccccggttcccttccccccgtcggtacccctacccccttaccctacccgaaagccggtaccccg

SEQ ID NO: 138210 - DNA, 755 bp, Homo sapiens
  misc_feature: GYAE6OF01EA2M4.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtcgcctcatcagttagttggtttcttcgtggggctgggtccgcagctccgaggggagggctaggaatacagttggaagttgtctctcagttagtggtacggttcctattacgacgtccgtctctacaagacgtcgacgtccacctatacttctcgtcggacaccgtcagactaattcgtacgttttccagtaagtatagtacgttcgtcggtcgaccgtccgtcgtacgaaccgtacgggttacgttttaacgttacgtggtacgacggtaagtacggtaaccggtactttaagtttagttacggtttaagtttttgggtaagtttcggtttaacgtttaccggaactaccccgttaggtaccggtaccgggtaccggggtccgtacccgggtaccccgggttacggggacccggtaacggggttaacgttaccggttcggtacccttacccggttccgttacccgtaccgtccccgtacccggaacccgtaccgggtacccctaccggtttccccggttcccccgtttacccccggtaccggtacccctacccccgttaccccgtacgaaccggtccgtaccccg

SEQ ID NO: 138211 - DNA, 577 bp, Homo sapiens
  misc_feature: GYAE6OF01CYMVT.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagttggtttcttcgtggggctgggtccggcagcctcccgaggggaagggctggaaatacagttggaagtgtctctcatagtggaggttcctattacagtccgtctctcaagagtcgagtcaccatatctctgacacgtcagcaatcagttttcccagaagactgagttctgtcgaccgcgctgacgtcgggtctttaagttactgtgcgagagcggctatatgtattttggagttggttattcgactacctagagtcggacgggctcggaccccgtgggaccgagggactacgtggtacctaccgtctacctacgccctaccgaccgaaccggccccacgttcccggtccccttcccccgtaggtccctacccctccctaccaacggcgtacccg

SEQ ID NO: 138212 - DNA, 591 bp, Homo sapiens
  misc_feature: GYAE6OF01ARBGI.46.67.G01.1.454.CMB.1.raw
  modified_base (219)..(219): a, c, t, g, unknown or other
  misc_feature (219)..(219): n is a, c, g, or t
  modified_base (230)..(230): a, c, t, g, unknown or other
  misc_feature (230)..(230): n is a, c, g, or t
tcagactagcagtacacgaccggtgctcgatttagagtatacatattgggtttggggtaggtctcggtcaggacacagcatggacatgagggtcccgctcagctcctggggctcctgctactctggctccgaggtgccagatgtgacatcgagctgacccagtctccatccctccctgtctgcaaccggtgggagacagtgcaccatcacttgccgggnaagtcggaacnttgacacctatttaaatggtatcaacatagacagggacgaccctaagctcctaagtctatacgctgcatccagtttgacaaggttgggcccagtcgaggttcagtgacagtgagtcgtgggacagtatttcactctctaccatcaagtaatctagtccaagtcgtaagtattttcgactaaacgtttatacttgtacctaactagaaacttactaagtttacgtttcggaacgaacgggtaactaccgtaaacttaaactaaattaaaccgtaacgtagtacggacttaggacccaacgttattccgttacgttaccgtttacaaccgtttcctaccccgtacctaactccgtacgtaacc

SEQ ID NO: 138213 - DNA, 713 bp, Homo sapiens
  misc_feature: GYAE6OF01AUU12.46.67.G01.1.454.CMB.1.raw
  modified_base (282)..(282): a, c, t, g, unknown or other
  misc_feature (282)..(282): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtgggctgggtccggcagctcccagggaaggggctggaatacagttggaagtgtctctcatagtggtaggttcctattacagtccgtntctcgaagagtcgacgtcacctatatctctggacacgtccagcaatctagttttccagaagtatgacgttctgtcgaccgccgctagaccgtacgggtcttttaacttacgtggtcgacggtaggacggtacggtcttaagtttagttagttaggttttttgggaaggtttaggtttaacgtttaccggtaactaccccgttaggtaacggttaccgggtaaccgggggtccgtacccggaccccgttgggggaccccgtaaggggtaaccttaacggttacggtacccgtacccggttccgttacccgttaccgacccgtacccgtaacccggtaacccgggtacccctacggttaccccggttccccgtttaccccccgtaccggtaccccgtaccccgtacccttacccgaaccggtaccgtaccccg

SEQ ID NO: 138214 - DNA, 606 bp, Homo sapiens
  misc_feature: GYAE6OF01BESLI.46.67.G01.1.454.CMB.1.raw
  modified_base (192)..(192): a, c, t, g, unknown or other
  misc_feature (192)..(192): n is a, c, g, or t
  modified_base (227)..(227): a, c, t, g, unknown or other
  misc_feature (227)..(227): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttggccggcaagtcgaacnttgacactattaaatgtatcaacatagaccagggacggccctaagctacctaatctatgctgcatccagtttgacgtaaagtcgggtacctagtcggtagttcagtcggctaggtggatcgtgggactagtactttcactctacacctatcaagtatctagctaacgtgaagtatttagactaaactttattaactacgtacaactagtaacttaggactaagtttcgtttaccggaaccgtaaaggggtacctaacggtaaacttaaccgtaaaacgttaaaaccgaacgttacgggtacggtaacgttacggaacctacccgtagttccttacgttcccttaactacgttcccttaccccgtctaacgtcgttaacg

SEQ ID NO: 138215 - DNA, 633 bp, Homo sapiens
  misc_feature: GYAE6OF01C1YI6.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacactatttaaatgtatcaacatagacagggacgccctaagctcctaatctatgctgcatcctagtttgcaaaggtcgggtcccatcgaggttcagtgcagtgatcgtgggacagtatttcactctcactatacagtaatctgactaacgtagaagttattttagacctaatttacttactagtaccaaactagtaaattaacgtaagtttcggtttttaccggaacgtaaacggggtaacctaaccggtaaacttaaacttaaaaacgttaaaccggtaacgttacggttacggtaccttaggtaaccctaaccgtactttccgtttaacggttaccttttaacccgtaaacctttccccgtttacccccggtacccttaacgtttccgtacggttaaacc

SEQ ID NO: 138216 - DNA, 598 bp, Homo sapiens
  misc_feature: GYAE6OF01CTUH6.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatgtatcaacatagaccagggacggccctaagctcctaatctatgctgcatccagtttgacaaaggtgggtcccatcgaggttcagtggcagtggatcgtgggacagatttcactctcaccatcagtaatctgacaacgtgaagtattttagactaactttattactgtacaactaagtaatttaactaattcgttttaccggaaccgtaagggtaacctaaccgtaacttaaactaaaattaacggtaaacttaggtacggaccttaggaccctaacccgtattaccgttcggtttacctttacctaactttccccgttacccccggtaccttaaccttccgttacgttaaccg

SEQ ID NO: 138217 - DNA, 561 bp, Homo sapiens
  misc_feature: GYAE6OF01C4APX.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacgttgccgggcaagtcggaacattgactaccttattaattgtatcaacatagaccagggacgccctaagctcctaatctatgctgctatcctagtttgacgtaaaggtcggggtaccccagtcggtaggttcagtggcaggtggatcgtgggacagtatttcactctcacatcagtatctgactaacgtagtaagtatttgacttaactttattactgtacaatagtaattactagttgtttacggaccaagggacaacgtaacttaactaaattaacgaacttggtagcctagaccacctattccgttcgttcctttctaccttcccgttaccccgacctacttcgtagtaac

SEQ ID NO: 138218 - DNA, 629 bp, Homo sapiens
  misc_feature: GYAE6OF01CXTAX.46.67.G01.1.454.CMB.1.raw
  modified_base (172)..(172): a, c, t, g, unknown or other
  misc_feature (172)..(172): n is a, c, g, or t
  modified_base (421)..(421): a, c, t, g, unknown or other
  misc_feature (421)..(421): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtcncctcatcagtagtggtttctcgtgggctgggtccggcagcctacccgaggggaacggggctaggaatacgagtttagggaagttgtctctcgtagttaggtggtaggttccttaagttacaggtccgttactccttacaagtacgtacgagttccaccatactctcgtgacacgtcagcaatctacttttccagaacgtatagtacgttctgtcgaccgccgctgacgtacggtcgtttaatcgtgtgngagagacgtctattatgttagtttggagttaggttattacgactaccgtagacgtcggtacgggcctaccggacccggtgggaccgtaagggtaacgttacgtcggtacgtacccgttctccgttacgacccttacccgaaccgacggtacccacggttccgttccccgttccccgtcggtcccctaccctcccaccacgcgtacccg

SEQ ID NO: 138219 - DNA, 535 bp, Homo sapiens
  misc_feature: GYAE6OF01BCJD2.46.67.G01.1.454.CMB.1.raw
tcagactagcagtacacgaccggtgctcgatttagagtatacatattgggtttgggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacaccttattaaattggtatcaacatagaccagggaccggccctaagctcctaatctatgctgcatccagtttgcaaaggtgggtcccatcgaggttcagtggcaggtggatcgtgggacagtatttcactctcaccatcagtaatctagcgaacgtagtaatatttcgactaactttattactgtacaacagtaattactaattgttacggacaacgggactaacgtactaacaaacttaacgacttgtggactagacacctatcttcgttacttcacttccttacccactactcctggtac

SEQ ID NO: 138220 - DNA, 578 bp, Homo sapiens
  misc_feature: GYAE6OF01EPQVM.46.67.G01.1.454.CMB.1.raw
  modified_base (210)..(210): a, c, t, g, unknown or other
  misc_feature (210)..(210): n is a, c, g, or t
  modified_base (293)..(293): a, c, t, g, unknown or other
  misc_feature (293)..(293): n is a, c, g, or t
  modified_base (512)..(512): a, c, t, g, unknown or other
  misc_feature (512)..(512): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagacccctgtccctcacctgcgctgtctctggtgcctcatcagtagtggtttcttctggggctgggtccggnagctcccgaggggaaggggctggaatacattggaagttgtctctcagtagtggtaggttcctattacagtccgtctctcaagngtcgagtcaccatatctctggacacgtccagcaatctacgtttttcccaggaacgatgagtttctgtcgaccgccgctgacgacgggtctttaattacgtgtgcgagagacggtctattatgtagttttggagttgtttagtttcgactacccgtagtagtcgggacggggctccggacccgtgggccgaagggtactacgtggtccacgtctcgtacncctcaccgtaacggcccagtccggtccttccccgtacgccctacccctccaccctaagcgtacccg

SEQ ID NO: 138221 - DNA, 1068 bp, Homo sapiens
  misc_feature: GYAE6OF01CH83M.46.67.G01.1.454.CMB.1.raw
tcagactagcagtacacgaccggtgctcgatttagagtatacatattgggtttggggagtctcggtcaggacacagcatggacatgagggtccccgctcagctccgtggggctcctgctacgtctggctccgaggtcgccagatgtgacatcgagctgacccagtctccactcctcctgtctgaccaaccggtgggacacaggtcgtccacctatcgacgttcggcccgggtactaaggtccggaaactagtttacggaacctaacccgtttaagtttttaaaaacgttcggttaacttaaccgtaaaaccgtaacgttaaccgggaacccggaaaccgggggaaccccggtaccccccgttaaaagggtacccctttaaccctttaaacgttaccttaacgttcgggtaccgttacggaccttaaccgttacccgttaaggtttttacggaaccgttaaaaacggggtttccgggggttaacccctaagtttacccgggttaacgggtttaccgaagggttaccgggaccgtaagggttcgggtaacgttaccggttacggggtaaccgtaacggttaactttttacccgaaccctttacccgtaaccgtaaaccccgttaacgttaccgtaaacggttaacgttaccggtaacgggtaaccgtaaacgggtttaacggtaaacggttttaacgtttttaccggaaaccgtttaaaccgttttaaacgtttaccggttaacggttaaacctaaaaccgttaacggttaaaacgtttaaccgtttaaacggttttaccgggtttttaacccggggaaacccggttaaaacggggtaacccgtaaaccgggtttaaaacccgtttaaaacccgtttaaaaaccggttttaaaacccgggtaaacccggtttacggggttaccggggttaacccgttaaccgggtaacccgttaaaccccgttaacggtttacccgtttaccgggtttaccccctttaaccgttaacccgtttacccccggtttaacccccggacccgtttaaccgtttacccggttaccgttaaacccg

SEQ ID NO: 138222 - DNA, 579 bp, Homo sapiens
  misc_feature: GYAE6OF01BC15Q.46.67.G01.1.454.CMB.1.raw
  modified_base (193)..(193): a, c, t, g, unknown or other
  misc_feature (193)..(193): n is a, c, g, or t
  modified_base (228)..(228): a, c, t, g, unknown or other
  misc_feature (228)..(228): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatccctccctgtctgcaaccgtggganacagtgtcaccattcacttgccggcaagtcgaacntgacactatttaatgtatcaacatagacagggaccgccctaagctacctaatctatgctgcatccagtttgacgtaaggtcgggtcccagtcgaggttcagtggcagtggatcgtagggactagtactttcactctaccacctatacagtaactctagacgtaacgtagtaaagttattttagtaaactttattactagtactaagtaagtaattaactaatttagtttacggaccgtaagggtaaccaacgtaaataacgtaaaagttaaaccgaacttaggtagtactacgacctaaccgtattcgttacgtcttacctacttcccttacccgactatctgtattaccg

SEQ ID NO: 138223 - DNA, 584 bp, Homo sapiens
  misc_feature: GYAE6OF01DIU6P.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccggaggtgccagatgtgacatcgagctgacccagtctccatcctcctgtctgcaaccggtgggagacagtgtcaccatcacttggccgggcaagtcggaacattgacacttatttaaatggtatcaacatagaccagggaccgccctaagctacctaatctatgctgctatcctagtttgactaaaggtcgggtacccagtcgaggttcagtggcaggtgatcgtagggactagtatttcactctcaacctatacagtaatctgacaacgtagtaagttatttagactaactttattactagtacaacaagtaattaactaagtttcggtttacggaccgtaaagggacctaacgtaacttaaactaaaagttaacgaacgttggtagctacgacctaacctattcttgttacctttacaacgttcccttacccgaccttacttcgttgtaaaccg

SEQ ID NO: 138224 - DNA, 609 bp, Homo sapiens
  misc_feature: GYAE6OF01B3JQD.46.67.G01.1.454.CMB.1.raw
  modified_base (599)..(599): a, c, t, g, unknown or other
  misc_feature (599)..(599): n is a, c, g, or t
  modified_base (603)..(603): a, c, t, g, unknown or other
  misc_feature (603)..(603): n is a, c, g, or t
tcagactagcagtacacgaccggtgctcgatttagagtatacatattgggtttggggagtctcggtcaggacacagcatggacatgagggtccccgctcagctcctggggctcctgctactctggctccggaggtgccagatgtgacatcgagctgacccagtcctccatccctccctgtctgccaaccggtgggagacagtcgtccaccatcacgttggccgggacaagtcggaacattgactaacttatttaaattggtatacaacatacgaccgagggaccggaccctaagcctacctaatcttatcgctgctactcctagtttagacgtaaaggtcgggtacccaagttcggtaggttcgacggttggctaggtggtatcggtagggactagtactttcactctacaccatacagttaactcgtacacgtaacgtgtaaattatttacgacttaactttattacgtagtacaaactaagtaaacttactaagttacgtttacggacgtaaggactaacgaactaaactaaacttaacgtaactggtagtacgtacgaccgtctaatcttctacttacacgttcccctccgtactntccngttacg

SEQ ID NO: 138225 - DNA, 760 bp, Homo sapiens
  misc_feature: GYAE6OF01DY74N.46.67.G01.1.454.CMB.1.raw
tcagactagcagtacacgaccggtgctcgatttagagtatacatattgggtttggggagtctcggtcaggacacagcatggacatgagggtccccgctcagcctcctggggctcctgctactctggctccggaggtgccagatgtgacatcgagctcgacccagtcctccactccctcctgtctgaccgtaaccggtgggacgacagtcgtccaaccatctaccgttggcccgggtagaaacggtccggaaactacgtttacgaacctaacctttaattttaaaacgtggtaactacaacaagtacgaaccgacgggacccgaccctaagcctaccttaactctacgtgcctgtacctacgttaccgtaggtttacgaacgtaacggttccgggtaccacgtacggtacggttacgtacggtcggagtaggtgacgtcggtagggactaggttcttcgaccttcgtacctactacgttactaacgttacgtccgtacgtaacgtaacggttagttaaacgtttacgttttaacgaacctttaaagtttaacttacgtaacgttaaacgtaaactaagttaaacctttaagttaacgtttaccgggttaccggaaaccgtaacgggtaaccctaaccgttaaactaaacgttaaaacgttaacggacttaggacgtacccgtaacgtacctaccgtacttcgttacggttaccttaccgtacccttaccccgttacccgaacttacttgtccgttaaaccg

SEQ ID NO: 138226 - DNA, 646 bp, Homo sapiens
  misc_feature: GYAE6OF01C9X8T.46.67.G01.1.454.CMB.1.raw
  modified_base (192)..(192): a, c, t, g, unknown or other
  misc_feature (192)..(192): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtcctccatcctcctgtctgcaaccgtggganacagtcgtcaccatcacgttcggacccgggcaaggtcggaactatttcgacctaccttaattttaaattggtaatacaacatagaccgagggaccgaccctaagctactaatctatgctgctatcctagttgacgtaaggtcgggtaccctagtcggtacgttcgaggtggacgtaggtgaacgtcgtagggtactagtacttttaccgacttctacgaccctatactaagttaactcgtacgactaacgtagtaagttattttacgacttaacttacttactacgtacaaacgtagtaattaacgtagtttcggtttacgaccgtaacggtaacctaacgtaacttaaacgtaaacttaaccgtaattcggtagtaccttagaccctaacgtacgttacgttcgttacttaccgtacgttccccttaccccgtactacgttccgtagtaaccg

SEQ ID NO: 138227 - DNA, 543 bp, Homo sapiens
  misc_feature: GYAE6OF01EEJB1.46.67.G01.1.454.CMB.1.raw
  modified_base (402)..(402): a, c, t, g, unknown or other
  misc_feature (402)..(402): n is a, c, g, or t
  modified_base (502)..(502): a, c, t, g, unknown or other
  misc_feature (502)..(502): n is a, c, g, or t
  modified_base (536)..(536): a, c, t, g, unknown or other
  misc_feature (536)..(536): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatccctcctgtctgcaaccgtgggagacagtgtcaccatcacttgccgggcaagtcgaacatgacacttatttaatgtatcaacatagaccagggaccgccctaagctcctaatctatgctgcactcctagtttgactaaaggtcgggtacccagtcgtaggttcgaggtggcagtggactcggtagggacagtattcactctcaaccatcaagtatctgacgaacgtagtaagtntttagactaacttattactgtactaacagtaattactaagttcggtttacgacgtaaggactacgaactaacaaacttacgaactgtcgctagaccactntcgttcgtcttactacttccttcccgactacttntcgtaac

SEQ ID NO: 138228 - DNA, 637 bp, Homo sapiens
  misc_feature: GYAE6OF01C1C13.46.67.G01.1.454.CMB.1.raw
  modified_base (212)..(212): a, c, t, g, unknown or other
  misc_feature (212)..(212): n is a, c, g, or t
  modified_base (252)..(252): a, c, t, g, unknown or other
  misc_feature (252)..(252): n is a, c, g, or t
  modified_base (339)..(339): a, c, t, g, unknown or other
  misc_feature (339)..(339): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtcccctcacctgcgctgtctctggtncctccatcagttagtggtttcttgtggggctgggtccggnagcctccgagggaggggctggaatacagttgggaaagtgtctcgtcagtaggtggtaggtttcctattacagtcccgtctctcaagngtcgagtccaccatactctcgtggacaccgtccagcaacttcctacgtttttacccaggtaagattaggtacgtttctaggtcgaacccgccgtctaggaccgtacggggtcgttttaattacttggtcgacgaggacgtacggtcttagtttatgttattttggtagttggtttattcgactaccgttagacgttcggaccgggggtcctacccggtacccggtgggggacccgaagggtaacgttaccggtcgggttaccctacccggttccttacccgttccgccctaaccccgg

SEQ ID NO: 138229 - DNA, 630 bp, Homo sapiens
  misc_feature: GYAE6OF01DU5LC.46.67.G01.1.454.CMB.1.raw
  modified_base (195)..(195): a, c, t, g, unknown or other
  misc_feature (195)..(195): n is a, c, g, or t
  modified_base (219)..(219): a, c, t, g, unknown or other
  misc_feature (219)..(219): n is a, c, g, or t
  modified_base (229)..(229): a, c, t, g, unknown or other
  misc_feature (229)..(229): n is a, c, g, or t
tcagactagcagtacacgaccggtgctcgatttagagtatacatattggggtttggggagtctcggtcaggacacagctagtggacatgagggtccccgctcagctccgtggggctcctgctactctggctccgaggtgccagatgtgacatcgagctgacccagtctccatcctcctgtctgcaaccgtggganacagtgtcaccatcacttgccggnaagtcgaacnttgacacttatttaatgtatcaacatagaccagggacgccctaagctctaatctatgctgcatcctagtttgcaagtcgggtcccagtcgaggttcagtgcagtgatcgtgggacagtattcactctcaccatcagtaatctcgacgtacgtagtaacttatttacgacttaaactttattacgtcgtacaacgtagtaaatttaaccgtaatttggttttacggaccgtaaaggggtacctaacggtaacttaaacgtaaaacgttaaaccgtaacgttacgggttacggtaccgttacggtacctaaccgttaacttacgtttaccggttaccgttttacctaaccgttttaccccgtttacccccggaacctttaacgttcccgttaggttaaacccg

SEQ ID NO: 138230 - DNA, 604 bp, Homo sapiens
  misc_feature: GYAE6OF01CBUCG.46.67.G01.1.454.CMB.1.raw
  modified_base (172)..(172): a, c, t, g, unknown or other
  misc_feature (172)..(172): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggcctttcggagaccctgtccctcacctgcgctgtctctggtncctccatcagtagtggtttcttcgtggggctgggtccggcagctcccgaggggaagggctggaatacattggaagtgtctctcatagtggaggttcctattacagtccgtctctacaagagtcgagtcaccatatctctggacacgtccagcaatctacgttttccctagaagatgtagttctgtcgaccgccgctcgacgtcgggtctttattactgtcgacgagagacgtcttattagttgttagttttggtagttaggtttactttcgacctaccgtagtacgtcggacggggctccggaccccgtgggccgaagggtactacgtcggtcgtaccgtctccgttacgccctacccgaccgacggtcccacggttcccggtcccttccccccgtcggaccctacccctacccgtaccaacgccgtacccg

SEQ ID NO: 138231 - DNA, 541 bp, Homo sapiens
  misc_feature: GYAE6OF01ADAE2.46.67.G01.1.454.CMB.1.raw
  modified_base (192)..(192): a, c, t, g, unknown or other
  misc_feature (192)..(192): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccgggcaagtcggaacattgacacctatttaaatgtatcaacatagaccagggacgccctaagctcctaatctatgctgcatccagtttgcaaagtcgggtacccagtcgaggttcagtggcagtggatcgtgggacagtatttcactctcacatcagtaatctagcaacgtgaagtatttagactaacttattactgtacaacagtaacttaactaagttcgtttacgaccgtaaggactacgtaactaactaaattaacgaacgtgtacgactacgacctaacgtatcgtcgttaccttactacttccttacccacctactctgtaac

SEQ ID NO: 138232 - DNA, 695 bp, Homo sapiens
  misc_feature: GYAE6OF01CEXK5.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcgagtagttggtttctcgtggggctggggtccggcagccgtccgagggaagggctggaatacgagttaggaagtgtctctcagtagtggtagttccttattacgtagtccgtcgtctacgaagtacgtcgaagtcaacctagtactcgtactaggacacgttccaacgactaattccgttaacgttttcccgaaggtaacgtagtacgttacgtttcgtagtaccggacccgccggtacgtacggtaccggtacggggttaccttttaagtaccgttggtacggacggtagacggtacgtacttaagtttagttggttagtttttgggagtttagggtttaacttcgtaacctaccgttaggtacgtccggggtaccggggccgttacccggaccccgggttgggaccggtaacgggtaacctacggttacggtacccgtacccgttaccgttcccggtaccgtcccgtaaccccgg

SEQ ID NO: 138233 - DNA, 783 bp, Homo sapiens
  misc_feature: GYAE6OF01CGFGM.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctaacctgcgctgtctctggtgcctccatcagtagtggtttcttctggggctgggtccgcagctccgagggagggctaggaatacattggaagtgtctctcatagtggaggttcctattacagtccgtctctcaagagtcgagtcaccatatctctggacacgtccagcaattctacgttttcccagaacgtattagtacgtttctgtacggacccgtccgtcgtcggaaccgtacggggttacttttaacgttaacgttggtcggacggtaaggacggtacgggtacttaagtttacgttaggtttaagttttttagggtaggtttacgggttttacgtttaccggtaaccttaacccgttaaggtacgttacccgggtaacgggggtccgttaccccgggtacccccggttcgggggaccccggtaaggggtaaaccttaccgggttacgggttacccgttaacccggttcccgttacccgtttaaccgtcccccgttaaccccgaaccccggtaaacccggggtccccctaaccggttccccggttcccccgtttaccccccgttccgggtaccccccttaaccccccgttaccccgtaccccgtaaccggacccgtcccgtacccccggg

SEQ ID NO: 138234 - DNA, 678 bp, Homo sapiens
  misc_feature: GYAE6OF01C86IX.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaaccggtgggagacagtgtcaccatccacgttggccgggacaaggtcggaacattcgactaaccttattttaatggtatcaaacatagaccgagggaccggaccctaagctactaatctatgctgctatccgtagtttcgacgtaaggtcgggtcccagtcggtaggttcaggtcggcgtaggtgagtcgtagggaactagtaactttcacttctaccgaactactactaagtaactccgtagaccgtaacgtagtaaagttcttttagaactaacgttttattacgtacgtaactaacgtaagtaaactttactaagttttcggtttaccggaaccgtaaacgggtaacctaacggtaaacttaaacgtaaaaacgtttaacgaacggtttcggtaacggtaccgttaacgtaccctaaccgtatttacccggtttgtttaccctttactaccgtttccccgtttaccccgaccctttaacgtcgttacgtaaaccg

SEQ ID NO: 138235 - DNA, 604 bp, Homo sapiens
  misc_feature: GYAE6OF01AQQG0.46.67.G01.1.454.CMB.1.raw
  modified_base (192)..(192): a, c, t, g, unknown or other
  misc_feature (192)..(192): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccgggcaagtcggaacattgacacctatttaaatgtatcaacatagaccagggaccgccctaagctacctaatctatgctgcatcctagtttcgactaaaggtcgggtcccagtcggagttcaggtggcaggtgatcgtagggactagtatttcactctacacctatcaagtaatctagactaacgtgaaagttattttgacttaactttattactcgtacaactagttaaactttacaagtttcggttttacgaccgtaaggtacctaacgtaaccttaaactaaaacgttaaccgaacttggtacggtacctacggtacctaaccgtattacgttacgtttaccttaccgtaaccttcccgttaccccgaccttaacgttccgttgtaaac

SEQ ID NO: 138236 - DNA, 594 bp, Homo sapiens
  misc_feature: GYAE6OF01CRQUS.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagacagggacgccctaagctcctaatctatgctgcatccagtttgacaaagtgggtcccatcgaggttcagtggcagtgatctagggacagatttcactctcaccatcagtaatctgacaacgtgaaagtattttgactaactttacttactagtacaaacgaagtaaatttacaaagttggtttttaccggacccgaaagggtaccaacggtaaacctaacgtaaaaattaaaaccggaaaccgttaggttacggacgttacgacctaaccctaattccttcgttacctttccaactttccccgtttaccccgaccccttaagtccttacggtaaac

SEQ ID NO: 138237 - DNA, 505 bp, Homo sapiens
  misc_feature: GYAE6OF01ECU31.46.67.G01.1.454.CMB.1.raw
  modified_base (401)..(401): a, c, t, g, unknown or other
  misc_feature (401)..(401): n is a, c, g, or t
  modified_base (444)..(444): a, c, t, g, unknown or other
  misc_feature (444)..(444): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacactattaaatgtatcaacatagaccaggacgccctaagctcctaatctatgctgcatccagtttgcaagtgggtcccagtcgaggttcagtggcagtggatcgtggacagtatttcactctcaccatcagtaatctgacaacgtgaagtatttgactaattattactntacaacagtaattacattgtttcgacgaaggactacgactaanaaattaacgatgtagctagcactatcttcgtcttacacgttcctacccgtactctctgtac

SEQ ID NO: 138238 - DNA, 585 bp, Homo sapiens
  misc_feature: GYAE6OF01AKI5T.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccgagggaaggggctggaatacattggagtgtctctcatagtggaggttcctattacagtccgtctctcaagagtcgagtcaccatatctctggacacgtccagcaatcacgttttcccagaagatgtagttctgtcgaccgccgctggacgtacgggtcgttttaagttactggttggacgtaggacggacggtcttattacgttgttagtttttggagtttcggtttatttcgacctacccgtagtacgtcgggaccggggtcctccggaccccggtggggcccaaggggtactacgtcggtccaccgtcttccgtagtccctacccg

SEQ ID NO: 138239 - DNA, 571 bp, Homo sapiens
  misc_feature: GYAE6OF01CEQY2.46.67.G01.1.454.CMB.1.raw
  modified_base (337)..(337): a, c, t, g, unknown or other
  misc_feature (337)..(337): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccgagggaaggggctggaatacattggaagtgtctctcatagtggaggttcctattacagtccgtctctcaagagtcgagtcaccatatctctggaccacgtccagcaatctacgtttcccngaagatgagttctgtcgaccgcgtctgacgtacgggtcgtttatactgtgcgagagacggctattatgtagttttgagttgttattcgacctaccgtagatcggacggggctccggacccgtgggccgagggactacgtcggtctaccgtcttcctacgccctaccacccgaacggccccacgttccggttcccttcccccgtcgtccctacccctccctaccaacgcgtcccg

SEQ ID NO: 138240 - DNA, 540 bp, Homo sapiens
  misc_feature: GYAE6OF01EH7RO.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacgccctaagctcctaatctatgctgcatccagtttgcaaagtgggtcccatcgagttcagtggcagtgatcgtgggacaggtattcactctacgaccatcagtaatctagacaacgtgaatatttgactaacttattactgtacaacagtaatttactaattgtttacggaccaagggtacaacgtaactaactaaattaaacgaacgtagtggactgtacacctattacgtgttccttagacttccttaccccgacctacttctagtaaccg

SEQ ID NO: 138241 - DNA, 524 bp, Homo sapiens
  misc_feature: GYAE6OF01A7MT2.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatcccagtttgcaaagtggggtcccatcgaggttcagtggcagtggatctgggacagatttcactctcaccatcagtaatctgcaacgtgaagtattttgctaactttattactgtcaacagaatttacaattcgttttacggaccgaagggtacacgtactaactaattaacgaactgtagctgacgtacctatctcgtcttactactcttccccgcctactctgtac

SEQ ID NO: 138242 - DNA, 576 bp, Homo sapiens
  misc_feature: GYAE6OF01C3K9X.46.67.G01.1.454.CMB.1.raw
  modified_base (547)..(547): a, c, t, g, unknown or other
  misc_feature (547)..(547): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctcatcagtagtggtttctcgtggggctgggtccggcagcctcccgaggggaaggggctagggaatacagttgggaagttgtctctcagtagtggaggttcctattacagtccgtctctacaagagtcgagtcaccatatctctggaccacgtccagcaatctacgttttccagaagtatgtagttctgtcgaccgcgctcgacgcgggtctttatactgtgcgagacgacggtcttattatgttagttttggagttgtttattcgactacctagcgtcggacgggctccggcccgtgggccagggtactacgtcgtacgtccgtctcccgtacgccctaccgaccgtacggccctagtcccgtcccttccccgnggtccctaccctcctaccgagcgtacccg

SEQ ID NO: 138243 - DNA, 741 bp, Homo sapiens
  misc_feature: GYAE6OF01A3Y17.46.67.G01.1.454.CMB.1.raw
  modified_base (295)..(295): a, c, t, g, unknown or other
  misc_feature (295)..(295): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctcgtggggctgggtccgcagctcccgaggggaaggggctaggaatacagttggaagtgtctctcataggtggaaggtttcctaattacagtccgtctctcaagngtcgagtccaccatatctctggacacgtccagcaatctacgttttcccagaagtactggtacgtttcgtaggtacgacccgccgtacgtcggaaccgtacggggttactttttaagttaccgtggttacggaccggtaaggtacgggtaccggtactttaagtttaacgttgtttaagtttttagggacggtttaggttttaactttccgaaccgttaacccgtaggtacgttaccggggacgggggtcccttaccgggtaccccggttacgggggaccgtaaacggggtaacttaccggtacgggttaccctacccggttccttacccggttacgccccgttacccgaacccggtaacgggtacccctaacgttcccgggttcccctttaccccccggtacggtaccctaccccccgttcctaacccggaacgtcccgtaccccg

SEQ ID NO: 138244 - DNA, 542 bp, Homo sapiens
  misc_feature: GYAE6OF01E12GI.46.67.G01.1.454.CMB.1.raw
  modified_base (211)..(211): a, c, t, g, unknown or other
  misc_feature (211)..(211): n is a, c, g, or t
  modified_base (248)..(248): a, c, t, g, unknown or other
  misc_feature (248)..(248): n is a, c, g, or t
tcagactagcagtacacgaccggtgctcgatttagagtatacatattgggtttgggggacctcctgtgcaagaacatgaagcacctgtggtttgtcctcctgctggtggcagctcccagattggtcctgtccctggtgcaactgcaggagtcgggcccacgactggtgaggccttcggagaccctgtccctcacctgcgctgtctctggtnactccatcagtagtggtttctctggggctgggtccgnagctcccgagggaagggctggatacattggaagtgtctctcatagtggaggttcctattacagtccgtctctcaagagtcgagtcaccatatctctggacacgtccagcaatctagttttccctgaagatgagttctgtcgaccgccgctgactacgggtcgtttatactgtgcgagagacgctattatgtattttgggagttggttatttcgacaccctagacgtcggacggggtctccggaccccgtggggccgagggatacgtcggtccaccgtctccttagccctacccg

SEQ ID NO: 138245 - DNA, 735 bp, Homo sapiens
  misc_feature: GYAE6OF01CJO3O.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccgcagctccgagggagggctggaatacagttggaagtgtctactcatagtggagttcctattacagtccgtctctcaagagtcgagtcactatatctcgtagacctacgtcacgtactaacttcgttacgttttacccgaaggtaacgtacgttcggttaacgtttcgtacgggtaccgtaaccccggtccgtacgttacggaccggtaacgggtttacttttaacgttacgtggttcgacggtaggtacgtacggtactttagttacgttagttttagtttagggtaggtttagtttacgttaccgtacctaccgtagtacggttccggggtacgggtccgtaccggtacccggtcggggtaccgtaacggggtactccggttacggtacccgtacccgttccttaccgttacccggacccctaccgtaaacccggtacccggtacccgttaccggttccccggttccccttcccccgtaccgggtacccccttaccccttacccgaaccctagggtccctacccgg

SEQ ID NO: 138246 - DNA, 623 bp, Homo sapiens
  misc_feature: GYAE6OF01BHLQ5.46.67.G01.1.454.CMB.1.raw
  modified_base (232)..(232): a, c, t, g, unknown or other
  misc_feature (232)..(232): n is a, c, g, or t
tcagactagcagtacacgaccggtgctcgatttagagtatacatattgggtttggggagtctcgggtcaggacacgagcatggacatgagggtccccgcgtcagtctcctggggctcctgctactctggctccgaggtgccagatgtgactagtcgagctgaccctagtctccatcctcctgtctgcaacgtggagacagtgtcacatcgacgttgccgggcaagtcgaacngtgacactattaaatgtatcgaacatacgaccagggtacgtccctaagctcctaatctatgctgctactccagtttcgcgtaaaggtcgggtacccaggtccgaggttcgaggtggctagtggatcgtagggactagtattcactctacactatcaagtaactctagacgaacgttacgtaaagtactttacgaacttaaacttacttaactacgtaacctaaacgtaagtaaacgtttcgtacgttaagttcggtttaacggaccgtaaagggtacctaacgtaactaaactaaaacgttaaacgaacgtaggtacgtacgtacgtacctaacctattccgtagttaccgttacgtacttacccgttacccgacgttaacgttcgtaacg

SEQ ID NO: 138247 - DNA, 678 bp, Homo sapiens
  misc_feature: GYAE6OF01DVY3Y.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtgggagacagtgtcaccatcacttggccgggacaaggtcggaactattgaactacttaatttaaatggtatacaacatacgaccgagggaccgaccctaagcctactaatctatgctgcatcctagtttgacgtaaaggtcgggtacccagtcggtaggttcaggtggcgtaggtgtactcgtagggactagtatttcactcctacactatcgtaagttaactcgtacgacgtaacgttagtaaattagttttacgaacttaaactttacttacttagtaacctaaacgtaagttaaactttaacgtaagttttcggttttaaccgggaaccgtaaagggtaaccctaaacggttaaaccttaaacgtaaaaacgtttaaacgtaacgttacgggtacgtacgttacgacccgtaacttacgttaccttacgttcctttaaccgtacccgtttccccgtttaccccgaccttacgtttcctaggttaaccc

SEQ ID NO: 138248 - DNA, 576 bp, Homo sapiens
  misc_feature: GYAE6OF01BWWEV.46.67.G01.1.454.CMB.1.raw
  modified_base (192)..(192): a, c, t, g, unknown or other
  misc_feature (192)..(192): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccgggcaagtcggaacattgacactattaaatgtatcaacatagaccagggaccgccctaagctcctaatctatgctgcatccagtttgactaaaggtgggtcccatcgaggttcaggtggcaggtggatcgtgggacagtatttcactctcacctatcagtaatctgctaagtgaagttatttgactaactttattactatacaatagtaattactaagttcgtttacggaccgtaagggactaacgtaactaaacgtaaacgttaaacgtaacgtaggtaggtacctacgtacctaacctattacgttcgttacctttccgtaacgtttcccttaccccgtacccttacttcgttcgtaaccg

SEQ ID NO: 138249 - DNA, 576 bp, Homo sapiens
  misc_feature: GYAE6OF01EWFWF.46.67.G01.1.454.CMB.1.raw
  modified_base (331)..(331): a, c, t, g, unknown or other
  misc_feature (331)..(331): n is a, c, g, or t
  modified_base (382)..(382): a, c, t, g, unknown or other
  misc_feature (382)..(382): n is a, c, g, or t
  modified_base (432)..(432): a, c, t, g, unknown or other
  misc_feature (432)..(432): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtcgcctccatcagtagtggtttctcgtggggctgggtccggcagcctccgagggaaggggctggaatacattggaagtgtctctcatagtggaggttcctattacagttccgtctctcaagngtcgagtcaccatatctctgacacgtcagcaatctacgttttcccagaagntgtacgttctgtcgaccgccgctgacgacgggtctttatactgtgcgagngacggtcttattatgttagttttggagttaggtttactttacgactacccgttagacgtccggtacgggggtcctaccggtaccccgtggggacccgagggtaactacgtcggtaccaccgttacctccgttgccctaccccgg

SEQ ID NO: 138250 - DNA, 588 bp, Homo sapiens
  misc_feature: GYAE6OF01ARDIG.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacgccctaagctcctaatctatgctgcatcctagtttgactaaaggtggggtcccattcgaggttcagtcggcaggtggactctgggacagtatttcgactctcaccatcaagtaactctacgacaacgttagtaagtattttacgactaactttaattacgttagtacaaactaagtaaattactaagtttcgttttacggaccgtaagggtaccaacgtaactaaactaaagttaaacgtaactaggtacggtacttggacctactattcgttcgttaccttacgtacttacccttcccgtaccctactccttagtaacc

SEQ ID NO: 138251 - DNA, 649 bp, Homo sapiens
  misc_feature: GYAE6OF01DARLM.46.67.G01.1.454.CMB.1.raw
  modified_base (294)..(294): a, c, t, g, unknown or other
  misc_feature (294)..(294): n is a, c, g, or t
  modified_base (343)..(343): a, c, t, g, unknown or other
  misc_feature (343)..(343): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtcgcctccatcagtagttggtttcttcgtggggctgggtccgcagcctcccgaggggaagggctaggaatacagttggaagtgtctctcatagtggaggttcctattacagtccgtctctcaagngtcgagtcaccatatctctggacaagtccagacaatctacgttttcccngaagatgagttctgtcgaccgccgctgacgacgggtctttattacgtgtgcgagagacggtctattatgttagttttggagttggtttatttcgacctaccgtagtacgtcggacggggtcctaccggaccccggtggggtaccgaaggggtaactacggttcggttacctaccggttccttacccgtttaaccgccccttacccgaacccggtaaaccgggtcccccgtaacgttcccggttaccccgtttccccccgtcggtcccctaccccctccccgttacccgaaacgtaccggtaccccg

SEQ ID NO: 138252 - DNA, 763 bp, Homo sapiens
  misc_feature: GYAE6OF01A68LO.46.67.G01.1.454.CMB.1.raw
  modified_base (96)..(96): a, c, t, g, unknown or other
  misc_feature (96)..(96): n is a, c, g, or t
  modified_base (176)..(176): a, c, t, g, unknown or other
  misc_feature (176)..(176): n is a, c, g, or t
  modified_base (241)..(241): a, c, t, g, unknown or other
  misc_feature (241)..(241): n is a, c, g, or t
tcagactagcagtacacgaccggtgctcgatttagagtatacatattgggtttgtcctcctgctggtggcagctccagatgggtcctgtcctggtncaactgcaggagtcgggccacggactggtcgaggtccttcggagccctgtccctcaccgttgcgtctgtctacgtggtcncctcatcagtagtgtttctcgtgggctgggtcgcagctccgaggggacgggctagggaactacgngttaggacgtcgtctctcgagttagtggtacgttctattacagtccgtctctcaagtacgtcgagtccactatactcgtcgtggaccacgtcagctaattctacgttttacctggtaacgtagtcgtaagttctggttacgaccggccgtacttcggaacggtacgggttcctttaagttaccgtcggttagaccggtaaggtacgtaccgggttacttagtttacgttaggtttaagttttacgggtagtttagggttttacctttacggtaacccttaaccgtaacgtacggtaaccgggtacggggtacccgttaccggaccccgggtaaggggtaccccggaacgggtaaccgtaccggttaccgggttaccgtaccgttcccgttaccgttacgtccccggttacccgaacccgggtacgggtacccccgtaggttccccgggtacccgtttacccccggttacggtacccgttacccccgttacccgtaacccggtaacgtcccgggtaaccccgg

SEQ ID NO: 138253 - DNA, 615 bp, Homo sapiens
  misc_feature: GYAE6OF01CURUU.46.67.G01.1.454.CMB.1.raw
  modified_base (174)..(174): a, c, t, g, unknown or other
  misc_feature (174)..(174): n is a, c, g, or t
  modified_base (349)..(349): a, c, t, g, unknown or other
  misc_feature (349)..(349): n is a, c, g, or t
  modified_base (584)..(584): a, c, t, g, unknown or other
  misc_feature (584)..(584): n is a, c, g, or t
tcagactagcagtacacgaccggtgctcgatttagagtatacatattgggtttgtcctcctgctggtggcagctcccagatgggtcctgtccctggtgcaactgcaggagtcgggccccacgactgggtgaggccttcggagaccctgtcccctcacctgcgctgtctctggtncctccatcagtagtggtttctcgtggggctgggtccggcagcctcccgaggggaaggggctagggaaatacagttagggaagttgtcctctcagtagtggtaggttcctattacagtccgtctctcaagagtcgagtcaccatatctctggacacgtcagcaatctagtttcccngaagatgagttctgtgaccgccgctgacgtacgggtcgtttaattacgtgtagcgagaggacggtacttattagtagttagttttaggtaggttggtttatttcgactaccctagtacgtcggacggggtcgtcccgtacccgtcgggaccgtagggaagttacgtcggttccgaccgtccgttaccttacgccctaccgaccgtaacggcccacgttccggtcccttcccccgngtcccacccctaccctccaacgtcgtacccg

SEQ ID NO: 138254 - DNA, 743 bp, Homo sapiens
  misc_feature: GYAE6OF01DSGD9.46.67.G01.1.454.CMB.1.raw
tcagactagcagtacacgaccggtgctcgatttagagtatacatattgggtttggggagtctcggtcaggacacagcatggacatggacgggtccccgctcacgctccgtggggctcctgctactctggctccggaggtgccaggatcgtgacatcgagctagaccctagtcctccatcctcctgtctgcaaccggtgggagacagtcgtacaccatcacgttcggccgggtactaaggtccggaaactagttacgaacctaaccgtttaaattttaaaagtggtaactaccgaaactagtaacgaccgaaggggaccggaccctaaagtcctctaaactctaatcgactgacactacgtagtttagaacgtaaggtcgggtccctaagtcggtaggttcgaggtcggacgtaggtaggtactcggtagggactaagttacttcaacctcgtacactaatctaagttaactcgtacgtacgtaacgttagtaaagtttcgtttacgtaccttaaactttaacgttaaccgttacgtaactaaacgtagttaaactttaactacgtttcggtttaaccggaaccggttaagggaacccttaaaccggtaaaccttaaaaccgttaaaacgttaaccggtaaccgttaggtaccggttacctagggtaaccctaaccgttagttacgtttccgtaacgtttacccttacgtaccccgttacccgagtttactcgttacggtaacc

SEQ ID NO: 138255 - DNA, 633 bp, Homo sapiens
  misc_feature: GYAE6OF01AGSR3.46.67.G01.1.454.CMB.1.raw
  modified_base (233)..(233): a, c, t, g, unknown or other
  misc_feature (233)..(233): n is a, c, g, or t
  modified_base (446)..(446): a, c, t, g, unknown or other
  misc_feature (446)..(446): n is a, c, g, or t
  modified_base (569)..(569): a, c, t, g, unknown or other
  misc_feature (569)..(569): n is a, c, g, or t
  modified_base (627)..(627): a, c, t, g, unknown or other
  misc_feature (627)..(627): n is a, c, g, or t
tcagactagcagtacacgaccggtgctcgatttagagtatacatattgggtttggggtaggtcgttcggtcgaggacacagcatggacatgagggtcccgctcagctcctgggctcctgctactctggctccgaggtgccagatgtgacatcgagctgacccagtctcatcctccctgtctgacaaccgtgggacgacagtgtcaccatcacttgccgggcaaggtccggaanttgactaccttatttaaattcggtattacaactatagaccagggacgaccctaagctaccgtaactctaagtcgtactagcctagtaccctaggttttagaccctaaaggtcggggtccccaagttcggacggtttccaggtggcgtagttggattacgtggggaacctggtactttcacgtctacgactatacagtatctagctaacggttnaacgtattttcgcttaaacttattacttagactaagagtttaaactattaagtcgttttccggaacgaaacgggtacctaacgtaccttaaataaaccgttaaagacgttagtgtaaccgttnacccgaacctgttaccaggttcctaagttaccgtccttaacccggcctaattaccgtntaaccg

SEQ ID NO: 138256 - DNA, 647 bp, Homo sapiens
  misc_feature: GYAE6OF01CXOGL.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacactatttaaatggtatcaacatagaccaggaccggccctaagctcctaatctatgctgcatccaagtttgacaaggtcgggtcccatcgagttcagtggcagtggatcgtgggactagattttcacttctaccactatctaagtaatctagactaacgtagaaagttattttagaacttaacgtttacttaactgttacaacgtaagttaacttaactaagtttacggttttaccggaccgtaaacggggtaacctaaccgtaacgttaaacctaaaaacgttaaccgaaacgttaacggtaggtaccctaggtaccctaaccgttaacgtttaccgtttacgttacccgttttacctaaacccgtttcccgttaccccccggtacccttaacgttcccgttaggttaaacccg

SEQ ID NO: 138257 - DNA, 628 bp, Homo sapiens
  misc_feature: GYAE6OF01DF3MJ.46.67.G01.1.454.CMB.1.raw
  modified_base (252)..(252): a, c, t, g, unknown or other
  misc_feature (252)..(252): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccggcagtcggaacattcgacaccttatttaatgtatcaanatagaccaggaccgccctaagcctactaatctatgctgctatcctagtttcgacgtaaaggttcgggtacccagtcgtaggttcaggtggactaggtggtatcgtaggggaactaggtactttcactcctacacctatactagttaactctacgacctaaggttgtaaagtttacttttagaaccttaacttttaactttaccgttacgtacaaacgttaagtaaactttactaagtttcggtttaacgaccgtaaacgggtacaacgtaactaaactaaaacgttaacgtaacgttggtacgactacgaccttacgtacttccttacgttccctttacaccgtttaccctaccccgcttaacttcgttagtaacc

SEQ ID NO: 138258 - DNA, 552 bp, Homo sapiens
  misc_feature: GYAE6OF01CWPUA.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacactatttaatgtatcaacatagaccagggacggccctaagctctaatctatgctgcatccagtttgacaagtgggtcccagtcgaggttcagtgcagtggatcgtgggacagtatttcactctcactatcagtaatctgactaagtgaagtatttagactaacttattactgtacaactagtaattactaattcgttttaccggacgtaacgggacctacgtaacttaaactaaacgttaacgaacgtagtacggactacgactaaccgtattaccgttgttccttactacttccttaccccgacctacttctgttaac

SEQ ID NO: 138259 - DNA, 587 bp, Homo sapiens
  misc_feature: GYAE6OF01DGCSH.46.67.G01.1.454.CMB.1.raw
  modified_base (334)..(334): a, c, t, g, unknown or other
  misc_feature (334)..(334): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctcgtggggctgggtccgcagctcccgagggagggctggaatacattggaagtgtctctcatagtggaggttctatacagtccgtctctcaagagtcgagtcaccatatctctggacacgtccagcaatctagtttccagaagntgagttctgtcgaccgcgctgacgacgggtctttatactgtgacgagagacggctattatgttagttttggagttgttattcgtactacccgtagacgtcggacgggtctccggacccgtggggccgaagggtactacgtcggtaccgtaccgtcttaccgttacgccctaccgaaccgtacgggcccaacggttcccggttcccttcccccgtcggtccctacccctcccgtacccgaacggtccgtacccg

SEQ ID NO: 138260 - DNA, 671 bp, Homo sapiens
  misc_feature: GYAE6OF01B31TK.46.67.G01.1.454.CMB.1.raw
  modified_base (193)..(193): a, c, t, g, unknown or other
  misc_feature (193)..(193): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtggganacagtgtcaccatcacttggccgggacaagtcggaactattgactacttaatttaaattggtatacaacataagaccagggaccggaccctaagctacctaatctatgactgactactcctagtttcgacaaacggtcggggtccctaagtcggtaaggttcgaggttggacgtaggtggtatcgtagggaacaggtatttcacttctacaaccctataccgaagtaactctagacctaaacggtgtaaacgttattttacgaacttaaactttatttacgtagtaacctaaacaagtaatttagactaagtttacggtttaccggaaccggtaaaggtaccaaccgttaaactaacgtaaaacgttaaaccgtaactagggtacgtacctacggtcctaaccgttacgttcgttacgtttaacccttacgttaacctttaccccgtttaaccccggtccttaacgtttcccttaagg

SEQ ID NO: 138261 - DNA, 685 bp, Homo sapiens
  misc_feature: GYAE6OF01BI8T9.46.67.G01.1.454.CMB.1.raw
  modified_base (192)..(192): a, c, t, g, unknown or other
  misc_feature (192)..(192): n is a, c, g, or t
tcagactagcagtacacgaccggtgctcgatttagagtatacatattgggtttggggagtctcggtcaggacacagcatggacatgagggtccccgctcagctcctggggctcctgctactctggctccggaggtgccagatgtgacatcgagctgacccagtctccatcctcctgtctgcaacggtggganacagtgtcaccatcacttcggccgggacaaggtcggaactagttacgaacctaccgttaattttaaaagttggtaactacaaacaagtaacggaaccgaggggaaccggtacccctaaaggtaccttacctaatcctaatcgctcgctactcctagttgacgtaaaggtcggggtaccagtcgtaggttacgaggtggcaggtaggacgtcgtagggacagtattactactctcacatctagtatctagactaacggtagtaagttactttagtaactaatttaacttacgttacgtaacctaaactaacggttaattaacgttaaacgttttcggttaaccggtaacccggtaaaggaaccgtaacgtaaaccgttaaacttaaaaccgttaaacggtaacgttaggtacggtacttacgaccctaacgtacttaccgtacgttaccttacctaccgttacccttacccgaccttaacgtcttaagtaaccg

SEQ ID NO: 138262 - DNA, 727 bp, Homo sapiens
  misc_feature: GYAE6OF01DKHOI.46.67.G01.1.454.CMB.1.raw
tcagactagcagtacacgaccggtgctcgatttagagtatacatattgggtttggtcctcctgctggtggcagctcccagatgggtcctgtccctcggtgcaactgcacggacgtccgggcccacgactggtgaggccttcggacgaccctgtccctcacctgcgctgtctctggtgcctccatcagtagtggtttcttcgtggggctgggtccgcagcctccgagggaagggctaggaatacattggaagtgtctctcatagtggtaggttctattacagttccgtctctacaagagtcgagtcaccatatctctggacacgtccagactaatctacgttttccctagaagtattagtacgtttcgtacgtcgacccgccgtctacggaaccgtaccgggttacttttaagttacgttggtcgacggaagacggtacggtactttaatttagttagtttaagtttttagggtagtttgggttttactttccggtaaccttaacccgttaggtacgttaccggggaccgggggtcccgtacccgggaccccggttgggggaccccgtaaggggtaacttaccggttcgggtacccgtacccggttccttacccgttacggccccttaaccccgaacccggtaaccggggtcccctaacggttcccggttaccccctttccccccgacggtcccctaccccttccccgtacccaaacgccgtaccccg

SEQ ID NO: 138263 - DNA, 572 bp, Homo sapiens
  misc_feature: GYAE6OF01EV6GX.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacttatttaaattggtatcaacatagaccagggacgccctaagctcctaatctatgctgcatccagtttgcaaagtgggtcccatcgaggttcagtggcagtggatcgtgggacagatttcactctcaccatcaagtaatcttagacaacgtgaagtatttgactaacttattactgtacaactagtaatttaacaattcggttttaccggactaaacgggactaacggtaacttaaactaaaattaaaccgaacttaggtacggtctacgacctaacctattacttcgttaccttactaacgtttcccttaccccgaccttacttccgtggttaaacc

SEQ ID NO: 138264 - DNA, 644 bp, Homo sapiens
  misc_feature: GYAE6OF01BCCXW.46.67.G01.1.454.CMB.1.raw
  modified_base (192)..(192): a, c, t, g, unknown or other
  misc_feature (192)..(192): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtcgcaccatcacgttcggccgggacaaggtcggaactattgaacctaaccttaattttaaagttggtaatcaaacatacgaccgagggaccgaccctaagctacctaatcctatgtctgcatcctagtttgacgtaaaggtcgggtccagtcgtaggttcagtggcagtgatcgtagggacagtattcactctacacctatctaagtaatcgtgactaacgtagtaagttattttagttaaacttattactacgtaacaacgtaagtaattaactaatttacggttttacggaccgtaaagggtacaaccggtaaactttaaactaaaattaaaccggaacttaggtacggtactacgaccctaaacctacttaccttaggttaccctttaccgtaacctttaccccgttaccccgtacccttaatttcctacggttaacttaacccg

SEQ ID NO: 138265 - DNA, 625 bp, Homo sapiens
  misc_feature: GYAE6OF01DZKLC.46.67.G01.1.454.CMB.1.raw
  modified_base (194)..(194): a, c, t, g, unknown or other
  misc_feature (194)..(194): n is a, c, g, or t
tcagactagcagtacacgaccggtgctcgatttagagtatacatattgggtttggggagtctcggtcaggacacagcatggacatgagggtccccgctcagctcctggggctcctgctactctggctccggaggtgccagatgtgacatcgagctgacccagtctccatccctccctgtctgcaaccgtggganacagtgtcaccatcacttgccgggcaagtcggaacattgacacctaattaaattggtatcaacatagaccagggacgccctaaagctacctaatctatgctgcactcctagtttgacaaaggtcgggtacccaagtccgaaggttcaggtggacgagtggatcgtaggggactaagtactttacactcgtacaacctatacctagtaacttcgtagactaacgtagtaagtatttagactaaactttattactagtacaaatacgtaaattactaaagttcgttttaccggaacctaaacgggactaaccggtaactaaactaaaagtttaaaccgaacttacggtggtaccgtagacctaactaagttccgttacgtcctttaacgtacctttacccgttacccctaccctacttaaccgtgttaaaccg

SEQ ID NO: 138266 - DNA, 800 bp, Homo sapiens
  misc_feature: GYAE6OF01BTU33.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagacccctgtccctcacctgcgctgtctcgtggtgcctccatcagttagtggtttctcgtgggctgggtccgcagcctcccgagggaacgggctaggaatacagttgggaagttcgtcctcgtcaagttaggtgggtaacggtttccttaagttacgacggttcccgttcttcctacaaaggtacgtcgagttccaaccattactcctctggaccacgtccaagctaaattctacgttttcccaggaacgtgtagtacgttccttggtcgaacccgtccgtcgtaggaaccgtaccgggttagttttaacgtaaccgttggttacggaccggaaggtacggtacggtaccttaagtttacgtgttttaagtttttgggaacgttttggtttaactttaccggaaccttaacccgtacggtaacggtaccgggtaccgggggtaccttacccgggaccccggttagggggaccccggtaacggggtaaacgttaaccgggttcggttacccgtacccggttaccgttacccgtttaaccggccccgtttaaccccgaaccggtaaacccgggtacccgtaacgttccccggttaccccgtttcccccgtacgggtcccccttacccccttacccggtacccgtaaaccggttccgaaccccgg

SEQ ID NO: 138267 - DNA, 843 bp, Homo sapiens
  misc_feature: GYAE6OF01BA588.46.67.G01.1.454.CMB.1.raw
  modified_base (173)..(173): a, c, t, g, unknown or other
  misc_feature (173)..(173): n is a, c, g, or t
  modified_base (212)..(212): a, c, t, g, unknown or other
  misc_feature (212)..(212): n is a, c, g, or t
tcagactagcagtacacgaccggtgctcgatttagagtatacatattgggtttgtcctcctgctggtggcagctcccagatgggtcctgtccctggtgcaactgcaggagtccgggcccacgactggtgaggccttcggagaccctgtccctcacctgcgctgtctctggtcncctccatcagttagttggtttctcgtgggctgggtccgnagcctccgaggggagggctaggaatacgagttaggagtgtcgtctcagtagtggtacggttacctattacgacgttccgtcttctacgaagtacggtcgaagtcaaccattactctacgtacggtacctaccggtccaacgtactaaacttaccgttacgtttttaccccaggtaaaacgtagttaggttacgtttacgttcggacgtaccccggcgttaccgtacggtaaccggtaccggggtttacgtttttaacttaacggtggttaggaaccgtagggtaacggtaccgggttactttaaggtttagtttaggttttagtttttaggggtaaggttttacggtttttaacgtttaccggtaaccttaacccggtaggttaccggttacccggggtaccggggggtaccgttaccccgggtaacccccgggtaggggggttaacccccggaaagggggttaacccttacgggttaccggtacccgttaacccgttcccgttacgttaccccgtacccgttaaccccgaacccggtaaccggtcccccgacggtttcccccggttccccttaccccccggtacgtacccccgtacccccgtaccctaacgtaacccggccgtaccccgg

SEQ ID NO: 138268 - DNA, 623 bp, Homo sapiens
  misc_feature: GYAE6OF01C4P3E.46.67.G01.1.454.CMB.1.raw
  modified_base (193)..(193): a, c, t, g, unknown or other
  misc_feature (193)..(193): n is a, c, g, or t
  modified_base (253)..(253): a, c, t, g, unknown or other
  misc_feature (253)..(253): n is a, c, g, or t
tcagactagcagtacacgaccggtgctcgatttagagtatacatattgggtttgggggagtctcggtcaggacacagcatggacatgagggtccccgctcagctcctggggctcctgctactctggctccgaggtgccagatgtgacatcgagctgacccagtctccatcctcctgtctgcaaccggtggganacagtgtcaccatcacgttgccgggcaagtcgaactattgacactatttaatgtatcaanatagaccagggaccgaccctaagctactaatctatgctgctatcctagtttgacgtaaggttcgggtacccagtcgtaggttcaggtggcaggtggatcgtagggactagtactttcacttctaccaactatacagtaactcgtagactaacgtagtaaagttattttagaacttaactttattacgtagtaacaaacgtaagtaaacttactaagtttcggtttaaccggaaccgtaaacgggtacctaaccgtaacttaaactaaaacgttaacgaacgttggtacgacctacgaaccctaaccgtattccgttacgttacctttaccacgtttacccgttacccgtaccttaactccgttagtaacg

SEQ ID NO: 138269 - DNA, 756 bp, Homo sapiens
  misc_feature: GYAE6OF01ATZTZ.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgcagatgtgacatcgagtctgacccagtctcatcctcctgtctgcaaccgtggagacagtgtcaccagtcacttggccgggacaaggtccgggaactagttcgaacctaccttaattttaaagttggtatacaactatacgaccagggaccgccctaagctactaatctatgctgcacgtccgtagtttcggacgtaaaggtcggggtaccctagttacggtacggtttacgaggttacggtacgtaggttacgggtaattccggtagggaactaaggttactttacgaaccttcttaccgtaaccgtaacgtaccgtaacgttaacttccgtacgtaaccgtaaacggttaggtaaacggttacttttaacggaactttaaacctttaacttaccgttacgtaacctaaacgtaacgttaaacgtttaactaaacggtttcggtttaaccgggaaccgtaaacgggtaacctaaccggtaaaccttaaaccgaaaacgtttaaaccggaacgtttacggttacgtaccgttaacgacccgtaccgtaacgttaccgttagtttacccttacgtaaccgtttaccccgttacccgtaacctaactttccgttacgttaaacg

SEQ ID NO: 138270 - DNA, 634 bp, Homo sapiens
  misc_feature: GYAE6OF01DMJ1R.46.67.G01.1.454.CMB.1.raw
  modified_base (265)..(265): a, c, t, g, unknown or other
  misc_feature (265)..(265): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgactacctatttaaattggtatcaacatagaccgnggacggccctaagctcctaatctatgctgcatctagttgcgtaaagtcgggtcccatcggagttacgaggtggcgtagtggattcggtacgggaactagtaactttccacttctaccaacctatacctaagtatcgtacgaactacgtaagtaagtttatttacgacttaaacttacgtttacgtataacaataagtaaatttactaagttttcggtttaaccggaacgtaacgggtaacctaaacggtaaccttaaaacgtaaaacgttaaacgtaaccgttagtacgtacgtacgtaccgacttacttcggttcttcctaaccttacgtttcccttacccggtaccttacttccgttagtaaacccg

SEQ ID NO: 138271 - DNA, 560 bp, Homo sapiens
  misc_feature: GYAE6OF01BVQ2C.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggcagctcccgaggggaaggggctggaatacagttggaagtgtctctcatagtggaggttcctattacagtccgtctctcaagagtcgagtcaccatatctctggacacgtccagcaatctagttttccctgaagatgagttctgtcgaccgccgctgacgacgggtctttattacgtgtgcgagagacggctattatgtattttggagttggtttatttcgtacacctagatcggacggggctcgcccgtgggccgagggactacgtggtcgaccgtctcttacgccctaccgaccgaacggcccacgtccgtcccttcccccgtgccctaccctcccaccagcgtacccg

SEQ ID NO: 138272 - DNA, 523 bp, Homo sapiens
  misc_feature: GYAE6OF01DF75B.46.67.G01.1.454.CMB.1.raw
  modified_base (217)..(217): a, c, t, g, unknown or other
  misc_feature (217)..(217): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggnaagtcggaacattgacacctatttaaatgtatcaacatagaccagggacggccctaagctacctaatctatgctgcatccagtttgcaaagtgggtcccagtcgaggttcagtgcagtggatctgggacagatttcactctcacatcagtaatctgacaacgtagaagtattttagactaactttattactgtacaactagtaattactaattgttttaccgaccgaaagggtacacgtaactaacaaattaacgaactgtagctgacactatctgtcttcacttccttacccgctactctgtaac

SEQ ID NO: 138273 - DNA, 653 bp, Homo sapiens
  misc_feature: GYAE6OF01DDFVM.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccggaggtgccagatgtgacatcgagctcgacccagtcctccactccctccctgtctcgacgaaccggtgggagactagtcgtccacctatccacgttcggccgggacaaggtaccggaactattacgacctaaccttaatttaaagttggtatacaactagtacgaccgagggaccgaccctagctacctaatctatcgctgactactcctagttgacgtaaggtcgggtaccagtccggtaggttcgaggtcggactaggtacggtactcggtaggaactacggtactttccgacttccgtacctaacctatacgtaagttaactcgtagaccgtaagtacgtaagtttactttacgaacttaagttacttactagtaacctaaagtaacgttaactttaacgacgtttacggttaccggaacgtaacggtactaaccgtaactaactaaaacttacgacgtgtacgctacgtacctacgtatcgtcttactacctacgttaccctcgacttactcgtagtacg

SEQ ID NO: 138274 - DNA, 749 bp, Homo sapiens
  misc_feature: GYAE6OF01C4FV3.46.67.G01.1.454.CMB.1.raw
  modified_base (192)..(192): a, c, t, g, unknown or other
  misc_feature (192)..(192): n is a, c, g, or t
  modified_base (231)..(231): a, c, t, g, unknown or other
  misc_feature (231)..(231): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaaccggtggganacagtgtcaccatcacttcggccgggacaaggtcgaacnttagactaacttatttaaatgtatcaacatacgaccgagggaccgaccctaagcctactaatctatgctgctactccgtagtttacgacgtaacgggtcgggtaccctaagtcggtaggtttacaggtcggacgtaggtacggtagttcgtaggggaactaggtactttaccgaccttcgtaccacctactacgtaacgttaatcgtacgaacgttaaacgtggtaaattacgttttacgaaccttaacttttactttaaccgtagttaaccaaacgttaacgttaaaacttttaaccgttaaaggttttccggttttaaccggaacccggtaaaacgggttaaccctaaacggttaaaccgttaaaaccttaaaacggtttaaaccgtaaacgtttcgggttaacgaccgttaacgcccgtaaaccgttacgtttaccgtttccggtttaaccctttaccttacgtttaccccccgttacccgtacccgtaaatttcccggttaacgttaaacccgg

SEQ ID NO: 138275 - DNA, 579 bp, Homo sapiens
  misc_feature: GYAE6OF01DOXY2.46.67.G01.1.454.CMB.1.raw
  modified_base (218)..(218): a, c, t, g, unknown or other
  misc_feature (218)..(218): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttggccgggnaagtcggaactattgacacttatttaaattgtatcaacatagacaggacgccctaagctcctaatctatgctgcatctagtttgactaaaggtcgggtcccagttcgaggttcagtggcagtggatcgtaggacagtattcactctcacatcatatctgacaagtgaagttatttgacttaattattactagtacaatagtaattacgtaatttgttttaccggaactaacgggactaaccggaacttaaacgtaaaagttaaccgtaaacgttggtacgtacgtacgacccgtaactaacttcgtcgtttaccttaccgtacgtttccccgttaccccgaccttacgttctcgttaaccg

SEQ ID NO: 138276 - DNA, 669 bp, Homo sapiens
  misc_feature: GYAE6OF01BETIH.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtgtggtttcttcgtggggctgggtccggcagcctccgagggaaggggctaggaatacagttggaagtgtctctcatagtggaggttcctattacagtccgtctctcgaagggtcgagtcacctatactctctggacacgtccagtctaatctagttttcccagtaagatgtacgtttcgtggtcgacccgcccgtcgtcggaacccgtaccggggttacgttttaacttaccgttggtacggacggaaggtacggaccggtacttaatttacgtcggtttagttttttagggaggttttagggttttaactttccgaaccgttaaccgtaggtacgttccgggtaccgggggtcctccccggtaccccggtcgggggaccaggggttaactaccggtggttacccgaccgttccttacccgttacgtccccgtcccgtaaaccccggg

SEQ ID NO: 138277 - DNA, 506 bp, Homo sapiens
  misc_feature: GYAE6OF01B87NB.46.67.G01.1.454.CMB.1.raw
  modified_base (499)..(499): a, c, t, g, unknown or other
  misc_feature (499)..(499): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacgccctaagctcctaatctatgctgcatccagtttgcaaagtgggtcccatcgaggttcagtggcagtgatcgtgggacagatttcactctcaccatcagtaatctgcaacgtgtaagtattttgactaacttattacttgtacaacagtaattactaattgtttcggaccgtaaggactacgtactaactaaattaacgaatgtgctgacactatctgtctcatctccacntctgtac

SEQ ID NO: 138278 - DNA, 672 bp, Homo sapiens
  misc_feature: GYAE6OF01B7DVS.46.67.G01.1.454.CMB.1.raw
  modified_base (198)..(198): a, c, t, g, unknown or other
  misc_feature (198)..(198): n is a, c, g, or t
tcagactagcagtacacgaccggtgctcgatttagagtatacatattggggtttggggagtctcggtcaggacacaggcatggacatgagggtccccgctcagctcctggggctcctgctactctggctccgaggtgccagatgtgacatcgagctcgacccagtcctccatcctccctgtctggcaaccggtggganacagtgtcaccatcacttggccgggataagtcggaacattcgaactacctaatttaaagttggtaatcaacataagacgaagggaccgaccctaagcctacctaatctatcgtctagtacctatccgtaggtttacgacggtaaaaggtcggggtacccaggtcggtaacggttcaggttggacgtaggtggtagtcgtaggactagtcttacactcacacctatacgagtaactctagactaacggtataaagttattagacttaagttaacttacttacgtaacaagtaacgtaaattactaaagttcggtttacgaacgttaacggactaaccgtaacttaaacgtaaaacgtaaccgtaacgtacggtacggtactaaccgtaacgtaacccgttagttaccgttcggttaccttaaccttacccgttacccttaccccgttaacctaacgttccgttaacgttaacccg

SEQ ID NO: 138279 - DNA, 603 bp, Homo sapiens
  misc_feature: GYAE6OF01CE9NN.46.67.G01.1.454.CMB.1.raw
  modified_base (400)..(400): a, c, t, g, unknown or other
  misc_feature (400)..(400): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggcagcctcccgaggggaaggggctggaatacagttggaagtgtctctcatagtggagttctattacagtccgtctctcaagagtcgagtcaccatactctctggacacgtcagcaatctacgttttccagtaagatgagttctgtcgaccgcgctgacgtcgggtctttattacgtgtcgcgagagacgtnttaattagtgttagttttggtagttggtttactttaccgtactaccctagcgtacgggacggggtcctccggtacccgtgggccgtaagggtactacgtcggtaccaccgtctccgttacgccctccgaaccgtacgggccctacggttccggtccccttccccgtcggtacccctacccctcccacccgtaagccgtacccg

SEQ ID NO: 138280 - DNA, 585 bp, Homo sapiens
  misc_feature: GYAE6OF01A47IO.46.67.G01.1.454.CMB.1.raw
  modified_base (192)..(192): a, c, t, g, unknown or other
  misc_feature (192)..(192): n is a, c, g, or t
  modified_base (216)..(216): a, c, t, g, unknown or other
  misc_feature (216)..(216): n is a, c, g, or t
  modified_base (351)..(351): a, c, t, g, unknown or other
  misc_feature (351)..(351): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcacatcacttggccggnaagtcgaacattgacacttatttaaatgtatcaacatagaccgagggaccgaccctaagctacctaatctatgctgcactcctagtttcgactaaaggtcgggtacccagtcgaggttcaggtgcaggtgatcgnggacagtattcactctcacatacaagtactctacgacgtaacgtagtaagttatttagacttaactttattaactgtacaaactagtaattactaagttcggtttacgacgtaaggactaacggtaactaacgtaaactaacgtaacgtaggtacgtcgtacgaccgtaacctacgttacttcgtaccttaccttacgttcccttaccccggtacctacttaccgtgttaaccg

SEQ ID NO: 138281 - DNA, 648 bp, Homo sapiens
  misc_feature: GYAE6OF01ANEXG.46.67.G01.1.454.CMB.1.raw
  modified_base (192)..(192): a, c, t, g, unknown or other
  misc_feature (192)..(192): n is a, c, g, or t
  modified_base (360)..(360): a, c, t, g, unknown or other
  misc_feature (360)..(360): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccgggcaagtcggaacattgacaccttatttaaattggtatacaacatagaccagggaccgccctaagctacctaatctatgctgcatcctagtttgacgtaaggtcgggtccagtcgaggttcagtggcagtggatcgtaggacagtnttacactctacactatacaagtactctagactaacgtataagtattttcgaactaactttacttacgttacgtaacaacgtaagtaaactttacgtaaagttttcggttttaaccggaaccgtaaaggggtaacctaaccggttaaaccttaaaccgttaaaaagttaaaacccgtaacggttacggttaacgggtaccttaacggaccctaacccgttattccgttacgtttcctttaaccgtacctttccccttaccccgtacttaaccttccgtaacgttaaccg

SEQ ID NO: 138282 - DNA, 585 bp, Homo sapiens
  misc_feature: GYAE6OF01BA6D1.46.67.G01.1.454.CMB.1.raw
  modified_base (335)..(335): a, c, t, g, unknown or other
  misc_feature (335)..(335): n is a, c, g, or t
  modified_base (339)..(339): a, c, t, g, unknown or other
  misc_feature (339)..(339): n is a, c, g, or t
  modified_base (548)..(548): a, c, t, g, unknown or other
  misc_feature (548)..(548): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggcagctcccgaggggaagggctggaatacattggaagtgtctctcatagtggaggttcctattacagtccgtctctcaagagtcgagtcaccatatctctggacacgtccagcaatctagtttccngaanatgattctgtgaccgcgctgacacgggtctttatacgtgtgcgagagacggtctattagtgttagttttggagttggttatttcgacctaccgtagacgtcggacggggcctaccggaccccgtggggccgaagggtaactacgtggtccaccgtctccgtacgccctacccgaccgaacgggccctacggttccgtcccttcccccgnggtaccccacccgttcccacccgtaaagcgtaccccg

SEQ ID NO: 138283 - DNA, 567 bp, Homo sapiens
  misc_feature: GYAE6OF01EB17G.46.67.G01.1.454.CMB.1.raw
  modified_base (438)..(438): a, c, t, g, unknown or other
  misc_feature (438)..(438): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactgggtgaggccttcggagaccctgtccctcacctgcgctgtctctggtcgcctccatcagtagtggtttctcgtggggctgggtccgcagctcccgagggaagggcgtggaatacagttggaagtgtctctcatagtggaggttcctattacgagtccgtctctcaagagtcgagtcacatatctctgacacgtcagcaatctacgtttccctagaacgatgtagttctgtcgaccgcgctgacgacggtcgtttatacgtgtgcgagagacgtntattagtgttagttttggtagttagtttattacgtactaccgtagacgtacggaccgggctcccggcccggtagggccggtagggacgtacgtcgtccgtaccgtacctccgttcgtcccgtaaccccg

SEQ ID NO: 138284 - DNA, 548 bp, Homo sapiens
  misc_feature: GYAE6OF01E1Y6G.46.67.G01.1.454.CMB.1.raw
  modified_base (386)..(386): a, c, t, g, unknown or other
  misc_feature (386)..(386): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacaccttatttaaattgtatcaacatagaccagggacgccctaagctcctaatctatgctgcatccagttttcgacgtaaaaggttcggggtcccagttcgaggttcaggtggcagtggatcgtgggacagtatttcactctcactatcagtaanctagcaagtgaagtatttgactaaacttattactgtacaaacagtaaatttacaagtttggtttacgaccgaaggactaacgtaactaacaaattaacgaactggtagctagacctactatcttcgttccttacacttccttaccccgctacttctgttaac

SEQ ID NO: 138285 - DNA, 548 bp, Homo sapiens
  misc_feature: GYAE6OF01C690T.46.67.G01.1.454.CMB.1.raw
  modified_base (193)..(193): a, c, t, g, unknown or other
  misc_feature (193)..(193): n is a, c, g, or t
  modified_base (218)..(218): a, c, t, g, unknown or other
  misc_feature (218)..(218): n is a, c, g, or t
  modified_base (515)..(515): a, c, t, g, unknown or other
  misc_feature (515)..(515): n is a, c, g, or t
  modified_base (519)..(519): a, c, t, g, unknown or other
  misc_feature (519)..(519): n is a, c, g, or t
  modified_base (536)..(536): a, c, t, g, unknown or other
  misc_feature (536)..(536): n is a, c, g, or t
  modified_base (545)..(545): a, c, t, g, unknown or other
  misc_feature (545)..(545): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtggganacagtgtcaccatcacttgccgggnaagtcggaacattgacacctattaatggtatcaacatagaccagggaccgccctaagcctctaatctatgctgctactcctagtttcgacgtaaaggtcggggtcccaagtcggtaggttcaggtggcaggtggatcgtgggactagtatttcactctacacctatcagtatctgacaacgtagtaagtatttacgactaactttattactagtacaatagtaattactaagttcgtttacggacctaagggacctaacgaacttaactaaacttaacgactggtgactgactactntctntctctacttccttaccnctactcgtntac

SEQ ID NO: 138286 - DNA, 656 bp, Homo sapiens
  misc_feature: GYAE6OF01AMBEF.46.67.G01.1.454.CMB.1.raw
  modified_base (190)..(190): a, c, t, g, unknown or other
  misc_feature (190)..(190): n is a, c, g, or t
  modified_base (193)..(193): a, c, t, g, unknown or other
  misc_feature (193)..(193): n is a, c, g, or t
  modified_base (196)..(196): a, c, t, g, unknown or other
  misc_feature (196)..(196): n is a, c, g, or t
  modified_base (225)..(225): a, c, t, g, unknown or other
  misc_feature (225)..(225): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcaagctgacccagtctccatcctcctgtctgcaaccgtgganacngtntcacatcacttgccggcaagtcggaactnttgacctacgttatttaaatggtatcaactatagaccagggaccgcctaagtcctacctaatctatcgcttgctatccgagtttgacgtaagtgggtacccatcggagttcaggtgctagtgtatcgtagggacagtagtttcactctacaccgtataccgtaagtactcgtacgtactaaacggtgtaaacgttagttttaggaaccttaagtttacgtttacttacggtaacctaaataaagtaactttaaacgaacgtttacggtttaccgggtaaccgaaaggggttacccaaaccgggttaacttaaaaccgtaaacgtttaaaacgaccggtttaagtcgggtaccttacggtaaccctaccggtattcgacgtttaccttaccgtaacttcccggtttaccccgattcccttaggtcttaaccg

SEQ ID NO: 138287 - DNA, 664 bp, Homo sapiens
  misc_feature: GYAE6OF01BMXSO.46.67.G01.1.454.CMB.1.raw
  modified_base (220)..(220): a, c, t, g, unknown or other
  misc_feature (220)..(220): n is a, c, g, or t
tcagactagcagtacacgaccggtgctcgatttagagtatacatattgggtttggggagtctcggtcaggacacagcatggacatgagggtccccgctcagctcctggggctcctgctactctggctccggaggtgccagatgtgacatcgagctgacccagtctccatcctccctgtctgcaacggtggagacagtgtcacatcacgttcggccggganaagtcgaactattgactacttattaatgtatacaacatacgaccgagggaccgacctagctactaatctatcgctgctactcctaggtttcgacgtaaaggttcgggtacccagtcggtaggttaccaggtggactaggtaggtacttacggtaggggaactaggttacttttcccgacttaccgtaccaacccttagttaccgtaagttaactcgtacgaaccgtaacgttaggtaaacgtttagttttacgaactttaaacgtttacttaacgttacgtaaacctaaacgtaagttaactttaacgtaagtttcggtttaaccgaacgtaacggtaactaacggtacttaaacgtaacgttaacgtacgtgtacgctacgactaacctattccgttacgttccttactaccgttacccgtacccgtaactacttcgtatacg

SEQ ID NO: 138288 - DNA, 567 bp, Homo sapiens
  misc_feature: GYAE6OF01A2Y3M.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccaggggaaggggctggaatacattggaagtgtctctcatagtggaggttcctattacagtccgtctctcaagagtcgagtcaccatatctctggacacgtccagcaatctagttttcccctgaagattgagtttcgtgtcgaccgccgctcgacgtacgggtcttttattactggtgcgagagacggcttattatgttattttggagttggttatttcgactacccgtagactcggacggggtcctcggcccgtggggccgagggtactacgtggtcaccgtcttcctacgcctccgacgacgggcccacgtccggtcctcccctcgtcccaccctcccaccagctacccg

SEQ ID NO: 138289 - DNA, 799 bp, Homo sapiens
  misc_feature: GYAE6OF01D3C3I.46.67.G01.1.454.CMB.1.raw
  modified_base (297)..(297): a, c, t, g, unknown or other
  misc_feature (297)..(297): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtcgcctccatcagtagttggtttcttcgtgggctcgggtccgcagcctccgaggggaagggctggaactacagttggaagtgtctctcagtagtggaggttcctattacagtcccgttctctacaagngtcgacgtcacctagtactctcgtggacacgtccagacaactcgttacgttttaccagtaagaattgtaacgtttctaggtaccgacccgtcccgtacgtacggaaccgtacgggttacgtttttaacgttacctggttacggacggaacgggtacggtaaccggtacgtttaagttagtttaggtttacgtttttagggtaggttttacggtttaacgttttaccggaacctttacccgtaaggtaccggttaccggggaccggggtaccgttaccccgggtaaccccgggtcggggaacccggtaaggggtaaaccgtttaccgttacgggttaccctaccccggtttaccgttaccccgttacgggtaccccctacccggaaacccggtaaccggggtacccccttaacggttccccggtttacccccgttcccccccggttacgggtaccccctaccccccgttaccccaacccggtaaaccggtaccgtacccccgg

SEQ ID NO: 138290 - DNA, 715 bp, Homo sapiens
  misc_feature: GYAE6OF01DWS85.46.67.G01.1.454.CMB.1.raw
  modified_base (176)..(176): a, c, t, g, unknown or other
  misc_feature (176)..(176): n is a, c, g, or t
  modified_base (218)..(218): a, c, t, g, unknown or other
  misc_feature (218)..(218): n is a, c, g, or t
  modified_base (329)..(329): a, c, t, g, unknown or other
  misc_feature (329)..(329): n is a, c, g, or t
tcagactagcagtacacgaccggtgctcgatttagagtatacatattgggtttgtcctcctgctggtggcagctcccagatgggtcctgtccctggtgcaactgcaggagtccgggcccacgactgggtgaggcccttcggacgaccctgtccctcacctgcgctgtctctggtcncctccatcagttagttggtttcttcgtggggctggggtccgnagctccgaggggagggctaggaatacgagttggaagtgtcctactcagtagtggtacggttcctattacgagttcccgtctcgtacaagagtcgacgtcaccatatctcgnggacaccgtccagctaaattctacgttttaccctagaacgtattgtagtttctggtcgacccggccgctacggaaccgtacgggtttctttaacgttacgtggtacggccggtaaggaacgtaccggtactttaattacgttaggtttagtttttagggtagtttaggtttatttccgtaacgtacccgtaggtacgtccgggacggggtccgttcccggtaaccccgtggggaccgaggggtaacttacggtcgtacctccgtccttacccgttacgcccttacccgaacccgtaaccggggtacccctacggttccccggttccccttcccccgtacgggtaccccttaccccgtcccctaaccggtaacgtcccggtaccccg

SEQ ID NO: 138291 - DNA, 619 bp, Homo sapiens
  misc_feature: GYAE6OF01BVTOP.46.67.G01.1.454.CMB.1.raw
  modified_base (192)..(192): a, c, t, g, unknown or other
  misc_feature (192)..(192): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacgttcggccgggacaagtcggaactattcgacaccttatttaaattggtatacaacatagaccgagggaccgaccctagctacctaatctatgctgcatcctagtttcgacgtaaaggtcggggtacccagtcggtaggttcgaggtggcgaggtggagtcgtaggactagtactttcactctcactatactagtactctgactagtagtaagttatttcgacttaacttattactagtaactaactaagttaaacttaactaacgtttacggttttaccggaaccgtaacggtacctaaccgtaacttaaactaaacgttaacgtaacgttggtacggtactacgacctaccgtattcgttacgttccttacctacctttcccttaccccgacttaccttacgtagttaac

SEQ ID NO: 138292 - DNA, 676 bp, Homo sapiens
  misc_feature: GYAE6OF01C3KGE.46.67.G01.1.454.CMB.1.raw
  modified_base (329)..(329): a, c, t, g, unknown or other
  misc_feature (329)..(329): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcgggagacccctgtcccctcacctgcgctgtctctggtgcctccatcagtagtggtttcttcgtggggctgggtccgcagcctcccgaggggaacggggctggaatacagttggaagttgtcctctcagtaggtggacggtttcctattacacgttccgtctctacaagagtcgagtcaccatatctctggacncgtccagctaatctacgttttcccagaacgtatgtagtttctgtcgacccgcgtcgtggaaccgacggggttactttaattacgtggtcgacggaggtaacggacggtactttaattagttaggtttaagtttttgggtaaggtttggttttacctttacggaacccttaacccgtaggtaccgtcgggacggggtcctccggaccccgtggggacccgaagggtacttacgtcggtaccgaccgttctacccgttagccccttaccgacccgtaaccgggtccctaggttcccggttaccccttccccggtacgtcccctacccttccgacccacgtcgtaccccg

SEQ ID NO: 138293 - DNA, 563 bp, Homo sapiens
  misc_feature: GYAE6OF01A0FMI.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacggccctaagctcctaatctatgctgcatcctagtttgctaaagtcgggtcccatcgaggttcagtggcagtggatcgtgggacagtatttcactctcacctatcagtatctgacaacgtgaagtatttacgactaacttattactgtacaaactagtaaattaactaattgttttacggaccgaagggtaacctaacgtaacttaaacgaaacgttaaaccgaacttaggtacggaccttaggacctaccattcttcgttccttactacttcccttaccccgcctacttctagtac

SEQ ID NO: 138294 - DNA, 724 bp, Homo sapiens
  misc_feature: GYAE6OF01C6RRT.46.67.G01.1.454.CMB.1.raw
  modified_base (173)..(173): a, c, t, g, unknown or other
  misc_feature (173)..(173): n is a, c, g, or t
  modified_base (305)..(305): a, c, t, g, unknown or other
  misc_feature (305)..(305): n is a, c, g, or t
  modified_base (360)..(360): a, c, t, g, unknown or other
  misc_feature (360)..(360): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactgggtgaggccttcggagaccctgtccctcacctgcgctgtctcgtggtncctccatcagtagtggtttctcgtggggctgggtccggcagcctccgaggggaaggggctaggaatacgagttgggaagttctctctactagtaggtcggaggtttcctattacagttccgtctctcgaagngtcgagtcacctatactctcgtgacacgtccagacaatctagttttcccagaagnttacgtagttctggtcgacccgcggtacttggaaccgtaggttcgggttacgttttacgtacgttgggtacgtacggtaaggacggtaccggtattagttagttagtttaggtttggttaaggttagtttacgttaccgtacctaaccggtagtacggtacggggaccggggtacgttacccggacccgggtcgggaaccgtaacgggtaacgtcgttacggtacccgtaacccgttccgttacccgttaccgtaccccgtacccgtaaaccgggtacccggtaaccctcccgggtttaccccgtccccgttacccccgtcgggtaaccccctacccccgtaccgttaacccggagtacccccg

SEQ ID NO: 138295 - DNA, 781 bp, Homo sapiens
  misc_feature: GYAE6OF01AX12W.46.67.G01.1.454.CMB.1.raw
  modified_base (177)..(177): a, c, t, g, unknown or other
  misc_feature (177)..(177): n is a, c, g, or t
  modified_base (182)..(182): a, c, t, g, unknown or other
  misc_feature (182)..(182): n is a, c, g, or t
  modified_base (248)..(248): a, c, t, g, unknown or other
  misc_feature (248)..(248): n is a, c, g, or t
tcagactagcagtacacgaccggtgctcgatttagagtatacatattgggtttgggggagtactcggtcaggactacgacgcaagtacggacagtagaccgggtccccgctcagcttcctgggtctcctgctactctggctccgaggtgccagatgtgactatcgtagcctgacccngtccnccactccctcctgttctcgccgaaccgtagggagaccacgtcgtccacatcgaccttaggccgganaaggtcggtaacattcgacaccttagtttaactgtataccagactacggccacggacgccctaagcctacctatctagtcgctcgcactaccgtacgtttcgacgtaaggtccgggtccctacgtcgacggttcgtacgtggcgagtggtagtcgtaggggactaggtactttaccgaccttctcgaaccctataccgtaacgttaaccgttccgttacggaaccgttaaccggttagggtaaaccggtttatttttcggacccgtttaaaccgtttttaacgttactttacggtaacgtaaaccgtaaggttaaactttactaacgtttccgggtttacccgacccggtaaacgggtaaccgtttaaccgggtaaccgttaaaccggttaaacgtaaaccggtacggttagggtacggtaacccgttggtaaacccgtacccgttaaggttacccgttaccgggttaccctttacgtacccctttacccggttaccccgtacccgttacgtttaccccgtcggtttaacccg

SEQ ID NO: 138296 - DNA, 501 bp, Homo sapiens
  misc_feature: GYAE6OF01E27DY.46.67.G01.1.454.CMB.1.raw
  modified_base (470)..(470): a, c, t, g, unknown or other
  misc_feature (470)..(470): n is a, c, g, or t
  modified_base (495)..(495): a, c, t, g, unknown or other
  misc_feature (495)..(495): n is a, c, g, or t
  modified_base (497)..(497): a, c, t, g, unknown or other
  misc_feature (497)..(497): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggccctaagctcctaatctatgctgcatccagtttgctaaagtggggtcccatcgaggttcagtggcagtggatcgtgggacagatttcactctcacatcagtaatctgctaacgtgaagtattttgctaacttattacttgtactaacagaattactaatgtttcggaccaaggactacgactaacaaattaacgaactgngctgcacatctgtctcatctccgcntngtac

SEQ ID NO: 138297 - DNA, 678 bp, Homo sapiens
  misc_feature: GYAE6OF01CL639.46.67.G01.1.454.CMB.1.raw
  modified_base (221)..(221): a, c, t, g, unknown or other
  misc_feature (221)..(221): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtgggagacagtgtccaccatcacgttggccgggnaaggtcggaacattgactaccttatttaaattggtatcaacatagaccgagggaccggccctaagcctactaatctatgctgcactccagtttgactaaaggtcgggtacccagtcgaggttcgagtggctagtaggatcgtgggactagtactttcacttctacacctatctaagttaacttctagtaccgtaacgttaggtaaacgttattttacggaacttaaactttattacgttagtaacctaaacgtaagttaaactttaacgtaacgttttacggttttaccggaaccgttaaacgggaacctaacgtaaaccttaaaacctaaaacgttaaaccgtaaacggttcggttaggtaccttacggaaccctaaccgtaacgttaccgttccggtttaacctttaccctacgtttacccctttccccggaaccttaccttcgttaacgtaacg

SEQ ID NO: 138298 - DNA, 640 bp, Homo sapiens
  misc_feature: GYAE6OF01DF92T.46.67.G01.1.454.CMB.1.raw
  modified_base (191)..(191): a, c, t, g, unknown or other
  misc_feature (191)..(191): n is a, c, g, or t
  modified_base (215)..(215): a, c, t, g, unknown or other
  misc_feature (215)..(215): n is a, c, g, or t
  modified_base (224)..(224): a, c, t, g, unknown or other
  misc_feature (224)..(224): n is a, c, g, or t
tcagactagcagtacacgaccggtgctcgatttagagtatacatattgggtttggggagtctcggtcaggacacagcatggacatgagggtccccgctcagctcctggggctcctgctactctggctcgaggtgccagatgtgacatcgagctgacccagtctccatcctcctgtctgcaaccggtggganacagtgtcaccatcacttgccggnagtcgaacnttgactactatttaatgtatcaacatacgaccgagggaccgaccctaagcctactaatctatgctgctactccgtagtttgactaaggtcgggtaccagtcgtagttcagtggcgagtgatcgtgggactagtactttcacttcacactatacgtaagtaatctagactaacgtagtaagttatttacgaacttaactttacttaacgttacgtaactaaacgtaagttaaactttaactaagttttacggttttaaccggaaccgtaaacgggtaacctaaaccgttaacgttaaaacttaaaacgttaaaccgaacgttacggtacggaccttacggtaccgtaaaccttatttccgttacgttacctttacctactttccccggttaacccacctaacttccgttagtaaccg

SEQ ID NO: 138299 - DNA, 559 bp, Homo sapiens
  misc_feature: GYAE6OF01BMZ7P.46.67.G01.1.454.CMB.1.raw
  modified_base (228)..(228): a, c, t, g, unknown or other
  misc_feature (228)..(228): n is a, c, g, or t
  modified_base (346)..(346): a, c, t, g, unknown or other
  misc_feature (346)..(346): n is a, c, g, or t
  modified_base (369)..(369): a, c, t, g, unknown or other
  misc_feature (369)..(369): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacnttgacacctatttaaatggtatcaacatagaccagggacgccctaagctcctaatctatgctgcatccagtttgcaagtgggtcccatcgaggttcagtggctagtggatcgtggacngatttcactctcgccatcagtanctgcaacgtgaagtatttgactaacttattactgtactaactaagtaattacaattcgtttacggaccgtaaggactacgaacttaacaaacgttaaacgaacgtgtacggtactaggacctacctaatcgttacgttccttaccgtacttacccgtttacccccgtacccgtaacttccgttagtaacc

SEQ ID NO: 138300 - DNA, 739 bp, Homo sapiens
  misc_feature: GYAE6OF01CHICC.46.67.G01.1.454.CMB.1.raw
  modified_base (295)..(295): a, c, t, g, unknown or other
  misc_feature (295)..(295): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagttggtttcttcgtggggctgggtccggcagctccgagggaaggggctaggaatacgattgggaagttgtctctcatagtggaggttcctattacagtccgtctctacaagngtcgagtcaccatatctctcggacacgtccagcaatctagtttcccagaagatgtacgttctggtcgacccgcgtctagtaccgtacgggttcgtttaacttagtggttgacgagtacgacggtacttaagtttagttacgtttagtttttacgggtaggtttacggttttacgttttaccggtaacccttacccgtaagtaaccgttacgggaacccgggggtaccttccccgggtaaccccgggtaccggggaccggtaacggggtaactttaccggtacggttacccgtacccggttccttacccgttaacgtccccgttacccgtaaacccggtaaaccggggtacccccttaacgggttcccccggttccccgtttacccccccgttaccgggtacccctacccccgtacccgttacccgaaacggtccgtaaccccgg

SEQ ID NO: 138301 - DNA, 656 bp, Homo sapiens
  misc_feature: GYAE6OF01DTI19.46.67.G01.1.454.CMB.1.raw
  modified_base (192)..(192): a, c, t, g, unknown or other
  misc_feature (192)..(192): n is a, c, g, or t
  modified_base (216)..(216): a, c, t, g, unknown or other
  misc_feature (216)..(216): n is a, c, g, or t
  modified_base (226)..(226): a, c, t, g, unknown or other
  misc_feature (226)..(226): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccggnaagtcgaacntgacactattaaatgtatacaacatacgaccgagggaccgaccctaagcctacctaatctatgctgctatcctagtttgacgaaaggttcgggtccctagtcggtaggttcaggtggctaggtggtatcgtagggactaaggtactttaccacttccgtacacctattacaagttaacttcgtacgacgtaacgtagtaaacgttactttagacttaaactttattaactacgtaacaacgtaagttaaacttaactaagttcggttttaccggaacccgtaagggaacctaacggtaaccttaaacgtaaaacgtttaaaccgtaacgttggtacggtaccttacgaaccctaaccgtagtttacctcggtttacccttaccgtaaccgtttcccgttaccccgtaccttaacgttcgtagttaaaccg

SEQ ID NO: 138302 - DNA, 497 bp, Homo sapiens
  misc_feature: GYAE6OF01D3XAE.46.67.G01.1.454.CMB.1.raw
  modified_base (475)..(475): a, c, t, g, unknown or other
  misc_feature (475)..(475): n is a, c, g, or t
  modified_base (480)..(480): a, c, t, g, unknown or other
  misc_feature (480)..(480): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattgtatcaacatagaccaggacggccctaagctcctaatctatgctgcatccagtttgcaaagtgggtcccatcgaggttcagtggcagtggatcgtgggacagatttcactctcaccatcagtatctgacaacgtgaagtatttgactaactttattactgtacaacagtaattacaattgttttacgcgaaggacacgactaacaattaacgactgtgctgcacatctntctcntcttcccgcatctgtac

SEQ ID NO: 138303 - DNA, 568 bp, Homo sapiens
  misc_feature: GYAE6OF01CP5VS.46.67.G01.1.454.CMB.1.raw
  modified_base (194)..(194): a, c, t, g, unknown or other
  misc_feature (194)..(194): n is a, c, g, or t
  modified_base (331)..(331): a, c, t, g, unknown or other
  misc_feature (331)..(331): n is a, c, g, or t
  modified_base (336)..(336): a, c, t, g, unknown or other
  misc_feature (336)..(336): n is a, c, g, or t
  modified_base (346)..(346): a, c, t, g, unknown or other
  misc_feature (346)..(346): n is a, c, g, or t
  modified_base (354)..(354): a, c, t, g, unknown or other
  misc_feature (354)..(354): n is a, c, g, or t
  modified_base (359)..(359): a, c, t, g, unknown or other
  misc_feature (359)..(359): n is a, c, g, or t
  modified_base (381)..(381): a, c, t, g, unknown or other
  misc_feature (381)..(381): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctcngggctgggtccgcagctccgagggaggggctggaatacattggaagtgtctctcatagtggaggttcctattacagtccgtctctcaagagtcgagccaccatatctctggacacgtccagcaatctagttttcccngaagntgagttctgngaccgcgntgacncgggtctttatactgtgcgagngacggctattatgtattttggagttggttattcgactacctagacgtcggacggggctcgaccccgtggggccagggtactacgtggtaccaccgtcgtccttacgccctaccgaccgaacgggacccacgtcccggttacccttcccccgtggtaccctaccccgttccctccgaaagcgtacccg

SEQ ID NO: 138304 - DNA, 606 bp, Homo sapiens
  misc_feature: GYAE6OF01DRF0U.46.67.G01.1.454.CMB.1.raw
  modified_base (374)..(374): a, c, t, g, unknown or other
  misc_feature (374)..(374): n is a, c, g, or t
tcagactagcagtacacgaccggtgctcgatttagagtatacatattgggtttgtcctacctgcctggtggcagcctcccagatgggtcctcgtccctggtgcaactggcagggagtccgggcccacgtactgggtgaggccttcggagaccctgtccctcacctgccgctgtctctggtgcctccatcgagtagtggttttcttacgtggggctggggtcccggcagccgtcccgaggggaaggggctagggaactacgtagttggaagttcgtctcgtcatagtggtaggttcctattacacgtcccgtctctacgaagtagtcgaggtcaccgatagtctcgtggacacgtcagcgaatctacgtttcccnggtaacgagtgtagttctagtcgtaccgcgctgacacgggtctttatacgtgtgcgagtagacggtactagttagtgtagtttaggagttggttattcgtactacctagacgtacggacgggtctcggacccgtgggaccgagggtatacgtggtacacgtctcctagccgtccacgacggcctacggtccggtccttccccgcggtcctaccctcctaccacgcgtacccg

SEQ ID NO: 138305 - DNA, 566 bp, Homo sapiens
  misc_feature: GYAE6OF01BU4ZB.46.67.G01.1.454.CMB.1.raw
  modified_base (248)..(248): a, c, t, g, unknown or other
  misc_feature (248)..(248): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctctggggctgggtccgnagctccgagggaagggctggaatacagttggaagtgtctctcatagtggaggttctattacagtccgtctctcaagacgtcgagtcaccatatctctggacacgtcagctaatctacgttttcccagtaagatgagttcgtgtcgaccgccgtctacgacgtacgggtacgtttattactgtgcgaggagacggtacttattagtgttagttttggtagttggtttatttcgactacctagacgtacggcgggtccgtccggacccggtgggacgagggactacgtcgtccgtaccgtccttcgttcgcccgtacccg

SEQ ID NO: 138306 - DNA, 582 bp, Homo sapiens
  misc_feature: GYAE6OF01BSE2L.46.67.G01.1.454.CMB.1.raw
  modified_base (192)..(192): a, c, t, g, unknown or other
  misc_feature (192)..(192): n is a, c, g, or t
  modified_base (217)..(217): a, c, t, g, unknown or other
  misc_feature (217)..(217): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccgggnaagtcggaacattgactacctatttaaattggtatcaacatagaccagggacgccctaagctcctaatctatgctgcatccagtttgcaaaggtgggtcccatcgaggttcagtggcagtggatcgtgggactagtatttcactctacacctatcagtaactctacgactaacgttagtaaagttaattttgaacttaaactttacttaacttagtaaccaaatacgtaaatttaactaatttcggttttaccggaacgtaacgggactaacgtaactaactaaaattaaccgaacgttgtacggtctacgcgtaacctattcttgttaccttcaacttcccttacccgacctactcgttgtaac

SEQ ID NO: 138307 - DNA, 818 bp, Homo sapiens
  misc_feature: GYAE6OF01DR7AO.46.67.G01.1.454.CMB.1.raw
tcagactagcagtacacgaccggtgctcgatttagagtatacatattggggtttggggagtctcggtcaggacacagcatggacatgagggtccccgctcagctcctggggctcctgctactctggctccgaggtgccagatgtgacatcgagctgacccagtctccactcctccctgtctgcaaccggtgggacacgaggtcgtccaccatcacgttcggccgggactaaggtaccggaactattacgaacctaaccttaatttaaagttggtaatacaactagtaacgaccgacggggaccgaccctaagccttacctaagttcctaagtcgtcctagacctacttacccgtaggttttacgaacgtaaaacggggttccggggttacccctaaggttaccgggtaacgggtttcgtaaggtcgggtaccgtaagggtacgggtaagttccggtaaggggtacgtaacgttactttaccaaccttcgtaccctaacctacgttaccgtaaagttaacttccgtacggaccgtaaacggttggtaaaagtttacgtttttacggaacctttaaacgtttaacgtttaacgttacgttaaaccctaaagttaaccggtaaattttaaccgtaacgttttacgggtttacccggaaaccggtaaacgggtaacctaaaccggtaaaaccttaaacgttaaaacgttaaaaccggtacgttacgggtacggtaccgtacggtaaccctaaccgtacttacgtttacgtacctttacttacccgtttacccctacccgtaccttacttccgtacggttaac

SEQ ID NO: 138308 - DNA, 602 bp, Homo sapiens
  misc_feature: GYAE6OF01CQQIR.46.67.G01.1.454.CMB.1.raw
  modified_base (220)..(220): a, c, t, g, unknown or other
  misc_feature (220)..(220): n is a, c, g, or t
  modified_base (256)..(256): a, c, t, g, unknown or other
  misc_feature (256)..(256): n is a, c, g, or t
  modified_base (420)..(420): a, c, t, g, unknown or other
  misc_feature (420)..(420): n is a, c, g, or t
tcagactagcagtacacgaccggtgctcgatttagagtatacatattggggtttggggagtctcggtcaggacacagcatggacatgagggtccccgctcagctcctggggctcctgctactctggctcgaggtgccagatgtgacatcgagctgacccagtcctccatcctccctgtctggcaaccgtgggagaccagtgtcaccatcacttgccgggnaagtcggaacattgacactatttaaatggtatcaanatagaccagggaccgccctaagctctaatctatgctgcactccagtttgacaaggtcgggtacccagtccgaggttcaggtggcgtaggtggatcgtaggggactagtatttccactctaccgactatacaggtaaacttcgtgaccgtaacgtagtaaagttnttttagaacttaatttaacttacttcgtacaactaagtaattacaatttggtttaccgacgtaacgggaactacggtaacctaacgtaaacgttaacgtaacgttggtacgcgttacgaaccgtaaccttaagtcctcgtttacttcactttcccgttaccccgtctaacttcgtagttaac

SEQ ID NO: 138309 - DNA, 706 bp, Homo sapiens
  misc_feature: GYAE6OF01EI62K.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacgccctaagcctcctaatctatgctgcatcctagtttgactaaggtcggggtcccagtcggtaggttcaggtggcgagtggtatcgtagggactaggtactttcactctacaaccatactaagttaactctacgactaacggttacgtaaagttagtttttacgactttaaacttttagtttacttacggttaccaaaacgtaagtaaacttttaaccgtaagtttacggttttaaccgggaacccggtaaaggggtaccctaaaccggttaaaccttaaaccgtaaaacgtttaaaaaccggtaaccgttacgggttacgggttacctaccgggtaaccctaacccgttaattacccggtttacgttacccttttaccctaaccgtttcccccgtttacccccggtacccttaacgttcccgttaaggttaaaccccg

SEQ ID NO: 138310 - DNA, 586 bp, Homo sapiens
  misc_feature: GYAE6OF01A866W.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcgaacattgacaccttattaaattggtatcaacatacgaccagggacgccctaagctactaatctatgctgcatcctagtttgactaaaggtcgggtacccagtcgtaggttcaggtgcgtagtggatcgtagggactagtactttcactctcactatacagtaatctagactaacgtagtaagttatttacgactaaactttattactagtacaactaagtaacttactaagtttcgtttacggaacgtaacgggaactaacgtaacttaaactaaacgttaaacgacgtagtacgtctacgaccactattaccgtgttacccttacgtaccttaccgttaccccgaccttattccgtgtaacc

SEQ ID NO: 138311 - DNA, 604 bp, Homo sapiens
  misc_feature: GYAE6OF01CKODU.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtgggagacagtgtcaccatcacttgccgggcaagtcggaacattgacactatttaaatgtatcaacatagacagggacgccctaagctctaatctatgctgcatccagtttgacaaaggtcggggtccagtcgaggttcagtggcagtggatcgtgggacagtatttcactctcacctatcagtaatctagacaagtagaagttattttcgactaatttacttactagtacaactaagtaaacttactaagtttcgttttaccggacgtaaacgggtaactaacggtaaacttaaactaaaacgtttaaccgaaacgtttaggtacggtaccgttacggtaacctaaccttagttaccttcggttacctttacctaacgtttacccctttaccccgacctaacttccgttagtaacc

SEQ ID NO: 138312 - DNA, 661 bp, Homo sapiens
  misc_feature: GYAE6OF01ENI6C.46.67.G01.1.454.CMB.1.raw
  modified_base (212)..(212): a, c, t, g, unknown or other
  misc_feature (212)..(212): n is a, c, g, or t
  modified_base (248)..(248): a, c, t, g, unknown or other
  misc_feature (248)..(248): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtcncctcatcagtagtggtttctcgtgggctgggtccgnagctccgagggagggctaggaatactagttggaagtgtctctctagtaggtggtacggtttcctaattaccgacggttcccgtctcgtacgaagtacgtcgacgtccaacctattactctacgtacggacctacgtccaagtcctaattctacgttttcccagaagtatgtagtttctggttcgacccgtccgtcgtacggaaccgtacgggttacttttacgttacgttggtcggacggtaaggacggtacggtacttagttagttcggtttagttttgggagtttgtttacttccgaactaccgtagtacgtcgggtaccggggtcctacccggacccggttggggaccgtaaggggtaacttacggtcgggtaccctacccgttccttaccctacggccccttaacccgg

SEQ ID NO: 138313 - DNA, 803 bp, Homo sapiens
  misc_feature: GYAE6OF01CPF7B.46.67.G01.1.454.CMB.1.raw
  modified_base (176)..(176): a, c, t, g, unknown or other
  misc_feature (176)..(176): n is a, c, g, or t
  modified_base (215)..(215): a, c, t, g, unknown or other
  misc_feature (215)..(215): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcgggagacccctgtcccctcacctgcgctgtctcgtggtcncctccatcagttagtggtttctcgtggggctgggtccgnagctccgaggggagggctaggaatacagttggaagttgtctactctagtaggtggtacggttcctaagttacagttcccgtcttcctacgaaggtcgtcgaagtccaaccgattactccgtacgtagggacccacggttccaaggtacctaaacttccgtaacgtttttccccagggaaaatcgttggtaactttcgtggtaaccggaacccgtcgtacgttacggaaccgttacggggttacctttttaagtaccgtggtacggacggaaggtaacggtaccggttaccgttaagtttagttaggtttaacggttttttagggacggttttacgggttttactttacggtaacccgttaacccggttaggtaaccggttacggggaccgggggtccttacccgggtaaccccgtcgggggaacccggaagggtaaccttacggttcggttaaccgtcccgttaccgttccgttaccgcccgtacccgaaacccggaccgggtacccctaacggttcccggttaccccgttaccccgttccgtaccccgttaccccgttaccgtaacccgaaaggacccgtaccccgg

SEQ ID NO: 138314 - DNA, 679 bp, Homo sapiens
  misc_feature: GYAE6OF01AD854.46.67.G01.1.454.CMB.1.raw
tcagactagcagtacacgaccggtgctcgatttagagtatacatattgggtttgggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacaccttatttaattgtatcaacatagaccagggaccgccctaagcctacctaatctatgctgcatcctagtttacgcgtaaaggtcggggtcccagtcggtaggttcaggtggcgtaggtggatcgtgggactaggtactttcgaccttcctacacctagtctaagttactctggactaacggtagtaagttactttcgaacgttaacctttacgttacgtagtaaccaaacgttaagtaaactttaacgtaacgttttacggttttaccggaaccgttaacggggtacctaaacccggttaaactaaaccgttaaaacgtttaaacccgtacggttagggtacggtaccgttaaccggacctaacccgttaagtttaccgttcgtttaccctttaaccgtaacttcccgtttaaccccgccttaacgttccgttagttaaccccg

SEQ ID NO: 138315 - DNA, 578 bp, Homo sapiens
  misc_feature: GYAE6OF01CKCPB.46.67.G01.1.454.CMB.1.raw
  modified_base (289)..(289): a, c, t, g, unknown or other
  misc_feature (289)..(289): n is a, c, g, or t
  modified_base (349)..(349): a, c, t, g, unknown or other
  misc_feature (349)..(349): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccaggggaaggggctggaatacattggaagtgtctctcatagtggaggttcctattacagtccgtctctcaagngtcgagtcaccatatctctggacacgtcagcaatcagttttccctgaacgatgagtttcngtgaccgccgctgacacgggtgttttatactgtgtcgagagacggctattatgtattttggagttggttatttcgacacctagatcggacggggctcggaccccgtggggccagggtatacgtcggtccaccgtctccgttacgccctccgaccgacgggccccaagttcccggtacccttccccccgtcgggtccccaccccgttccttaccccgaaggccgtacccg

SEQ ID NO: 138316 - DNA, 536 bp, Homo sapiens
  misc_feature: GYAE6OF01D5BBF.46.67.G01.1.454.CMB.1.raw
  modified_base (407)..(407): a, c, t, g, unknown or other
  misc_feature (407)..(407): n is a, c, g, or t
  modified_base (472)..(472): a, c, t, g, unknown or other
  misc_feature (472)..(472): n is a, c, g, or t
  modified_base (522)..(522): a, c, t, g, unknown or other
  misc_feature (522)..(522): n is a, c, g, or t
tcagactagcagtacacgaccggtgctcgatttagagtatacatattgggtttgggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggaccgccctaagctacctaatctatgctgcatcctagtttgacgtaaaggtcggggtaccctagtcggtaggttcaaggtggcaggtggatcgtgggacagtattcactctcacatacagtaactctagcaagtgaaagtntttagactaatttattactagtacaaacataattactattgtttcgacgaaggactacgactaanaattaacgactgtagctagactactatctgtacttcacttccttacccgntactccgtagtacc

SEQ ID NO: 138317 - DNA, 589 bp, Homo sapiens
  misc_feature: GYAE6OF01DTQM4.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtgggagacagtgtcaccatcacttgccgggcaagtcggaacattgacacctatttaatgtatcaacatagaccagggacgccctaagctactaatctatgctgcatccagtttgacaaggtcgggtcccagtcgaggttcagtgcagtgatcgtggacagtatttcactctcaccatacagtaatctagacaacgtagtaagtagtttagactaactttattactacgtacaactaagtaacttaactaagtttcgttttacgacgtaagggactagtacgtaaccttaacgtaaacgttaaacgtaacgttaggtacggtacgtacgacctaacctaacgtttccttacgttactttacctaccgtttaccccttaccccggtaccttacgttccgtaacg

SEQ ID NO: 138318 - DNA, 671 bp, Homo sapiens
  misc_feature: GYAE6OF01EO4HE.46.67.G01.1.454.CMB.1.raw
  modified_base (171)..(171): a, c, t, g, unknown or other
  misc_feature (171)..(171): n is a, c, g, or t
  modified_base (344)..(344): a, c, t, g, unknown or other
  misc_feature (344)..(344): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtncctcatcagtagtggtttctcgtgggctgggtccggcagctcccgagggaaggggctaggaatacagttaggaagtgtctctcagtagtggaggttcctattacagtccgtctctcaagagtcgagtcaccatatctctggtacacgtcagacaatctacgttttccagtaanatagagttctggtcgaccgccgactgaccgtacgggtcgttttaacttacgtgtggacgaggacgtacggtcttattaagttgttagttttggtagttggtttactttacgacctaccgtagtacgtacgggacgggtcgtacccggtacccggtggggacccgaagggttaactaccggtcggtaccgtacccggtaccttcccgtacggtccctaacccgtacccggaaaccgggtccccgtaacgttcccgggttcccccgttaccccccgttaccggcccctaccccccttacccgtaaccccgtaaaggtcccgtaaccccg

SEQ ID NO: 138319 - DNA, 616 bp, Homo sapiens
  misc_feature: GYAE6OF01EY8PY.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccgcagctcccgagggaaggggctaggaatacattggaagtgtctctcataggtggaggttcctattacagtccgtctctcaagagtcgagtcaccatatctctggacacgtccagcaatctagttttcccagaagatgtagttctgtcgaccgccgtctgacgtacgggtcgtttatcgtgtgcgagagacggtctattagtgttagttttggagttggttactttcgtactaccgtagtacgtcgggaccggggtctaccggacccgtcggggaccgaagggtaacttacgtacggtccgtaccgtcttccgttacgtccctacccgaaccggaacgggtcccacgttccgttccccgttccccccgtcggtaccctacccccttaccctacccgtagaccgtacccg

SEQ ID NO: 138320 - DNA, 648 bp, Homo sapiens
  misc_feature: GYAE6OF01A23PY.46.67.G01.1.454.CMB.1.raw
  modified_base (193)..(193): a, c, t, g, unknown or other
  misc_feature (193)..(193): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatccctccctgtccgcaaccgtggganacagtgtcaccatcacttgccgggcagtcggaacattgacaccttatttaaatgtatcaacatagaccagggacgaccctaagctacctatctatgctgctatcctagtttgacgtaaaggtcgggtcccagtcggagttcaggtcggcaggtgatcgtagggactagtatttcactcctacacctatcctaagttaactcgtacgtaccgtaaacgttggtaaagttacttttacggaccttaaacgtttactttaacgttacgttaaccaaacgttaagtaaactttaacgttaatttacgggttttaccggaaccgtaaacggggtacctaacgttaaaccgtaaaccttaaaacgttaaaccgtattacggtacggtacttacggacctaaccgtattccttaggttccttacacttcccgttaccctacctaattctcgttaacgtaccg

SEQ ID NO: 138321 - DNA, 621 bp, Homo sapiens
  misc_feature: GYAE6OF01CNHCC.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctctggggctgggtccgcagctcccgagggagggctggaatacagttggaagtgtctctcatagtggaggttcctattacagtccgtctctcaagagtcgagtcaccatatctctggacacgtccagacaatctagttttccctagaagatgagttctgtcgaccgcgctgacgacgggtcgtttaatactgtgcgagagacggtctattatgtagttttggagttggttatttcgactacccgtagtacgtcggacggggtctaccggtaccccgtaggggcccgtagggtaactacgttcggtccgtaccgtccgttacccgttacgcccttacccgaacccgtaacgggtcccccaacgttcccgggttacccctttaccccccgtcgggtacccctaccccgttccctacccgaacgcgtaaccccg

SEQ ID NO: 138322 - DNA, 739 bp, Homo sapiens
  misc_feature: GYAE6OF01CPJ7D.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtcctggtgcaactgcaggacgtcgggcccacgacgtggtgcggccttcggacgtccctgtccctcacctgccgctgtctcgtggtcgcctcatcagttcgttgtttctcggtggggcttcggggccgcagccgtaccggaggggagggcgtaggaatacgtagttaggagtcgtctctgtagtagtgggtacgttcttacgttaacgtcgttccgtctctacgaagtcgtcgacgttcaacctattactcgttacgacggtacaccgtacgacgtactaacttaccgttacgtttttaccctaaggtaacgtagttacgtacgtttccgtaggtccgtacccgggccgtcgtacggaccggttacgggtttactttagttacgtcggtacgacggaaggtaccggtagttactttaagttcggttaagttttaggtttttagggtaggtttagttttacgttacgtaacccgtaccggttaaggtacgggtccgggtaccggggttcccgttacccgggcccggggtacggggaacggtacgggtaaccgttacggttccggtaacccggttcccgttacttacccgggttcctaccccggtaaccccgg

SEQ ID NO: 138323 - DNA, 626 bp, Homo sapiens
  misc_feature: GYAE6OF01B7Q1M.46.67.G01.1.454.CMB.1.raw
  modified_base (283)..(283): a, c, t, g, unknown or other
  misc_feature (283)..(283): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctcatcagtagtggtttctcgtgggctgggtccgcagctcccgagggaagggctggaatacattggaatgtctctcatagtggagttcctattacagtccgtctctcaagngtcgagtcaccatactctctggacacgtcagcaatctagtttccagaagatgagttctgtcgaccgcgctgactacgggtctttaatacgtgtgcgagagacggtcttattagtgtagttttaggagttaggtttatttacgacctacccgtaagacgtacgggacggggtcctccggtaccccggtggggaccgaagggtaactaccgttcggtacctaccgttccttccgttacgcccttacccgaacccgtaaccgggtccccaacgttcccggttaccccgtttccccccgtacggtacccctaaccccgttcccctaacccaacggaccgtaccccgg

SEQ ID NO: 138324 - DNA, 662 bp, Homo sapiens
  misc_feature: GYAE6OF01AJMOO.46.67.G01.1.454.CMB.1.raw
  modified_base (207)..(207): a, c, t, g, unknown or other
  misc_feature (207)..(207): n is a, c, g, or t
  modified_base (213)..(213): a, c, t, g, unknown or other
  misc_feature (213)..(213): n is a, c, g, or t
  modified_base (247)..(247): a, c, t, g, unknown or other
  misc_feature (247)..(247): n is a, c, g, or t
  modified_base (308)..(308): a, c, t, g, unknown or other
  misc_feature (308)..(308): n is a, c, g, or t
  modified_base (398)..(398): a, c, t, g, unknown or other
  misc_feature (398)..(398): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtcctntggtcncctcatcagtgtgtttctcgtgggctgggtccgnagctccgagggagggctaggaatacgagttggatgtctctcataggtggtagttctatacncgtccgtctctacaagtcgtcgacgtcaacctattactctacgtcggaccacgttccaagtcaacttcgtacgttttacccgagaacgtntcgtacgttcgtgtacgacccgcgtcgtaggaccgtacgggtcttttaagtcgtgtacggacgtaggacgacggttacttaagtttacgttaggtttagtttttacgggagtttaggtttaactttaccggaaccttacccgttaggtacggaccgggtacccgggggtcctacccgggtaccccggtggggacccgtaagggtaaccgttaccggtccggttaccgtacccgttccgttacccgtccgtccccgtaaccccgg

SEQ ID NO: 138325 - DNA, 635 bp, Homo sapiens
  misc_feature: GYAE6OF01ARFEM.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctcatcagtagttggtttctcgtggggctgggtccggcagcctcccgagggaagggctggaatacagttggaagtgtctctcagtagtggtacggttcctattacagtccgtctctacaagtgtcgagtcacatatctctgacacgtcagctaatctacgttttccagtaagtatgtacgtttctgtcgaccgtccgtcgtacgtaacgtacgggttacgttttagtttacgtggtcgacggtaggacggtacgggtacttaagtttacgttagttaggtttttggaggtttaggtttacgtttcgtaaccgtaccgttagtacgtaccgggtaccggggtcctcccggtacccgggtggggacccgtaagggaacgttacgtcgggtacctacccgttcttacccgtcgtcccgtaacccgg

SEQ ID NO: 138326 - DNA, 762 bp, Homo sapiens
  misc_feature: GYAE6OF01CTBXG.46.67.G01.1.454.CMB.1.raw
  modified_base (174)..(174): a, c, t, g, unknown or other
  misc_feature (174)..(174): n is a, c, g, or t
  modified_base (265)..(265): a, c, t, g, unknown or other
  misc_feature (265)..(265): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcgggacgaccctgtccctcacctgcgctgtctctggtcncctccatcagtagtggtttctcgtggggctcgggtccgcagcctccgaaggggagggctaggaatacagttgggaagttcgtactccgtanaagttaggtacgggtacggtttaccttaagttaacgaaggttaccgtccttactacgaaaggtacgtacgaacgtaccaacctattactcctacgtacggacctacgtaccagactaactccttaacgttttcccaaggaagtagtacggtacgttcgtacggtaccggacccggtccgtacgtacggaacccggtacgggtttactttttaacgttaccgtggttacggacggtaggtaacggtacggtacttaagttagttaggtttagttttagggtaggtttagttacgttaccgacctaaccgttagacgtacgggacgggtaccgtaccggacccgggtacgggaccgaacgggtaacgtaccggtcggtacccgtaccgttccttaccgttaccgccctacccgaaccggaccgggtaccctacggtcccggttccccttacccccggtacgtaccccctacccgtacccaaccgtaacgcccgtacccg

SEQ ID NO: 138327 - DNA, 589 bp, Homo sapiens
  misc_feature: GYAE6OF01DNZ82.46.67.G01.1.454.CMB.1.raw
  modified_base (152)..(152): a, c, t, g, unknown or other
  misc_feature (152)..(152): n is a, c, g, or t
  modified_base (313)..(313): a, c, t, g, unknown or other
  misc_feature (313)..(313): n is a, c, g, or t
  modified_base (376)..(376): a, c, t, g, unknown or other
  misc_feature (376)..(376): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctnacctgcgctgtctctggtgcctccatcagtagtggtttctcgtggggctgggtccggcagcctcccgagggaaggggctaggaatacagttggaagtgtctctcatagtggaggttcctattacagttccgtctctcaagagtcgagtcaaccatatctcnggacacgtcagcaatctaagtttcccagaacatgagttctagtcgaccgcgctgacgacggtntttaatacgtgtgcgagagacgtctattagtagttattttggagttgtttattacgactaccctagactcggacggggtctccggacccgtggggtaccgagggtaacgttacgtggtaccaccgtccgtaccgttacgccctcgacccgtaagggccctacggtccgttaccctccccctacggtccctaccctccctacaacgcgtacccg

SEQ ID NO: 138328 - DNA, 559 bp, Homo sapiens
  misc_feature: GYAE6OF01DMCZ0.46.67.G01.1.454.CMB.1.raw
  modified_base (235)..(235): a, c, t, g, unknown or other
  misc_feature (235)..(235): n is a, c, g, or t
  modified_base (330)..(330): a, c, t, g, unknown or other
  misc_feature (330)..(330): n is a, c, g, or t
  modified_base (383)..(383): a, c, t, g, unknown or other
  misc_feature (383)..(383): n is a, c, g, or t
  modified_base (438)..(438): a, c, t, g, unknown or other
  misc_feature (438)..(438): n is a, c, g, or t
  modified_base (443)..(443): a, c, t, g, unknown or other
  misc_feature (443)..(443): n is a, c, g, or t
  modified_base (539)..(539): a, c, t, g, unknown or other
  misc_feature (539)..(539): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccagactggtgaggccttcggagaccctgtccctcacctgcgctgtctctggtgcctccatcagtagtggtttcttcgnggggctggggtccggcagctccgagggaaggggctgggaatacattggaagtgtctctcatagtggaggttcctattacagtccgtctctcaagngtcgagtcactatatctctggacacgtccagcaactcagttttccctgaacgntgagttctgtcgaccgcgctgaccgacgggtctttattactgtcgcgagagcggntattntagttagttttggagttggttatttcgactcctagactcgggaccgggtctccggacccgtggggccgaagggaacttcgtcggtctaacccgttntcccgttgtccctaaccccg

SEQ ID NO: 138329 - DNA, 558 bp, Homo sapiens
  misc_feature: GYAE6OF01BCIMQ.46.67.G01.1.454.CMB.1.raw
  modified_base (217)..(217): a, c, t, g, unknown or other
  misc_feature (217)..(217): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggnaagtcggaacattgacacttattaaattgtatcaacatagacaggacggccctaagctcctaatctatgctgcatcagtttgcaaagtgggtccatcgagttcagtggcagtggatcgtgggacagtatttcactctcaccatcaagtatctgacaacgtgaagtattttgactaactttattactgtactaactagtaaattactaagttgttttacgggacctaaggggacctaagtaacctaaactaaatttaaacggaacttggtacggcttagacctaacctatcttagttacctttcgtaacttcccgtttacccgacctaactccgttgtaacg

SEQ ID NO: 138330 - DNA, 610 bp, Homo sapiens
  misc_feature: GYAE6OF01B9WI1.46.67.G01.1.454.CMB.1.raw
tcagactagcagtacacgaccggtgctcgatttagagtatacataagttagggtttaggggacctccttgtgcaagaacgatgaaagactacctgtggtttgtcctcctgctggtggcagctcccagatgggtcctgtccctggtgcaactgcgaggagtcgggcccacgactggtgaggccttcggagaccctgtccctcacctgcgctgtctctggtgcctcatcagtagtgtttctcgtgggctgggtccgcagcctaccgagggagggctggaatacagttgaagtgtctctcatgtggtacgttctagtacacgtccgtctctacgaagtacgtcgagtcaaccgtatactctcgtagacacgtccagtctaatcgtacgtttaccctaggtaagtagtagtacgttcgtcgtacgacccgtccgtcgtcgaccgtacggttactttagtacgtgtacgacgtagtcgtacgtacttagttagtcgtttaagtttgggtagttcgttacttacgacgtacctagtcgtcgggacggtaccgtaccggccggtggaccgtaggtactacggtcgtacctaccgtactccgttacgcccgtaacccg

SEQ ID NO: 138331 - DNA, 625 bp, Homo sapiens
  misc_feature: GYAE6OF01DA5Z4.46.67.G01.1.454.CMB.1.raw
  modified_base (222)..(222): a, c, t, g, unknown or other
  misc_feature (222)..(222): n is a, c, g, or t
tcagactagcagtacacgaccggtgctcgatttagagtatacatattgggtttggggagtctcggtcaggacacagcatggacatgagggtccccgctcagctccgtggggctcctgctactctggctccgaggtgccagatgtgacatcgagctgacccagtctccatccctccctgtctgcaaccggtgggagacagtcgcacatcacgttggccggganaagtcgaacattgacaccttaatttaagtgtatacaatagacgaccgagggtaccgaccctaagctactaatctatgctgacatcctagttgacgtaaggtcgggtaccagtcgagtcagtgcgtagtggatcggtaggactagtacttcactctacgacatacaagtatcgtagactacgtagtaagttactttacgaactaactttattacgtactaacctaaataagttaacttaacgtaagtttacggtttaccggaaccgtaacggaacctaacggtaaacttaaacgtaaaacgttaaacgaacgttagtacgtaccgttacgaacctaacctaagttcttacgttaccttactaaccgttccctttaaccccggacttaacgttcgtacgttaacc

SEQ ID NO: 138332 - DNA, 657 bp, Homo sapiens
  misc_feature: GYAE6OF01CLHL9.46.67.G01.1.454.CMB.1.raw
  modified_base (189)..(189): a, c, t, g, unknown or other
  misc_feature (189)..(189): n is a, c, g, or t
  modified_base (214)..(214): a, c, t, g, unknown or other
  misc_feature (214)..(214): n is a, c, g, or t
tcagactagcagtacacgaccggtgctcgatttagagtatacatattggggtttggggagtctcggtcaggacacagcatggacatgaggtccccgctcagctcctggggctcctgctactctggctccgaggtgccagatgtgacatcgagctgacccagtctcatcctcctgtctgcaaccgtgganacagtgtcacatcacttgccggganaagtcgaatattcgacactatttaagtgtatacaacagtacgaccgaggaccgaccctaagctactatctatgctgacatccgagtttacgacgtaaggtcgggtacctagtcggtagttacgaggtcggtacgtaggtaggtattcggtagggaactacgtactttaccgacttacctaaccacctactacaaggttaactcgtaggtacctaacgtagtaagttactttcgaacttaactttataacgtagtaaccgaaacgttaaggttaaacttaacgttaaggtttacggttttaccggaaaccggttaagggtaaccctaacgggtaaccttaaacgtaaagttaaccgtaagttggtacgtacgacgtacccgtacgtattcgttcgttaccttacgttaccgttcccgtttacccactttactcgttacgtaccg

SEQ ID NO: 138333 - DNA, 600 bp, Homo sapiens
  misc_feature: GYAE6OF01EZ39O.46.67.G01.1.454.CMB.1.raw
  modified_base (363)..(363): a, c, t, g, unknown or other
  misc_feature (363)..(363): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcacatctacttggccgggacaaggtcggaacattcgactaccttaatttaaagttggtatacaaacataacgaccgacgggaccgaccctaagcctacctaatctatgctgcatcctagttgactaaggtcgggtccatcggagttcgagtgacagtggatcgngggacagtactttcactctacactatctagtaactctgacaacgtgaagtatttcgactaacttattactagtactaacaagtaacttactaattcggtttacgacgtaacggactaacgtaaacttaactaaaacgttaaacgtacgtagttacggtactacgtacccgtaaccgtattaccgttcgttacttaccgtactttccccgttacccgtacctacttccgtaggttaac

SEQ ID NO: 138334 - DNA, 608 bp, Homo sapiens
  misc_feature: GYAE6OF01C7WHB.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctcgtggggctgggtccggcagcctcccgaggggaaggggctggaatacgattggaagtgtctctcagtagtggaggttcctattacagtccgtctctacgaagagtcgagtcaccatactctctggaccacgtccagcaatctacgttttccagaagtatgagttctgtcgaccgccgctgacgtacgggtctttatactggtcgcgagacgacggtcttattagtgttagttttggagttggtttacttcgacctaccgtagacgtcgggacggggtcctaccggacccgtggggaccgtaggggtaacttcgtggtacctaccggtccttaccttacgccctaccgaaccgtacgggccctacgtcccggttccctcccccgtggcccctaccctccctaccaacgccgtacccg

SEQ ID NO: 138335 - DNA, 608 bp, Homo sapiens
  misc_feature: GYAE6OF01DC0ZS.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagttggtttcttcgtggggctgggtccggcagcctcccgaggggaaggggctaggaatacattggaagtgtctctcatagtggaggttcctattacagtccgtctctcaagagtcgagtcaccattatctctggacacgtccagcaatctagttttcccagaagatgagtttctgtcgaccgccgctgacgacgggtcgtttatactgtgcgagcgacgctattatgtagttttggtagtggttatttcgacctaccgtagagtcggacggggtctccggacccggtgggaccgtaagggtacgttacgtcggttaccgaccgtcttaccgttacgcccgtaccgaacccggtaacggggtacccctacggttccggttcccgttcccccgtcggcccctacccgtccctaccgaagcgtacccgg

SEQ ID NO: 138336 - DNA, 599 bp, Homo sapiens
  misc_feature: GYAE6OF01DQZOE.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtgggagacagtgtcaccatccacgttcgcccgggcaaggtcggaacattgactaccttattttaaattggtatacaacatagaccagggaccgccctaagctacctaatctatgctgcactcctaggtttgacgtaaaggtcggggtaccctagtcgaggtttcaggtcggctaggtggatcgtagggacagtactttcactctcaccatacagttaactctagactaacgtgtaaagttatttagacttaactttatactagtaacaactagtaaacttactaagtttcgtttaccggaacctaagggtacctaaccgtaacttaaactaaaacgttaacgaactggtacgactgacctacctattcttgttaccttactacttcccttaccccgacttactcgtcgtaac

SEQ ID NO: 138337 - DNA, 566 bp, Homo sapiens
  misc_feature: GYAE6OF01BV3DW.46.67.G01.1.454.CMB.1.raw
  modified_base (251)..(251): a, c, t, g, unknown or other
  misc_feature (251)..(251): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctcgtggggctggggtccggnagcctccgagggaaggggctggaatacattggaagtgtctctcatagtggaggttcctattacagtccgtctctcaagagtcgagtcaccatatctctggacacgtccagcaatctagttttcccagaagatgagttctgtcgaccgcgctgacgacgggtctttatactgtgcgagagacgtctattagtgtagttttggagttaggttatttcgactaccgtagtacgtcggaccggggtctccggccccggtggggacccgagggtaactaccgtggtacccaccgttcctcccgttagccccgtaacccgg

SEQ ID NO: 138338 - DNA, 564 bp, Homo sapiens
  misc_feature: GYAE6OF01B2E92.46.67.G01.1.454.CMB.1.raw
  modified_base (211)..(211): a, c, t, g, unknown or other
  misc_feature (211)..(211): n is a, c, g, or t
  modified_base (438)..(438): a, c, t, g, unknown or other
  misc_feature (438)..(438): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtncctcatcagtgtgtttctcgtggggctgggtccggcagcctcccgagggaagggctggaatacagttggaagtgtctctcatagtggaggttcctattacagtccgtctctcaagagtcgagtcaccatatctctggacacgtcagcaatctagtttcccagaagtatgtagttctgtcgaccgccgctcgacgacgggtacgtttattacgtgtgcgagagacgtnttattagtgttattttggagttggttatttcgactacccgtagtacgtcgggacggggtctaccggtcccggtggggccgaagggacgtacgtcggtaccacgttcctccgttcgcccgtaacccg

SEQ ID NO: 138339 - DNA, 668 bp, Homo sapiens
  misc_feature: GYAE6OF01A75YZ.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggccctaagctcctaatctatgctgcatccagtttgacgtaaaggtcggggtccccagtcggtaggttcaggtggcaggtggatcgtgggacagtatttcactctcacatcagtatctgactaacgtgaagttatttgactaatttattacttgtacaacaagtaaattaactaagtttcggttttaccggaccgtaaacgggtacctaacggtaaccttaaacgtaaaacgttaaaccgtaaacgttacggttacgggtaccgttacggaacccgttaacccgtaacgtttacccgtttcggttttaaccccgtttttaccccgttaaaccttttaccccccggttttaccccccggtaacccccgttaacgttttaccccgtttaacggttaaacccg

SEQ ID NO: 138340 - DNA, 583 bp, Homo sapiens
  misc_feature: GYAE6OF01C4JHF.46.67.G01.1.454.CMB.1.raw
  modified_base (286)..(286): a, c, t, g, unknown or other
  misc_feature (286)..(286): n is a, c, g, or t
  modified_base (339)..(339): a, c, t, g, unknown or other
  misc_feature (339)..(339): n is a, c, g, or t
  modified_base (343)..(343): a, c, t, g, unknown or other
  misc_feature (343)..(343): n is a, c, g, or t
  modified_base (413)..(413): a, c, t, g, unknown or other
  misc_feature (413)..(413): n is a, c, g, or t
  modified_base (558)..(558): a, c, t, g, unknown or other
  misc_feature (558)..(558): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtcccctcacctgcgctgtctctggtgcctccatcagtagtggtttcttcgtggggctggggtccggcagcctcccgaggggaaggggctggaatacattggaagtgtctctcatagtggaggttcctattacagtccgtntctcaagagtcgagtcaccatatctctggacacgtcagcaatcacgttttccngaanatgagttctgtcgaccgccgctgacacgggtctttattacgtgttcgcggagacggacggtcttaagttntagttatttttgggagttggttacttcgacctaccctagtactcgggacggggtctccggacccgtggggacctaagggtactacgtcggtcgaccgtcttccgttacgccctacgaccgacggccacgtccgttccctccccgngtcccaccctcctaccagtcgaccg

SEQ ID NO: 138341 - DNA, 667 bp, Homo sapiens
  misc_feature: GYAE6OF01DDRP4.46.67.G01.1.454.CMB.1.raw
  modified_base (193)..(193): a, c, t, g, unknown or other
  misc_feature (193)..(193): n is a, c, g, or t
  modified_base (230)..(230): a, c, t, g, unknown or other
  misc_feature (230)..(230): n is a, c, g, or t
  modified_base (379)..(379): a, c, t, g, unknown or other
  misc_feature (379)..(379): n is a, c, g, or t
tcagactagcagtacacgaccggtgctcgatttagagtatacatattgggtttgggggagtctcggtcaggacacagcatggacatgagggtccccgctcagctcctggggctcctgctactctggctccggaggtgccagatgtgacatcgagctgacccagtctccatcctcctgtctgcaaccgtggganacagtgccacatcacttgccgggacaagtcggaactnttcggctaaccttatttaagtggtatcaacatagaccagggaccgccctaagcctactaatctatgctgctatccgtagtttgactaaaggtcgggtacccagtcggtaggttacaggtgctaggtggtatcgtggactagtactttcncgtctacaccgatacaagtaactcgtcgtaactaacgggtataaaggttcttttacgaacgttaacttttattaaccgttcgttaaccaaacgtaacgtttaaacttaacgtacgttttacggtttaccggaccgtaaacgggtacctaaccggtaaacttaaacgtaaaacgtttaaccgacgttacggtacggaccgttacgaacccgtaaccgttacgttaccgttccgtttaccttactacccgtttcccgttaccccgtacccttagttacgttcggtaaacc

SEQ ID NO: 138342 - DNA, 648 bp, Homo sapiens
  misc_feature: GYAE6OF01BREG4.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccggaggtgccagatgtgacatcgagctcgacccagtctccatccctccctgtctgccaaccggtgggagacgagtgtccaccatcacgttcggccgggacaaaggtcggaactattcgaacctaccttaattttaaagttggtaatacaacagtaacgaccgacggggaccggaccctaagcctacctaactctctgctgcactcctagtttgactaaggtcgggtcccagtcgtaggttcaggtcggacgtaggtggatcgtagggactagtactttcactctacacatacaatactctgacgtacgtagtaagttagttagtactaacttattactagtactaactaagtaattaactaagttactttacggggggggggggggggggggggtaacctaacgggtaacgtaacgaactaaacgtaaactaaacgtaacgtacgtacgtacgtacgtacgtacctactacttcgttccttacttaccttacccgttacccgtacctacttcgtagtacg

SEQ ID NO: 138343 - DNA, 629 bp, Homo sapiens
  misc_feature: GYAE6OF01CRLS2.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctcgtggggctgggtccgcagcctcccgaggggaaggggctagggaaatacgattgggaagttgtctctcagtaggtggaggttcctattacagttccgtctctcaagagtcgagtcaccatactctctggacacgtccagcaatcagttttcccagaacgatgagttctgtcgaccgccgctacggacgtacgggtcgttttaattacgtggtagcggaagtacggacggtacttaagttagtgttagtttttgggaagtttggtttatttacgaacctacccgtagtacgtcggacgggtctccggacccgtgggaccaagggtaactacgttcggtacctaccgttcctaccgttacgccctaccgacccgaaccgggtcccacgttcccggtccttcccccgtgccctaccccgtccctaccgacgtcgtacccg

SEQ ID NO: 138344 - DNA, 716 bp, Homo sapiens
  misc_feature: GYAE6OF01BXQEE.46.67.G01.1.454.CMB.1.raw
  modified_base (252)..(252): a, c, t, g, unknown or other
  misc_feature (252)..(252): n is a, c, g, or t
  modified_base (272)..(272): a, c, t, g, unknown or other
  misc_feature (272)..(272): n is a, c, g, or t
  modified_base (640)..(640): a, c, t, g, unknown or other
  misc_feature (640)..(640): n is a, c, g, or t
  modified_base (711)..(711): a, c, t, g, unknown or other
  misc_feature (711)..(711): n is a, c, g, or t
tcagactagcagtacacgaccggtgctcgatttagagtatacatagttggggtttgggggagtactcggtcaggactacgacgcagtacggacagtagaccgggtccccgctcagccttccgtcgggtcctcctgctactcgtggcctccggaggtcaccagtagtgtagactatacgagctcgaccgtctccaccacctcccttcctgtcgtcgaccgaaccggtaggggaacacgtacgtcctccacctntcgacggtcggaccgggtanaacggtaccgtatagtacgactaacttaatttaacgtcgtactacaatacgaacggaaccgacgggaccctacccgtaagtcctaaccgtacttcgtactcgtcgtcgactaccgtcgtacgttacggaccgtaacgggttcggtacctacgtcggtacgttcggtggttccggagtagggttacgacgtcgtagggtaccttaggttaccttcgaaccttcgtaccgtaacacgtacctaaacgttctccgtaagtaacccgtaagggttattaaggttactttacgtaaccttaatttactagtaccgaaactaagtacgtaagttacgtacgtttccggttaccgaacgtacgtactaacgtaanaaacttaagtacacgtgacgactacgtactactagttctacttactctaccttcctacgtaatcgttagtntaacg

SEQ ID NO: 138345 - DNA, 594 bp, Homo sapiens
  misc_feature: GYAE6OF01DP074.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtccgggcccacgactggtgaggccttcggagaccctgtccctcacctgcgctgtctctggtgcctccatcagtagtggtttctcgtggggctgggtccggcagctcccgagggaaggggctggaatacattggaagtgtctctcatagtggagttcctattacagtccgtctctcaagagtcgagtcaccatatctctggacacgtccagctaaatctacgttttccctagaagatgtagtttctggtcgacccgccgtctgacacggggtctttattacgtgtgcgagagacgtactattatgtattttaggtagttggttactttcgtactacccgtagtagtcggacggggtcgtccgacccgtcggggccgaagggtatacgtggtcctaccgtctccttacgcctccgaccgaacggcccagtcccggtccttcccccgtcggtaccctaccccgtcccttacccgaacgtcgtacccg

SEQ ID NO: 138346 - DNA, 573 bp, Homo sapiens
  misc_feature: GYAE6OF01C57VX.46.67.G01.1.454.CMB.1.raw
  modified_base (334)..(334): a, c, t, g, unknown or other
  misc_feature (334)..(334): n is a, c, g, or t
  modified_base (565)..(565): a, c, t, g, unknown or other
  misc_feature (565)..(565): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctcgtggggctgggtccgcagctcccgaggggaaggggctggaatacattggaagtgtctctcatagtggaggttcctattacagtccgtctctcaagagtcgagtcaccatatctctggacacgtcagcaatcagttttcccngaagatgtagttctgtcgaccgccgtctgacacgggtctttattactgtgcgagagacggctattatgtattttggagttggtttatttcgacacccgtagacgtcggacggggctcggacccgtggggccaggggattacgtcggtctaccgtctccgttagccctccgaccgacggccctacgtccggttcccttcccccgtcggtccctaccccgtccctaccgacgngtaccccg

SEQ ID NO: 138347 - DNA, 559 bp, Homo sapiens
  misc_feature: GYAE6OF01DAH64.46.67.G01.1.454.CMB.1.raw
  modified_base (192)..(192): a, c, t, g, unknown or other
  misc_feature (192)..(192): n is a, c, g, or t
  modified_base (358)..(358): a, c, t, g, unknown or other
  misc_feature (358)..(358): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccgggcaagtcggaacattgacacctatttaaatggtatcaacatagaccagggacgccctaagctcctaatctatgctgcatccagtttgacaagtgggtcccatcgaggttcagtgcagtggatcgtgggacagatttcacttcnctaccatcagtaatctgacaacgtagaagttattttagacttaacttattactgtacaacaacgtaattactaattcggttttacggaccgtaagggactacgtaaccttaactaaacttaaacgtaacgtacggttaggacttggacctacctattctgttaccttcacgttcccttaccccgtacctactcctgtaacg

SEQ ID NO: 138348 - DNA, 578 bp, Homo sapiens
  misc_feature: GYAE6OF01DDBGF.46.67.G01.1.454.CMB.1.raw
  modified_base (191)..(191): a, c, t, g, unknown or other
  misc_feature (191)..(191): n is a, c, g, or t
  modified_base (227)..(227): a, c, t, g, unknown or other
  misc_feature (227)..(227): n is a, c, g, or t
  modified_base (340)..(340): a, c, t, g, unknown or other
  misc_feature (340)..(340): n is a, c, g, or t
  modified_base (346)..(346): a, c, t, g, unknown or other
  misc_feature (346)..(346): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaaccgtggganacagtgtcaccatcacttgccgggcaagtcggaacnttgacactatttaatgtatcaacatagaccagggacgccctaagctactaatctatgctgcatccagtttgacaaaggtgggtccccagtcgaggttcaggtgcagtgatcgngggacngatttcactctcacatactagtaactctagactaacgtagtaaagttattttagaactaacttttattaacttacgtacaaactaagtaaactttacaatttcggttttaccggaccgtaaagggacctaacgaaccttaaactaaaattaaaccgtaacttgtaggccttaggacctaaccgtatttacgttcgttcttacctacttccttaccccgctaactctggtaac

SEQ ID NO: 138349 - DNA, 689 bp, Homo sapiens
  misc_feature: GYAE6OF01C0PHP.46.67.G01.1.454.CMB.1.raw
  modified_base (220)..(220): a, c, t, g, unknown or other
  misc_feature (220)..(220): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatccctccctgtctgcaaccggtgggagacagtgtcaccatcacttggccgggnaagtcggaacattgacaccttatttaaattgtatcaacatagacaggacgcccaagctactatctatgctgcatacctagtttcgactaaaggtcgggtacccagtcgtacggttacgtagttggacgtaggtacggagtcgtaggggactaaggtactttacactctacgacctatactaagttaactctacgactaacgttagtaacgtattttagaacttaactttaacttacttagtactaaactaacgtaaactttaactaaacgtttcgttttacggaacccggtaaagggtaccccgtaaacgtaaccttaaaacgttaaaacgttaaaaccggtaacgttaacgggttacggtaacccgttacgtaaccccggtaactaacgtttaccgttaccgttaccctttacccgtaacgttttcccccttaaccccggacctttacgttccgttacgttaaacccg

SEQ ID NO: 138350 - DNA, 563 bp, Homo sapiens
  misc_feature: GYAE6OF01DF38O.46.67.G01.1.454.CMB.1.raw
  modified_base (211)..(211): a, c, t, g, unknown or other
  misc_feature (211)..(211): n is a, c, g, or t
  modified_base (233)..(233): a, c, t, g, unknown or other
  misc_feature (233)..(233): n is a, c, g, or t
  modified_base (374)..(374): a, c, t, g, unknown or other
  misc_feature (374)..(374): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtncctcatcagtagtgtttctcgnggggctgggtccgcagcctccgagggaagggctggaatacagttggaagtgtctctcataggtggtaggttcctattacagtccgtctctcaagtgtcgagtcacctatatctctgacacgtcagcaatctacgttttccngaagtatgtagttctgtcgaccgccgctagacgtacgggttctttattacgtgtcgtcgagtacgacgtacttatttagtgttagtttttggagtttgttactttcgacctacctagacgtcggacggggtctccggacccgtgggaccgagggactcgtcgtccgaccttcgtcctcgccctaacccg

SEQ ID NO: 138351 - DNA, 640 bp, Homo sapiens
  misc_feature: GYAE6OF01C8Y7S.46.67.G01.1.454.CMB.1.raw
  modified_base (335)..(335): a, c, t, g, unknown or other
  misc_feature (335)..(335): n is a, c, g, or t
  modified_base (340)..(340): a, c, t, g, unknown or other
  misc_feature (340)..(340): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctcgtggggctgggtccgcagctccgaggggaagggctggaatcagttggaagtgtctctcagtagtggaggttcctattacagtccgtctctcaagagtcgagtcaccatatctctggacacgtccagcaatctagttttcccngaagntgtagttcgtgtgaccgccgtctcggacgtacgggtctttaattacgtggtacgcggagacggacggtacttaagttagtagttagtttttgggaagtttggtttactttcgacctacccgtagacgttccgggacgggggtcctaccggaccccggtggggacccgtaagggtaacgttcgtacggtacccgtaccgttccttccgttacgcccgtacccaaccggaaccgggtcccctacggtcccggttaccctcccccgtcggtccctaccccttcccgtaccacgccgtaccccg

SEQ ID NO: 138352 - DNA, 581 bp, Homo sapiens
  misc_feature: GYAE6OF01EW7ZI.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatccctccctgtctgcaaccgtgggagacagtgtcaccatcacttgccgggcaagtcggaacattgactactatttaaattggtatcaacatagaccaggacgaccctaagctacctaatctatcgctgcactcctagtttcgacgtaaaggtcggggtaccctagtcggtaggttcaggtggcgaggtggactcgtagggactagtatttcaactctcactatcagtaatctagactaacgtagtaagttatttgactaacttattactagtacaatagtaacttactaattcgtttacgacgtaaggactaacgaacttaactaaacttaaacgtacgtggtacgtacctagtaccacctatcgttacgttaccttactaccttcccgttacccgacctacttcgtgtaaccg

SEQ ID NO: 138353 - DNA, 590 bp, Homo sapiens
  misc_feature: GYAE6OF01EJO4G.46.67.G01.1.454.CMB.1.raw
  modified_base (194)..(194): a, c, t, g, unknown or other
  misc_feature (194)..(194): n is a, c, g, or t
  modified_base (219)..(219): a, c, t, g, unknown or other
  misc_feature (219)..(219): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgccaaccggtggganacagtgtcaccatcacttgccgggnaagtcgaacattgacacttattaatggtatcaacatagaccaggacggccctaagctacctaatctatgctgcatcctagtttgactaaaggtgggtcccagtcgaggttcagtgacagtgatgtaggacagtattcactctacacctatcaagtaatctagacaacgtagtaagtatttgactaacttattactagtactaactagtaacttataagttgtttacggacgtaacggactaacgtaacgttaaactaaagttaaacgtaacttacggtagtccgtacgtaccgtaaccgtactttacgttcgttacccttacctaccgtttaccccttaccccgtaaccttacttccgttaaggttaaacc

SEQ ID NO: 138354 - DNA, 577 bp, Homo sapiens
  misc_feature: GYAE6OF01A1W9S.46.67.G01.1.454.CMB.1.raw
  modified_base (289)..(289): a, c, t, g, unknown or other
  misc_feature (289)..(289): n is a, c, g, or t
  modified_base (334)..(334): a, c, t, g, unknown or other
  misc_feature (334)..(334): n is a, c, g, or t
  modified_base (339)..(339): a, c, t, g, unknown or other
  misc_feature (339)..(339): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctcgtggggctgggtccggcagcctcccgaggggagggctggaatacattggaagtgtctctcatagtggaggttcctattacagtccgtctctcaagngtcgagtcaccatatctctggacacgtccagcaatcagttttccngaagntgagttctgtcgaccgcgctgacacgggtctttatacgtgtgcgagagacggtctattatgtattttggagttggtttattcgactacccgtagacgtcggacggggctccggacccgtgggaccagggtaactacgtggtccaccgtctccgttacgccctaccgaccgacgggcccacgttcccggtccttcccccgtcggtaccccacccgttaccctacccaacgtcgtacccg

SEQ ID NO: 138355 - DNA, 658 bp, Homo sapiens
  misc_feature: GYAE6OF01EE37T.46.67.G01.1.454.CMB.1.raw
  modified_base (194)..(194): a, c, t, g, unknown or other
  misc_feature (194)..(194): n is a, c, g, or t
  modified_base (349)..(349): a, c, t, g, unknown or other
  misc_feature (349)..(349): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctcgacccagtctccatcctccctgtctgcaaccggtggganacagtcgtacaccatcacttggccgggcaagtcggaacatgactacttattaaatgtatcaacatagaccagggaccgacctaagctactaatctatgctcgcactccgagtttgacgtaaaggtcgggtacccagtcggtagtcgaggtcgganagtggatcgtgggactagtactttcgacttctaccaactatacgtaagttaactctacggtaactaacggttagtaaagtttatttttaacgtaaactttaattacgttagtaacctaaacgtaagttaaacctttacttaagtttacggtttaccggaaccgtaaaggtacccaacgttaacttaaaacgtaaaacgtttaaaccggattggtacggtaccttacgtaaccctaccgtattaccgtcggtttaccttacgtaaccgtttccccgtaccccgtactaaccgtttcgtagttacttacgg

SEQ ID NO: 138356 - DNA, 545 bp, Homo sapiens
  misc_feature: GYAE6OF01A5MBO.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacgccctaagctcctaatctatgctgcatccagtttgacaaagtgggtcccatcgagttcagtggcagtggatcgtgggacagatttcactctcacatcagtaatctagactaacgtgaagtattttagactaacttattactgtactaacagtaaattactaagttcggttttcggaccgtaagggacctacgaacttaactaaacgttaacgaacgtggtgtactagaccacctattcgtgttaccttctacttcctacccgaccattccgtgtacc

SEQ ID NO: 138357 - DNA, 805 bp, Homo sapiens
  misc_feature: GYAE6OF01DT2WB.46.67.G01.1.454.CMB.1.raw
  modified_base (197)..(197): a, c, t, g, unknown or other
  misc_feature (197)..(197): n is a, c, g, or t
  modified_base (227)..(227): a, c, t, g, unknown or other
  misc_feature (227)..(227): n is a, c, g, or t
tcagactagcagtacacgaccggtgctcgatttagagtatacatattgggtttggggagtctcggtcaggacacagcatggacatgacgggtccccgctcagctccgtggggctcctgctactctggctccggaggtgccagatgtgacatcggagctgacccagtctccatccctcctgtctgcaaccggtggganacagtgtccacatccacgttcggccggganaaggtcggaactattcgacctaccttaattttaaagtggtactacaaactaagtacgaacccggaacggggaacccggtacccctaaaggcccttaccttaaacttccttaagtacggtccttaggacctacttacccgtaaggttttacggaacgtaaacggggttccggggtaccctaagttcgggtaacggtttcgacggtgggacgtagggtaggacgttacggtaggggaactaggtactttaccgaccgttacctaccaaccgtattacgtaagttaactccgtacgtaaccgtaaggttaaggtaaacgtttacgttttaacggaacctttaaaccttttaacgtttacgttacgttaacaaacgttaagttaacgtttacgaaccgtttaagttttcgggttttaaccgggaaccggtaaacggggtaccctaaaccgtaaacttaaacgtaaacgtttaaaaccggaacgttcgggtacggtacgtacgtaacccgtaacttactttccgtagtttacccgttacttacccgtttaccccttaccccgtaccttacgttcgttaaaccg

SEQ ID NO: 138358 - DNA, 565 bp, Homo sapiens
  misc_feature: GYAE6OF01B13HH.46.67.G01.1.454.CMB.1.raw
  modified_base (331)..(331): a, c, t, g, unknown or other
  misc_feature (331)..(331): n is a, c, g, or t
  modified_base (391)..(391): a, c, t, g, unknown or other
  misc_feature (391)..(391): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctctggggctgggtccgcagctcccagggaagggctggaatacattggaagtgtctctcatagtggaggttcctattacagtccgtctctcaagagtcgagtcaccatatctctggacacgtccagcaatctagtttcccngaagatgagttctgtcgaccgcgctgacgacgggtcttttatacgtgtgcgagagacggntattatgtagttttggagttggtttattcgactacccgtagactcggacggggcctcggaccccgtgggaccgagggtactacgtggtcaccgtctccgtacgcctccgaccgacgggccctagttccggtcccttcccccgtggccctacccgtccctccgaaagcgtacccg

SEQ ID NO: 138359 - DNA, 652 bp, Homo sapiens
  misc_feature: GYAE6OF01BD84S.46.67.G01.1.454.CMB.1.raw
tcagactagcagtacacgaccggtgctcgatttagagtatacatattgggtttgggggagtctcggtcaggacacagcatggacatgagggtccccgctcagctcctggggctcctgctactctggctccgaggtgccagatgtgacatcgagctgacccagtctccatcctcctgtctgcaaccgtgggagacagtgtcaccatcacttggccgggcaagtcggaactattgactacttatttaaatggtatacaacatagaccgagggaccgaccctaagcctacctaatctatgctgctactcctagtttcgacgtaaggtcgggtcctagtcgtaggttcaggtggcgtagtggatcgtgggactagtattcactctcactatcagttactcgtagtacgtaacgtagtaagttacgttttacgaacttaaactttaacgtttaccttacgttaaacctaaacgtaagttaaactttaacgttaagttttccggtttaacggaaccgtaaacgggtaaccgtaaaccgtaaacttaaactaaaacgttaaacgtaaacgtagttacggacgttacgacctaacgtattaccgttgttacccttacgacctttacccgttccccgtaacttaccttacgttcgtaaccg

SEQ ID NO: 138360 - DNA, 509 bp, Homo sapiens
  misc_feature: GYAE6OF01DKR0R.46.67.G01.1.454.CMB.1.raw
  modified_base (353)..(353): a, c, t, g, unknown or other
  misc_feature (353)..(353): n is a, c, g, or t
  modified_base (381)..(381): a, c, t, g, unknown or other
  misc_feature (381)..(381): n is a, c, g, or t
  modified_base (450)..(450): a, c, t, g, unknown or other
  misc_feature (450)..(450): n is a, c, g, or t
  modified_base (498)..(498): a, c, t, g, unknown or other
  misc_feature (498)..(498): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacactattaatgtatcaacatagaccaggacgccctaagctctaatctatgctgcatccagtttgactaaaggtcgggtcccagtcgagttcagtgcagtgatcgtggacagtattcactcncaccatacagtaatctgacagtagaatntttagactaacttattactgtacaacagtaattacattcggtttacgacgtaaaggactacgtactaanaaacttaacgaactgtggctgcactatctgtcttcacttccttacccntactctgtaac

SEQ ID NO: 138361 - DNA, 581 bp, Homo sapiens
  misc_feature: GYAE6OF01B9S46.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacggccctaagctcctaatctatgctgcatccagtttgcaaaggtcgggtcccagtcgaggttcagtcggcaggtggatcgtgggacagatttcactctcaccatcagtaatctagactaacgtgaagtattttgactaactttattacttgtacctaaacagtaaactttactaagtttcggttttaccggaaccgtaaacgggtactaaccgtaacttaaactaaaatttaaaccgaacttcggtaggtactacgactaccctattaccttgttacccttactacttcccttaccccgactacttctcgtaacg

SEQ ID NO: 138362 - DNA, 624 bp, Homo sapiens
  misc_feature: GYAE6OF01C15LX.46.67.G01.1.454.CMB.1.raw
  modified_base (178)..(178): a, c, t, g, unknown or other
  misc_feature (178)..(178): n is a, c, g, or t
  modified_base (202)..(202): a, c, t, g, unknown or other
  misc_feature (202)..(202): n is a, c, g, or t
tcagactagcagtacacgaccggtgctcgatttagagtatacatattgggtttgtcctcctgctggtggcagctcccagatgggtcctgtccctggtgcaactgcagggagtccgggccccacgactgggtgaggcccttcgggagaccctgtcccctcacctgcgctgtctctggtncctcatcagtagtggtttcttcgnggggctgggtccggcagctcccgaggggaaggggctaggaaatacagttggaagtgtctctcataggtggaggttcctattacagtccgtctctcaagagtcgagtcaccatatctctgacacgtccagcaatctagtttcccagaagatgagttctgtcgacccgcgctgaccgacgggtcgtttattactggtgcgagagacggacttattatgttagttttggagtttggttatttcgacctacccgtagacgtcggacggggtcctccggaccccgtggggaccgaaggggtactacgtcggtccgtacgtccttccgttacgccctaccgacccgtaaccgggcccctacggttcccggttaccccgtttccccccgcggtacccctaccccgtccctaccccgaagccgtaccccg

SEQ ID NO: 138363 - DNA, 636 bp, Homo sapiens
  misc_feature: GYAE6OF01CLDG5.46.67.G01.1.454.CMB.1.raw
  modified_base (191)..(191): a, c, t, g, unknown or other
  misc_feature (191)..(191): n is a, c, g, or t
  modified_base (217)..(217): a, c, t, g, unknown or other
  misc_feature (217)..(217): n is a, c, g, or t
  modified_base (337)..(337): a, c, t, g, unknown or other
  misc_feature (337)..(337): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaaccgtggganacagtgtcaccatcacttggccgganaagtcgaacattgacactatttaaatgtatcaacatagacaggacgaccctaagctactatctatgctgcatccagtttgacaagtcgggtcccaagtcgagttcagtcgcagtgatcgngggactagtactttcgacttctacacctatactagtaacttcgtagaccgtaaacgttcgtaaagttagttttagaaccttaacgtttaacgttacttacgtactaaacgtaggttaaaacttacgtaaagtttcggttttaaccgacccggtaaagggtaacctaaccggtaaacttaaacgtaaaacgtttaaacggaaccgtttaggtacggacttacgaaccgtaacccgtatttaccggttcgttaccttactaccgttaccctttacccgaccgttaattccgttagtaaacc

SEQ ID NO: 138364 - DNA, 754 bp, Homo sapiens
  misc_feature: GYAE6OF01DOEOL.46.67.G01.1.454.CMB.1.raw
tcagactagcagtacacgaccggtgctcgatttagagtatacatattggggtttggggagtctcggtcaggacacagcatggacatgagggtccccgctcagctcctggggctcctgctactctggctccgaggtgccagatgtgacatcgagctcgacccagtctccatccctccctgtctcgacaaccgggtgggagacaggtcgtccaccatctacgttcggccggggtacaaggtccggaaactagtttcgaacctaacctttaagttttaaaagttggtaactacaaactagtaacggaccgaacggggaccggtaccctaagcctacctaatctagtcgcttcgactactccgtagttacgactaaagggtccgggtaccagtcggtacggttcgaggtggacgtagggtacggtacgtacggtacgggactaggtaacttttcacctttctacctaaccctagtaccgtaacgttactcgttacggaccgtaaacgggtttacggtaaagtttacgtttttaacggaacctttaaaacttttacgttaacttacggtaactaaaacgtaagttaaacttttaacgtacgtttacgggttaccgggtaaaccgaaacgggtactaaaccgtaaacttaaacgttaaaacgttaaaccgtacggttaggtacggtaacctacggtaaccaccgttataccggttacgttcttaacctcgtacccttccaaccgtacttcgtaacgtacg

SEQ ID NO: 138365 - DNA, 644 bp, Homo sapiens
  misc_feature: GYAE6OF01EVZKQ.46.67.G01.1.454.CMB.1.raw
  modified_base (192)..(192): a, c, t, g, unknown or other
  misc_feature (192)..(192): n is a, c, g, or t
  modified_base (256)..(256): a, c, t, g, unknown or other
  misc_feature (256)..(256): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccgggcaagtcggaacattgacaccttatttaaattggtatcaanatagaccagggaccgccctaagctacctaatctatgctgctatcctagtttgacgtaaaggttcgggtaccctagtcggtaggttcgaggtggactaggtggacgttcggtaggggaactaggtactttcaccgttctaccaacctattacgtaagttaactcgtacgacgtaacggttagtaaagttagttttagaccttaaactttacttacttacgtaactaactaagtaaactttaactaagtttacggttttaccggaaccgtaacgggtaacctaaccgtaacttaaactaaacgttaaacgaacttggtacgtaccgtacgaccgtactagttcttcgttaccttctaccttcccgttaccccacctacgttcgtgtaacg

SEQ ID NO: 138366 - DNA, 660 bp, Homo sapiens
  misc_feature: GYAE6OF01AQDBW.46.67.G01.1.454.CMB.1.raw
  modified_base (191)..(191): a, c, t, g, unknown or other
  misc_feature (191)..(191): n is a, c, g, or t
  modified_base (224)..(224): a, c, t, g, unknown or other
  misc_feature (224)..(224): n is a, c, g, or t
  modified_base (347)..(347): a, c, t, g, unknown or other
  misc_feature (347)..(347): n is a, c, g, or t
tcagactagcagtacacgaccggtgctcgatttagagtatacatattgggtttggggtagtctcggtcaggacacagcatggacatgagggtcccgctcagctcctggggctcctgctactctggctcgagtgccagatgtgacatcgagctgacccagtctccatcctccctgtctgacaaccgtggganacagtgcaccatcacttgccggcaagtcgaacnttgacactatttaaatgtatcaacatagaccaggacgccctaagctacctaactctatcgtctacgctactcctagtttcgactaaaggtcgggtcccagtcgtagttcgagtcggcagtcgntcgtggacagtcttcactctacacatcgataatctagacgtaacgtgaagtatttacgacttaacttacttacgttacgtaacctaagaacgttaactttaactaacgtttacggtttttaaccggaaccggttaacgggtaacccgtaacgtaaaccgttaaaccgtaaaacgtttaaaccgtaacgttaaggtttacggtaaccgttacggtaacctaacccgttagttacctttaccggttacctttaccgtaaccgtttaccccgtttaccccgtaaccgtttacccttaaccggttaagtttaacccg

SEQ ID NO: 138367 - DNA, 608 bp, Homo sapiens
  misc_feature: GYAE6OF01BU6SV.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtgggagacagtgtcaccatcacttgccgggcaagtcggaactattcgactaccttaatttaaagtggtatacaaacatacgaccgagggaccgccctaagctacctaatctatgctgacatccgtagtttacgacgaaacggttcgggtacccagtcggtaggtttcaggtggacaggtggatcgtagggactagtattcgactctacactatacaagtaatctagactaacgtagtaagttactttgaacttaactttactttactagtaaccaaagtaattaacttaactagtttacggtttacggaaccgtaaggactaaccgtaaactaactaaagtaacgacgttaggtcgtctacgaccgtactattctcgttacttaccgtacttcccttaccccgattacttccgtagtaacc

SEQ ID NO: 138368 - DNA, 580 bp, Homo sapiens
  misc_feature: GYAE6OF01B6T5V.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctgggctgggtccgcagctccagggaagggctggaatacattggaagtgtctctcatagtggaggttcctattacagtccgtctctcaagagtcgagtcaccatatctctggacacgtccagacaatctagttttccctagaagatgagttctgtgaccgccgctgacgacgggtcgttttagttactgtgcgagagacggtcttattagtgttattttgggagttaggtttatttcgacctaccctaggactcggtacggggcctcggacccgtgggccgagggtaactacgtggtcaccgtctccttacgcctccgaccgtacgggccctacgtccggttcccttccccgccggcccctaccccgtccttacccagtccgacccg

SEQ ID NO: 138369 - DNA, 668 bp, Homo sapiens
  misc_feature: GYAE6OF01CIM9B.46.67.G01.1.454.CMB.1.raw
  modified_base (166)..(166): a, c, t, g, unknown or other
  misc_feature (166)..(166): n is a, c, g, or t
  modified_base (336)..(336): a, c, t, g, unknown or other
  misc_feature (336)..(336): n is a, c, g, or t
  modified_base (440)..(440): a, c, t, g, unknown or other
  misc_feature (440)..(440): n is a, c, g, or t
  modified_base (449)..(449): a, c, t, g, unknown or other
  misc_feature (449)..(449): n is a, c, g, or t
  modified_base (511)..(511): a, c, t, g, unknown or other
  misc_feature (511)..(511): n is a, c, g, or t
  modified_base (611)..(611): a, c, t, g, unknown or other
  misc_feature (611)..(611): n is a, c, g, or t
tcagactagcagtacacgaccggtgctcgatttagagtatacatattggggtttggggagtctcggtcaggacacagcatggacatgacgggtccccgctcagctcctgggggctcctgctactctggctccggaggtgccagatgagacatcgagctacgacccngtctcctactccctcctgtctcgaccgaaccggtgggaagacgaaggttcgaccaaccataccgtaacgttcgggaccggggactaaacggtaccggaaactattacggaacctaaccgtttaattttaaagtggtaactacaaacagtaacgaaccggacgggaacccncctaaagcctactaatctaatcggctgactcgtactagttgacgtaaggccggtaccagtcgtaagttcgagtcggctaggtgactggtaggactagttacttnacctctaanactactagtagtactaccgtgaacgttaagtaggtaactttgtaaccgtaattaacgtttanacggttactaaacaattaagtaacttaacttaccgtttggtaaccgaacggtaaactacgaacgttaaattaaacaaacgtttaaagcgttgaggtaccngtaaccacgttatccgttattccgtcaaccttcggtacccctatcgttagaactacg

SEQ ID NO: 138370 - DNA, 629 bp, Homo sapiens
  misc_feature: GYAE6OF01EC4MS.46.67.G01.1.454.CMB.1.raw
  modified_base (293)..(293): a, c, t, g, unknown or other
  misc_feature (293)..(293): n is a, c, g, or t
tcagactagcagtacacgaccggtgctcgatttagagtatacatattgggtttgtcctcctgctggtggcagctcccagatgggtcctgtccctggtgcaactgcaggagtccgggcccacgactggtgaggccttcggagaccctgtccctcacctgcgctgtctctggtgcctcatcagtagttggtttcttcgtggggctgggtccggcagctcccgaggggaggggctggaatacagttggaagtgtctctcatagtggaggttcctattacagttccgtctctcaagngtcgagtccaccatactctcgtggaccacgtccagctaatctacgtttttcccagaagtatgtagttctgtcgacccgccgctgacgtacggtcgttttatacgtgtgacgagagacggtcttattatgttagtttggaggtttggttatttcgactaccctagtacgtcggacggggtcctccggaccccggtggggaccgaaggggtaacttaccgtcgggttaccacccggttccttcccgttacgccccttaacccgaccgtaccgggaccctacgttcccggttccccttcccccgtacgtccctacccctaccctccgaacgcgtacccg

SEQ ID NO: 138371 - DNA, 540 bp, Homo sapiens
  misc_feature: GYAE6OF01BN8J2.46.67.G01.1.454.CMB.1.raw
  modified_base (428)..(428): a, c, t, g, unknown or other
  misc_feature (428)..(428): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaaattggtatcaacatagaccagggacggccctaagctcctaatctatgctgcatccagtttgacaaagtgggtcccatcgaggttcagtggcagtggatcgtgggacagatttcactctacaccatcataatctgcaacgtgtaagtattttgactaacttattactgtacaaactagaatttanaattgttttacggaccaagggaactacgaactaactaaaacttaaacgaacgttgtagggactagactacctatactgttcttacacttccttacccgaccattcctgtaac

SEQ ID NO: 138372 - DNA, 631 bp, Homo sapiens
  misc_feature: GYAE6OF01EO521.46.67.G01.1.454.CMB.1.raw
  modified_base (329)..(329): a, c, t, g, unknown or other
  misc_feature (329)..(329): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtgtggtttctcgtgggctgggtccgcagctccgagggagggctggaatacattggaagtgtctctcagtagtggaggttcctattacagtccgtctctcaagagtcgagtcacatatctctggacacgtccagcatcacgttttcccngaagatgtagttctgtgaccgcgctcgacgtacggtcgtttaatactgtgacgagagacggtcttattagtgtagtttttggagttaggtttattcgaactacccgtagacgtcggtacggggccttccggaccccggttggggacccgtaaggggtaacttacgtcgggtaccacccggtttccttcccgttacgccccttaccgacccgtaaccgggcccctaacggttccccggttacccttccccccgtacgggtcccctaaaccccgttcccctaccccgaaaggtccgtaaccccg

SEQ ID NO: 138373 - DNA, 826 bp, Homo sapiens
  misc_feature: GYAE6OF01BUHHN.46.67.G01.1.454.CMB.1.raw
  modified_base (317)..(317): a, c, t, g, unknown or other
  misc_feature (317)..(317): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtcgcctccatcagtgtggtttctcgtgggctgggtccgcagctccgagggagggctggaatacgagttggaagtgtctctcagtaggtggtacgttcctattacgagttccgtctctacaagtgtcgagtcactatactctcgtgacncgtccagactaatctacgtttaccgagaagtactgtacgtttcgtggtacgacccgtcgtacgtacggaacggttaccggggtttacgttttaacgtttacggtcggtacggtaccgggtaaggtaacgggtacggtacgtttaacgtttaggttacggttttaagtttttacggggtaagggttttaggttttaaccgtttaccggtaacccgttaaacccgttaggtacccgggttaccggggtaaccgggggttacccttaccccgggtaaccccggggttacggggtaacccgggtaaaggggtaaccgtttaccgggttaccgggttaaccccgtacccggttaacccgtttacccggttacccggtacccccgttaaccccgtaaccccgggtaacccgggtaccccttaccggttccccgggtttacccccttcccccgggttacccgtacccccttacccccgttaccccgtaacccgttaacgggacccgttacccccgg

SEQ ID NO: 138374 - DNA, 527 bp, Homo sapiens
  misc_feature: GYAE6OF01EUBM2.46.67.G01.1.454.CMB.1.raw
  modified_base (416)..(416): a, c, t, g, unknown or other
  misc_feature (416)..(416): n is a, c, g, or t
  modified_base (458)..(458): a, c, t, g, unknown or other
  misc_feature (458)..(458): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggaccgccctaagctacctaatctatgctgcatccagtttgcaaagtcgggtcccatcgaggttcagtggcaggtggatcgtgggacagtacttcactctcaccatcagtatctgacagtagaagtatttgactaacttattactgtacaanagtaattactaagttcgtttacgacaagggacacgaactaanaaagttaacgactagtcgctagactacctatctcgtacttactacttacctcccgactacttcgtgtac

SEQ ID NO: 138375 - DNA, 598 bp, Homo sapiens
  misc_feature: GYAE6OF01DXUL3.46.67.G01.1.454.CMB.1.raw
  modified_base (191)..(191): a, c, t, g, unknown or other
  misc_feature (191)..(191): n is a, c, g, or t
  modified_base (216)..(216): a, c, t, g, unknown or other
  misc_feature (216)..(216): n is a, c, g, or t
tcagactagcagtacacgaccggtgctcgatttagagtatacatattgggtttggggagtctcggtcaggacacagcatggacatgagggtccccgctcagctcctggggctcctgctactctgactccgaggtgccagatgtgacatcgagctgacccagtctccatcctcctgtctgcaaccgtggganacagtgtcaccatcacttgccgggnaagtcgaacatgactacctatttaattgtatcaacatagaccagggaccgccctaagctactaatctatgctgctatcctagtttcgacgtaaggtcgggtcccagtcggtaggttcaggtggcaggtggatcgtgggactagtatttcactctcacctatactagtatctgtacaacgtagtaagttattttagtaactttattactgttactaactaagtaatttaactaatttggtttaccggaaccgtaagggacctaacggtaaccttaaactaaaacgttaaacgacgttaggtacggtacctagaccctaaccgtattaccgttacgttaccttacctacttcccctttacccgaccttattcctagtattaccg

SEQ ID NO: 138376 - DNA, 601 bp, Homo sapiens
  misc_feature: GYAE6OF01BLYPT.46.67.G01.1.454.CMB.1.raw
  modified_base (372)..(372): a, c, t, g, unknown or other
  misc_feature (372)..(372): n is a, c, g, or t
  modified_base (392)..(392): a, c, t, g, unknown or other
  misc_feature (392)..(392): n is a, c, g, or t
  modified_base (434)..(434): a, c, t, g, unknown or other
  misc_feature (434)..(434): n is a, c, g, or t
tcagactagcagtacacgaccggtgctcgatttagagtatacatattgggtttggggagtctcggtcaggacacagcatggacatgagggtccccgctcagctcctggggctcctgctactctggctccggaggtgccagatgtgacatcgagctgacccagtctccatcctccctgtctgcaaccggtgggagacagtgcaccatcacttgccgggcaagtcggaacattgactactatttaaagtggtatcaaacagtagaaccgagggaccggaccctaagctacctaaatctaatgactgacatccgtagtttgacaaaggtcgggtccagtcgagttcgagtggactagtcgagtcgtgggacagtnttacactctacacatacganatctgacacgtgaatatttagactaattatatagacaaacgngtaaacttacgtaattggtttaccgaccgaaagggtaccaacgtaactaaacgtaaacgttaaacgaacgttaggtaccgcttaacgaccctaaccgtagttacccttggtttacccttacgaacctttcccgttacccccgacctaattacccgttgtaaaacccg

SEQ ID NO: 138377 - DNA, 714 bp, Homo sapiens
  misc_feature: GYAE6OF01D908R.46.67.G01.1.454.CMB.1.raw
  modified_base (196)..(196): a, c, t, g, unknown or other
  misc_feature (196)..(196): n is a, c, g, or t
tcagactagcagtacacgaccggtgctcgatttagagtatacatattgggtttgggggagtctcggtcaggacacagcatggacatgagggtccccgctcagctcctggggctcctgctactctggctccgaggtgccagatgtgacatcgagctgacccagtctccatccctccctgtctgccaaccggtggganacagtgtccaccatcacgttcggccgggacaaggtccggaactagttacgaacctaacctttaattttaaagttggtaactacaaactagtacgaccgaggggacccgaccctaagcctacctaatctatgctgacctactccgtaggtttacgacgtaaacgggttcgggtacccagttcggtaggttcgaggtcggacgtaggtggacgttcggtaggggtaactaggttactttaccacgttcctaccaacctatacgtaagtacttccgtgtaaccgtaacggttagtaagtttacgtttacggtaaccttaacgtttacttaacgttacgtaaccgtaaactaacgttaaactttaacgtaagtttaccgggtttaccggaaccggtaacggtaaccttaaaccggtaacttaaacgtaaaacgttaacggaacgttcggtagtacctacgtaacctacctacgttcttcgttaccttctaccgttcccttacccgattactcgtcgtaaccg

SEQ ID NO: 138378 - DNA, 522 bp, Homo sapiens
  misc_feature: GYAE6OF01ELS5G.46.67.G01.1.454.CMB.1.raw
  modified_base (192)..(192): a, c, t, g, unknown or other
  misc_feature (192)..(192): n is a, c, g, or t
  modified_base (228)..(228): a, c, t, g, unknown or other
  misc_feature (228)..(228): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccgggcaagtcggaacnttgacactattaatgtatcaacatagaccagggacgccctaagctcctaatctatgctgcatccagtttgcaaagtgggtcccatcgaggttcagtggcagtggatcgtgggacagtatttcactctcacatcagtaatctgacaacgtgaagtatttagactaacttattactgtacaacaagtaattaacaattgtttacggacctaagggacctaacgaactaacaaattaaacgaactgtagactgactacctatactgtcttacacttccttcccgactactctgtacg

SEQ ID NO: 138379 - DNA, 574 bp, Homo sapiens
  misc_feature: GYAE6OF01AOA5E.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacgccctaagctctaatctatgctgcatccagtttgcaaagtgggtcccatcgaggttcagtgcagtgatctgggacagatttcactctcaccatcagtactctagcaacgtgtaagtatttgactaacttattactagtacaactagtaattactaagttagttttacggaccgtaagggtacctaacgtacctaaactaaacttaaacgtaacttagtacggactaggacctaacctagttaccgttcgttaccttaccgtacttaccccgtttacccccgtaccctaacttcccgtagttaaccg

SEQ ID NO: 138380 - DNA, 1019 bp, Homo sapiens
  misc_feature: GYAE6OF01CIODH.46.67.G01.1.454.CMB.1.raw
  modified_base (193)..(193): a, c, t, g, unknown or other
  misc_feature (193)..(193): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtggganacagtgtcaccatcacttcggccgggacaaggtccggaaactattcgacctaaccttaatttttaaaacgttggttaacttaccaaaactaattaacggaaacccgtaagggggaacccgggtacccccttaaaaggcccttacccttaaattccttaagttcggcgttcgacctattcccgtaaggtttttacggaacgtaaaacggggttcgggggttaccccaagttcgggtaacgggtttccgaaggttcggggtaccgtaagggttcggggtaactttccgggttacgggggaaccttaacgggtaacttttttacccgaacccgttttaccttacccgtaaaacccgttacttacccgttaaacggtttaaaacgtttcccgttaacggtaacccgttaaaacgggtttaacgggtaaaaacggttttaacgtttttttaaccggtaaccttttaaaacccgttttttaaacgttttaaccggtttaacggtttaaaacccttaaaaccgttaaaacggtttaaaacgttttaaaacccgtttaaaacggtttttaaccggggtttttttaaccccggggaaacccgggttaaaaccggggggttaaaacccgtaaacccgggttaaaacccgtttaaaaacccgttaaaaaacgttttaaaaacccggtaaaaccggtttacgggttaaccgggtaccgttaaccggtacccgtaaacccgttaactttaccggtttaccgttttaacccgttaacccgtttaaccgtttaccccgtttacccccggtacctttaacctttccgttaacgtttaaaccg

SEQ ID NO: 138381 - DNA, 624 bp, Homo sapiens
  misc_feature: GYAE6OF01CC2DU.46.67.G01.1.454.CMB.1.raw
  modified_base (356)..(356): a, c, t, g, unknown or other
  misc_feature (356)..(356): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtgggagacagtgtcaccatcacttgccgggacaagtcgaacattgactactatttaaattgtatacaacatagaccgagggaccggaccctaagctacctaatctatgctgcatcctagtttgacgtaaaggtcgggtacccagtcgaggttcagtggcagtggatcgnggacagtatttcactctacaccatcgtaataatctgacctaacggtagtaaagttattttacgacttaaactttactttaacttacgtaaccaaacgtaagttaaactttaactaagtttcgttttaccgggaacgtaacgggaactaacgtaaaccttaaacgtaaaagttaaaccgtaacgttggtacgtacgtacgtaccaccttacttcttcgttccgtttaactaccttcccgttacccccgaccttacttcccgtagtaccg

SEQ ID NO: 138382 - DNA, 736 bp, Homo sapiens
  misc_feature: GYAE6OF01EVIPI.46.67.G01.1.454.CMB.1.raw
  modified_base (194)..(194): a, c, t, g, unknown or other
  misc_feature (194)..(194): n is a, c, g, or t
tcagactagcagtacacgaccggtgctcgatttagagtatacatattgggtttggggagtctcggtcaggacacagcatggacatgagggtccccgctcagctccgtggggctcctgctactctggctccggaggtgccagatgtgacatcgagctgacccagtctccatcctcctgtctgcaaccggtggganacagtgtacaccatcacgttcggccgggactaaaggtccggaaactagttacggaacctaacctttaagttttaaaagttcgggtaactaccgaaactagttaacggaacccgaaggggtacccggacccctaaaggtccttaccgtaaatccgtaagtcggtctacgcctaacttcccgtaggtttcgacgtaaagggtccgggtaccctaagtcggtacggtttccgagggttggaccgaggttaggtactcggtaggggaacctaggttacttacgaacccttcgtaccaactagtcgtaagtaactcgtacgactaacggtagtaagttattacgtacttaacttatacgttacgtaactaacgtataaacgtactaaggttcgtttaaccggacggtaacggtacgtaaccgtaacttaaacgtaaagttaaccgtaagtaggtacgtacgtacgtaccgtacctaccgtacttacggtacccgtttaactacccgttacccgtttaccccgtaacttacgttccgtacgttaaccg

SEQ ID NO: 138383 - DNA, 568 bp, Homo sapiens
  misc_feature: GYAE6OF01CE5YL.46.67.G01.1.454.CMB.1.raw
  modified_base (192)..(192): a, c, t, g, unknown or other
  misc_feature (192)..(192): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccgggcaagtcggaacattgacacctatttaaatggtatcaacatagaccaggacggccctaagctcctaatctatgctgcatccagtttgctaaagtgggtcccagtcgaggttcagtggcagtggatcgtggactagtatttcactctcaccatcagtatctgactaagtgaagtatttgactaacttattactgtacaatagtaaacttactaattcgtttaccgaccgtaagggtacctaacggtaacttaaacgtaaattaaaccgtaacgttaggtacggtactacggacctacctattaccgttcgtacctttactaacttcccttaccccgactacttcctaggtaacc

SEQ ID NO: 138384 - DNA, 743 bp, Homo sapiens
  misc_feature: GYAE6OF01CPAK5.46.67.G01.1.454.CMB.1.raw
  modified_base (208)..(208): a, c, t, g, unknown or other
  misc_feature (208)..(208): n is a, c, g, or t
  modified_base (355)..(355): a, c, t, g, unknown or other
  misc_feature (355)..(355): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtcgcctcatcagtagtggtttctcgtgggctgggtccgnagctccgagggagggctggaatacgagttggaagtgtctctacagtaggtggacggttcctattacagtccgtctctacgaagcgtcgagtaccaacctatactcctgtacggacacgtccagtacaactctacgtttccagaagtntgtagttctgtacgaccgtccgtctagaacgtacgggtctttaacgttcgtggtacgcgaaggacgtacggtactttaagttagttagtttaagttttggtaacggtttaggttttaactttaccggaaccttacccgtaaggtaacgttacccggggtacgggggtcccttaacccgggtaccccggtacggggtacccgtaaaggggtaaccttaccgggttacggtaccgtaccccggtttaccttacccgttacccgtaccccgttacccgaaccccggtaacccgggtaccccgtaaccggtttccccggttacccccgttaccccccgtcgggtacccccctaccccgtttacccgaaccccgtaaggtcccgtaaccccgg

SEQ ID NO: 138385 - DNA, 523 bp, Homo sapiens
  misc_feature: GYAE6OF01AR3PK.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgaccaccttatttaaattggtatcaacatagaccagggacggccctaagctcctaatctatgctgcatccagtttgcaaagtggggtcccatcgaggttcagtggcagtggatcgtgggacagatttcactctcaccatcagtaatctgacaagtgaatatttgactaacttattactgtacaacagtaattaacattagttttcggacctaaggactaacgaactaactaaacttaacgactgtgactgacactatctgtccttactacttccttacccgctatcgtgtaac

SEQ ID NO: 138386 - DNA, 580 bp, Homo sapiens
  misc_feature: GYAE6OF01AB1S5.46.67.G01.1.454.CMB.1.raw
  modified_base (193)..(193): a, c, t, g, unknown or other
  misc_feature (193)..(193): n is a, c, g, or t
  modified_base (228)..(228): a, c, t, g, unknown or other
  misc_feature (228)..(228): n is a, c, g, or t
  modified_base (330)..(330): a, c, t, g, unknown or other
  misc_feature (330)..(330): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtcctccatcctccctgtctgcaaccgtggganacagtgtcaccatcacgttgccggcaagtcgaacnttgacactattaatggtatcaacatagaccaggacggccctaagctacctaatctatgactgctatccagtttgacaagtgggtcccagtcgagtcagtgcngtgatcgtggacagattcactctcacatcagtatctgacaacgtgtaactatttcgactaactttattactagtaccaaactagtaaatttaactaacgtttacgttttaccggaccgtaaacggtaccgtaaccgtaacttaacctaaagtttaaaccgtaacgtacgtggtacctgtaccccgtaactacgttactaccggttcttacctacgtttccgttaccctacccttatccgtacggttaacc

SEQ ID NO: 138387 - DNA, 563 bp, Homo sapiens
  misc_feature: GYAE6OF01A2JB9.46.67.G01.1.454.CMB.1.raw
  modified_base (334)..(334): a, c, t, g, unknown or other
  misc_feature (334)..(334): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattgtatcaacatagaccagggacggccctaagctcctaatctatgctgcatccagtttgcaaaggtggggtcccatcgaggttcaggtgnagtggatcgtgggacagtatttcactctcaccatcagtatctgacaacggtgaagttattttgactaactttattacgtgtacaaacgtataaactttacgaagtttcgttttaccggacccgtaaagggacctaacgtaactaaactaaattaaaccgattacggtgacctcgacctacccattcgtcttaccttcctacttccccttacccgactattccgtgtacc

SEQ ID NO: 138388 - DNA, 718 bp, Homo sapiens
  misc_feature: GYAE6OF01BHMXW.46.67.G01.1.454.CMB.1.raw
  modified_base (253)..(253): a, c, t, g, unknown or other
  misc_feature (253)..(253): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcgggagaccctgtcccctcacctgcgctgtctctggtgcctccatcagtagttggtttctcgtggggctgggtccggnagccgtcccgagggaagggctggaatacagttggaagtgtctctcatagtggaggttcctattacagtccgtctctcaagagtcgagtcaccagtatctctgacaccgtcagcaatctacgttttcccagaagattgagtttctgtcgaccgtccgcgtggaccgtacgggttacgttttacgttacgttggttcggcggtaaggacggtacgggtctttaagtttaacgttggtttaagtttttttggggaagggttttgggtttttaacgttttacccggtaacccgttaacccgttaacgggtaacggttacccggggacccggggggttaccgttacccccgggtaacccccgggttaggggggtaccccggtaacgggggttaaaccttaccggttaccgggttacccgtaccccggttacccgtttcccccgttttaccggcccccggttaacccccgg

SEQ ID NO: 138389 - DNA, 554 bp, Homo sapiens
  misc_feature: GYAE6OF01AR28P.46.67.G01.1.454.CMB.1.raw
  modified_base (334)..(334): a, c, t, g, unknown or other
  misc_feature (334)..(334): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccgagggaaggggctggaatacattggaagtgtctctcatagtggaggttcctattacagtccgtctctcaagagtcgagtcaccatatctctggacacgtcagcaatcagttttcccngaagatgagttctgtcgaccgcgctgacacgggtctttattactgtgcgagagacggctattatgtattttggagttggttattcgactaccctagactcggacggggctccggacccgtgggccagggtaactacgtggtaccgaccgtctccttagccctccaccgacgggcccagtccggtccttcccccgtggcccaccctcctccaagcgtcccg

SEQ ID NO: 138390 - DNA, 540 bp, Homo sapiens
  misc_feature: GYAE6OF01A6H0G.46.67.G01.1.454.CMB.1.raw
tcagactagcagtacacgaccggtgctcgatttagagtatacatattgggtttgggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggccctaagctcctaatctatgctgcatccagtttgcaaagtggggtcccatcgaggtttcaggtggcaggtggatcgtgggacagtatttcactctcaccatcagtatctagacacgtgaagtatttgactaacttattacgtgtacaacagtaaattactaattacgttttacgaccgaagggtaccacgtaactaactaaattaaacgaactgtagctagaccacctatcgtcttcttctacttcccttccgacctattcgtgtaacg

SEQ ID NO: 138391 - DNA, 550 bp, Homo sapiens
  misc_feature: GYAE6OF01B92LJ.46.67.G01.1.454.CMB.1.raw
  modified_base (533)..(533): a, c, t, g, unknown or other
  misc_feature (533)..(533): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggcagctcccgaggggaaggggctggaatacattggaagtgtctctcatagtggaggttcctattacagtccgtctctcaagagtcgagtcaccatatctctggacacgtccagcaatctagttttcccagaagatgtagttctgtcgaccgcgctgacgacgggtctttattactgtgcgagagacggtctattatgtattttggagttggtttattcgtactaccgtagacgtcggacggggctccgacccgtgggccgagggatcgtggtccaccgtctcctacgcctccaccgacggcccagtccgtcctccccgtcgccnccctcctccagcgaccg

SEQ ID NO: 138392 - DNA, 698 bp, Homo sapiens
  misc_feature: GYAE6OF01DAV0O.46.67.G01.1.454.CMB.1.raw
  modified_base (276)..(276): a, c, t, g, unknown or other
  misc_feature (276)..(276): n is a, c, g, or t
  modified_base (689)..(689): a, c, t, g, unknown or other
  misc_feature (689)..(689): n is a, c, g, or t
tcagactagcagtacacgaccggtgctcgatttagagtatacatattgggtttggggagtctcggtcaggacacagcatggacatgagggtccccgctcagctcctggggctcctgctactctggctcgaggtgccagatgtgacatcgagctgacccagtcctccatccctccctgtctgcaaccggtgggagacagtcgtcaccatcacgttggccgggacaaggtacggaactattagaacctaccgttaattttaaagttggtaactacaanagtaagaccgagggaccgaccctaagctacctaatctatgctgacactctagtttagacaaaggttcgggtccctagtcggtaggttcaggtcgacgtaggttggacttcggtacggggaactacgttaactttacactacctacaacccgtatacgtaagttactcgtacgtacaaacggttagtaaagtttacttttagaaccttaaatttaacgttacttacgtaaacctaaacgtaagttaaactttacgttaacgtttacggttttaccggaaccggtaaacggaaccgtaaaccgtaaaccttaaaacgtaaaaccgttaaacgaacgttaggtaccgtacgttacggaccctaacgttacttccgtagttacccttctaacgttacccctaccgtactacgttcgngtttaaccg

SEQ ID NO: 138393 - DNA, 614 bp, Homo sapiens
  misc_feature: GYAE6OF01C8WFL.46.67.G01.1.454.CMB.1.raw
  modified_base (219)..(219): a, c, t, g, unknown or other
  misc_feature (219)..(219): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgcccggganaagtcggaacattgacaccttatttaaatgtatcaacatagaccagggacgccctaagctcctaatctatgctgccatcccgtagtttcgacgtaaacggttcggggtcccagtcgtaggttcaggttggcaggtggatcgttaggggactaggtatttcacgtctcacctatactagtaatctagactaacgtagaagttattttacgacttaacttattacttagtaccaaatagtaaactttaactaagtttacggttttaccgaccgtaaagggtaacctaaccgtaactaaactaaaattaacgtaaacgttggtacgaccgtgacctaacctattaccttacggttaccttacctacgttcccttaccccgactacttcgtagttaacg

SEQ ID NO: 138394 - DNA, 577 bp, Homo sapiens
  misc_feature: GYAE6OF01BGZC4.46.67.G01.1.454.CMB.1.raw
  modified_base (289)..(289): a, c, t, g, unknown or other
  misc_feature (289)..(289): n is a, c, g, or t
  modified_base (335)..(335): a, c, t, g, unknown or other
  misc_feature (335)..(335): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggcagctcccgagggaagggctggaatacattggaagtgtctctcatagtggaggttcctattacagtccgtctctcaagngtcgagtcaccatatctctggacacgtcagcaatctacgtttcccngaacgatgtagttctgtcgaccgcgctgacgtacgggtctttatcgtgtgacgagagacggtcttattatgtagttttggagttggtttacttcgactacctagacgtcggtacggggtctccggacccgtggggaccgagggtaactacgtcggtctaccgtctccgtacgccctaccgaccgacggtcccacgtcccggtcccttccccgtcgtccctaccctccctaccagcgtacccg

SEQ ID NO: 138395 - DNA, 636 bp, Homo sapiens
  misc_feature: GYAE6OF01A2H3N.46.67.G01.1.454.CMB.1.raw
  modified_base (194)..(194): a, c, t, g, unknown or other
  misc_feature (194)..(194): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtcctccatcctccctgtctgcaaccggtggganacagtgtcaccatcacgttcggccgggacaacggtcggaactattcgactaaccttaatttaaagttggtatacaactatacgaccgagggaccgaccctaagcctacctatctatgctgcactcctagtttcgacgtaaggtcgggtaccagtcgaggttcaggtgctagtgatcgaggacagtacttcactctacactatacgtaacgtaactcgtacgacgtaacgttagtaagttactttacgaacttaactttagttactacgtaacaataacgtaatttaactagttttacgttacccggaacgtaaacgggtaacctaacgtaaccttaaacgtaaaacgtttaaccgagttacggtacgtcgtacgtaaccctacttattcgttacgttaccttactaaccgtttcccgtacccgacttattccgtagtaaccg

SEQ ID NO: 138396 - DNA, 572 bp, Homo sapiens
  misc_feature: GYAE6OF01ENM7S.46.67.G01.1.454.CMB.1.raw
  modified_base (251)..(251): a, c, t, g, unknown or other
  misc_feature (251)..(251): n is a, c, g, or t
  modified_base (334)..(334): a, c, t, g, unknown or other
  misc_feature (334)..(334): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactgggtgaggccttcggagaccctgtccctcacctgcgctgtctctggtcgcctccatcagtagtggtttctcgtggggctgggtccgnagctcccgagggaagggctggaatacagttggaagtgtctctcagttaggtggtaggttcctattacagtccgtctctcaagngtcgatcacatatctctggacacgtcagcaatctacgttttcccagaagtatgagtttctgtacgaccgccgcgtcgacgtacgggtctttattacgtggtgcgagacgtacggtcttagttatgttattttgggagtttggttactttcgactacccgtagagtccgggacggggtctcccggtcccgtggggaccagggaactcgtcggtaccaccgttctccttcgccctacccg

SEQ ID NO: 138397 - DNA, 553 bp, Homo sapiens
  misc_feature: GYAE6OF01DFXA5.46.67.G01.1.454.CMB.1.raw
  modified_base (191)..(191): a, c, t, g, unknown or other
  misc_feature (191)..(191): n is a, c, g, or t
  modified_base (226)..(226): a, c, t, g, unknown or other
  misc_feature (226)..(226): n is a, c, g, or t
  modified_base (369)..(369): a, c, t, g, unknown or other
  misc_feature (369)..(369): n is a, c, g, or t
tcagactagcagtacacgaccggtgctcgatttagagtatacatattgggtttggggagtctcggtcaggacacagcatggacatgagggtccccgctcagctcctggggctcctgctactctggctcgaggtgccagatgtgacatcgagctgacccagtctccatcctccctgtctgcaaccgtggganacagtgtcaccatcacttgccgggcaagtcgaacnttgactactatttaaatgtatcaacatagaccagggacgccctaagctacctaatctatgctgcatccagtttgactaaaggtcgggtacccagtcgtaggttcagtggcaggtggtatcgtgggactagtactttcacttcncacctatcaagtaatctgactaacgtgtaagtatttcgactaacttattactgtacaatagtaattactaattgtttaccggacgtaagggtacctaacgtaactaaactaaagttaaacgaacgtgtgactagacctactatcttcgttcttcgtactccgtttacccgactactctggtaac

SEQ ID NO: 138398 - DNA, 633 bp, Homo sapiens
  misc_feature: GYAE6OF01B7WHQ.46.67.G01.1.454.CMB.1.raw
  modified_base (289)..(289): a, c, t, g, unknown or other
  misc_feature (289)..(289): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggcagctcccgagggaggggctggaatacattggaagtgtctctcatagtggaggttcctattacagtccgtctctcaagngtcgagtcaccatatctctggaccacgtccagctaatctacgttttccccagaagtactagacgtttctggttcgacccggcccgcgtcgaccgtacgggtcgttttaagttacgtgtcggacggaggaacggacggtacttattagttagttagtttttgggtagtttgttagtttccgactacccgtagacgtcggtacggggtcctccggacccgtcgggccgagggtaactacgttcggtcctaccgtcctccgttacgtccctacccgaccgacggccctacgttcccggttcccttcccccgtacggtcccacccctcccaccctaggaccgtacccg

SEQ ID NO: 138399 - DNA, 707 bp, Homo sapiens
  misc_feature: GYAE6OF01CYCP3.46.67.G01.1.454.CMB.1.raw
  modified_base (197)..(197): a, c, t, g, unknown or other
  misc_feature (197)..(197): n is a, c, g, or t
tcagactagcagtacacgaccggtgctcgatttagagtatacatattgggtttggggagtctcggtcaggacacagcatggacatgagggtccccgctcagctccgtggggctcctgctactctggctcggaggtgccagatgtgacatcgagctgacccagtctccatccctcctgtctcgacgaaccggtggganacgtagtcgtaccaccatcgtacgttcggaccggataacggtaccggaactagtttcgaacctaaccttaattttaaagttaggtactacaactagtacgaaccgaagggacccgacctagctaccgtatctatgctgacactcagtttcgacgtaagggtcggtacctagtcgtacggtcaggtgtcgtaggtaggtacgtcggtaggaactacgttactttaccgacttacgtacaacgtaactacgtaagttaactccgtacgtaacgtaacggttagtaaaggtttactttaagacctttaaatttacgttacttagtaactaaataacgttaaacttaacgttagtttacgggtttaccggaaacggtaaccgggtactaaaccgttaaactaaacgtaaaacgttaacgaacgttacggttagaccttagaacctaacgttactacgtttactccgttaacctacgtttcccgtaacccgtacttaacgttcgtacggttaacc

SEQ ID NO: 138400 - DNA, 606 bp, Homo sapiens
  misc_feature: GYAE6OF01DDEYE.46.67.G01.1.454.CMB.1.raw
  modified_base (227)..(227): a, c, t, g, unknown or other
  misc_feature (227)..(227): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgcaccatcacttgccgggcaagtcggaacnttgacactatttaatgtatcaacatagaccagggaccgccctaagcctactaatctatgctgcatcctagtttgacaaaggtcgggtcccagtcgaggttcaggtgcagtggatcgtagggacagtatttcacttctcacctatacagttaactcgtagaccgtaaggtagtaaagttacttttagaaccttaacgttttaacttaacgtagttaaccaactaagttaaattaacgttaatttcggttttaaccggaccgtaaacgggtaccaacggtaacttaaactaaaacgtttaacgaacgttaggtacggactcgaccgtacctagttaccttgttaccttaccacttaccttacccgcttaacgtctagtaac

SEQ ID NO: 138401 - DNA, 654 bp, Homo sapiens
  misc_feature: GYAE6OF01BITJ0.46.67.G01.1.454.CMB.1.raw
  modified_base (191)..(191): a, c, t, g, unknown or other
  misc_feature (191)..(191): n is a, c, g, or t
  modified_base (197)..(197): a, c, t, g, unknown or other
  misc_feature (197)..(197): n is a, c, g, or t
tcagactagcagtacacgaccggtgctcgatttagagtatacatattgggtttggggagtctcggtcaggacacagcatggacatgagggtccccgctcagctccgtggggctcctgctactctggctcgaggtgccagatgtgacatcgagctgacccagtctccatcctcctgtctgacacggtggganacagtntcaccatcacgttggccggacaagtccggaactagttacgacctacttaatttaaagtgtatacaacatacgaccgacgggaccgacctaagcctactaatctatagctgactactcctagttacgacgtaaggtcgggtacctagtcggtagttcgagtcggacgtaggtaggtagtcgtaggactagttacttacacgtctactaacgtactacgtaacgttaactacgtacgtacgtaacggttagtaacgttagttttacgaacttaaacgtttacttaacgttaacgtaactaactaaagtaactttaaccgtaagtttccggtttacggaaccgtaacgggaacctaaccgttaactaaacgtaaacgtaaccgtacgtacggtcgtactaacgtcctaacttactcgtttactcttactaccgttccttacccgactacttgtcgttacc

SEQ ID NO: 138402 - DNA, 607 bp, Homo sapiens
  misc_feature: GYAE6OF01EXGQA.46.67.G01.1.454.CMB.1.raw
  modified_base (193)..(193): a, c, t, g, unknown or other
  misc_feature (193)..(193): n is a, c, g, or t
  modified_base (257)..(257): a, c, t, g, unknown or other
  misc_feature (257)..(257): n is a, c, g, or t
  modified_base (354)..(354): a, c, t, g, unknown or other
  misc_feature (354)..(354): n is a, c, g, or t
tcagactagcagtacacgaccggtgctcgatttagagtatacatattgggtttggggagtctcggtcaggacacagcagtggacatgagggtccccgctcagctcctggggctcctgctactctggctccgaggtgccagatgtgacatcgagctgacccagtctccatcctccctgtctgcaaccgtggganacagtgtcaccatcacgttgccgggcaagtcggaacattgactacttatttaaattgtatcaanatagaccgagggaccgaccctaagctacctaatctatgctgctactccgtagtttacgacgtaaaggtcgggtacccagtcgaggttcaggtggacngtgatgtggactagtattcactctacacatactagtaatcgtagactaacgtagtaagttatttagtacttaactttattactacgtaactaacgtaagtaatttaactaagttacgtttacggaaccgtaacgggactaacgtaaacttaaactaaacgttaaacgtaacgttacggtacgtactacgaccgtacctattcgttacgttaccttactaccttcccttacccgtactacgttcgtacgtaacg

SEQ ID NO: 138403 - DNA, 598 bp, Homo sapiens
  misc_feature: GYAE6OF01BJ2VG.46.67.G01.1.454.CMB.1.raw
  modified_base (228)..(228): a, c, t, g, unknown or other
  misc_feature (228)..(228): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacnttgacacctattaaattggtatcaacatagaccagggaccgccctaagctctaatctatgctgcatccagtttgactaaaggtcgggtaccctagtcggtaggttcaggtggacaggtggatcgtagggacagtactttcactctcacctatacagttatctacgactaacgtgtaagtagtttacgacttaactttattactagtacctaacgtagttaaattactaagtttcgtttccggaaccgtaacgggtacctaacgtaaacttaaactaaacgttaacgaacgttggtacggtactacgaccgtaacctatacgttcgttaccttctacgttcccttaccccgacttacttccgtagtaaccg

SEQ ID NO: 138404 - DNA, 664 bp, Homo sapiens
  misc_feature: GYAE6OF01BQYP2.46.67.G01.1.454.CMB.1.raw
  modified_base (194)..(194): a, c, t, g, unknown or other
  misc_feature (194)..(194): n is a, c, g, or t
  modified_base (221)..(221): a, c, t, g, unknown or other
  misc_feature (221)..(221): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtcctccatcctccctgtctgcaaccggtggganacagtgtcaccatcacttggccggganaagtcggaactattcgactacttaatttaaattggtatacaacatagacgagggaccgaccctaagctacctaatctatcgctgcatcctagtttgactaaaggtcgggtacccaagtcggtaaggtttcaggtcggactaggtggatcgtgggactagtactttcactctcgacctatacctaagtaactcgtagactaacgtacgtaagttagtttagacttaaacgtttattactagtaacctaaacgtaagtaaactttaacgtaagtttacgttttaccggaacctaaacgggtacctaaacgttaaaccgttaaactaaaacgttaaaccgtaaccgttaggtaccggtaccgtacgtacccgtaacctaagttacgttccgtttacctttactaacgttcccctttaccccgtacctaacttacctcggttaaacc

SEQ ID NO: 138405 - DNA, 621 bp, Homo sapiens
  misc_feature: GYAE6OF01AFH2A.46.67.G01.1.454.CMB.1.raw
  modified_base (193)..(193): a, c, t, g, unknown or other
  misc_feature (193)..(193): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtggganacagtgtcaccatcacgttcggccgggacaagtcggaactattgacctaccttaatttaagttggtatacaacatacgaccgagggaccgccctaagctactaatctatgtgcactctagtttgacgtaaggtcgggtaccagtcggtaggttcgaggtggcgtaggtggtactcggtagggactagtactttcactcctaccacctatacgtaagttactcgtacgacgtaacgtagtaagttatttacgacttaactttacttacgttactaactaactaagtaacttacgtaagtttacggtttaccgaacggtaacggtacctaacgtaacctaaacgttaaacgttaacgacgttcggtacgtcgtacgacctacgtacgttattacttcttactacttacccgtcctactactctgtctacg

SEQ ID NO: 138406 - DNA, 682 bp, Homo sapiens
  misc_feature: GYAE6OF01BI2HG.46.67.G01.1.454.CMB.1.raw
  modified_base (192)..(192): a, c, t, g, unknown or other
  misc_feature (192)..(192): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttcggccgggacaagtcggaacattcgactacttaatttaaatggtatacaacatacgacgagggaccgaccctaagctaccgtaatctatcgactcgactacttaccgtagtttacgacgtaaacgggtcgggtaccctagttacggtacggtttacgaacgggttcggacgtagggttacgggtagttaccggtaggggaactaaggttactttacctaccgttacctacctaaccgtacgttaccgaagtttaacttcgtacggtaactaacggttagttaagtttacttttacgaacctttaacgtttacttacgttagtacaaacgtagttaacttacgtaagtttcggtttaacggaaccgtaagggtaacctacgtaaactaagttaaacgttaacgtacgtaggtacgacgtacgaccgtactattcgttacttcttacacgttcctaccgattactcgtagtacg

SEQ ID NO: 138407 - DNA, 548 bp, Homo sapiens
  misc_feature: GYAE6OF01EEISX.46.67.G01.1.454.CMB.1.raw
  modified_base (342)..(342): a, c, t, g, unknown or other
  misc_feature (342)..(342): n is a, c, g, or t
  modified_base (523)..(523): a, c, t, g, unknown or other
  misc_feature (523)..(523): n is a, c, g, or t
  modified_base (536)..(536): a, c, t, g, unknown or other
  misc_feature (536)..(536): n is a, c, g, or t
  modified_base (541)..(541): a, c, t, g, unknown or other
  misc_feature (541)..(541): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagttggtttcttcgtggggctgggtcccggcagcctcccgaggggaaggggctggaatacagttggaagtgtctctcatagtggaggttcctattacagtccgtctctcaagagtcgagtcaccatatctctggacacgtccagcaatctagttttcccngaagatgagttctgtgaccgcgctgactacgggtcgttttattactgtgcgagagacggctattatgtattttggagttggttatttcgactacctagatcggacgggcctcgcccgtgggccagggatacgtgtcaccgtctcctacgcctccacgacggcccactccggtcctccccgngcccaccctcccnccagngtacccg

SEQ ID NO: 138408 - DNA, 700 bp, Homo sapiens
  misc_feature: GYAE6OF01EA3O6.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactgggtgaggccttcggagaccctgtccctcacctgcgctgtctctggtgcctccatcagtagtggtttcttcgtggggctgggtccgcagctcccgaggggaagggctaggaatacagttgggaagtgtctctcatagtggaggttcctattacagtccgtctctacaagagtcgagtcaccatatctctggacacgtccagcaatctaacgtttttcccagaacgtatcggtaagtttcgtaggtaccgaacccggtccccgtacgtcggaaccggtaccggggtcgttttaattacgtggttcggacggagacggaccggtctttagttagttgttaagtttttcgggtagtttaggtttactttccgaactacccgttagacgttcgggacggggtctaccggtaccccggtggggacccgtaagggtaacttacgttcggtaccctaccgttccttacccgttacgccccgtacccgaacccggtaccgggcccctaacggttcccggttacccccgttcccccgacgggtcccctaacccccgttacccaacccgtaacggccgtaccccgg

SEQ ID NO: 138409 - DNA, 526 bp, Homo sapiens
  misc_feature: GYAE6OF01EXU95.46.67.G01.1.454.CMB.1.raw
  modified_base (288)..(288): a, c, t, g, unknown or other
  misc_feature (288)..(288): n is a, c, g, or t
  modified_base (292)..(292): a, c, t, g, unknown or other
  misc_feature (292)..(292): n is a, c, g, or t
  modified_base (397)..(397): a, c, t, g, unknown or other
  misc_feature (397)..(397): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggccctaagctcctaattcntatnctgcatccagtttgctaaagtcgggtacccagtcgaggttcgagtggcagtggagtcgtggacagtattcactctcacatcagtaatctgacaacgtagaagtanattttagtcaacttattactagtactaacagaattaactaatagtttacggtaccaaggaacgacgaactaactaaattaaacgaacgagtggactagtcaccatctcgtacttctactcttcccgtcc

SEQ ID NO: 138410 - DNA, 592 bp, Homo sapiens
  misc_feature: GYAE6OF01BOBVQ.46.67.G01.1.454.CMB.1.raw
  modified_base (417)..(417): a, c, t, g, unknown or other
  misc_feature (417)..(417): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacaccttatttaaattggtatcaacatagacagggacgaccctaagctctaatctatgctgcatccagtttgacaaaggtcgggtacccatcggaggttcaggtggacaggtggatcgtgggacagactttcactctcacatcagtaatctagacaacgtagaagtatttgactaacttattactntacgaactaagtaattaactaagttcgttttacggaaccgtaaacgggactaaccggtaacttaaacgtaaaacttaaacgtaacgtaggtacggactacgaccgtaactattacttagttacccttacgtaactttacccgttaccccgtacctaacgttccgttaggtaaacc

SEQ ID NO: 138411 - DNA, 639 bp, Homo sapiens
  misc_feature: GYAE6OF01CS2A2.46.67.G01.1.454.CMB.1.raw
  modified_base (219)..(219): a, c, t, g, unknown or other
  misc_feature (219)..(219): n is a, c, g, or t
  modified_base (247)..(247): a, c, t, g, unknown or other
  misc_feature (247)..(247): n is a, c, g, or t
  modified_base (436)..(436): a, c, t, g, unknown or other
  misc_feature (436)..(436): n is a, c, g, or t
  modified_base (505)..(505): a, c, t, g, unknown or other
  misc_feature (505)..(505): n is a, c, g, or t
tcagactagcagtacacgaccggtgctcgatttagagtatacatattgggtttgggggacctcctgtgcaagaacatgaagcacctgtggtttgtcctcctgctggtggcagcctcccagatgggtcctgtccctggtgcaactgcaggagtcgggcccagactgggtgacggtccttcggacgccctgtcccctcaccctgccgctgtctcgtggtcncctacatcgagttagttggtttctcggnggggctcggggtccgcagtccgtaccgaggggaagggctagggaactacgtagttaggaagtcgtctctctaagttaggtgggtacgtttcctagttaaccacgttccgtctactacgaaagtacgtcgacgtccaaccattactctgtacggactacggtccagactaactcttacgttttccagaanatgtagttcgtgtcgaccgtcgtctagaacgtcgggttactttagtacgtggtacgacgtagacgcgtnttattagtgttatttggagttgttatcgacacctagacgtcgggacgggtctaccggtacccgggtgggacccgaagggtaacctcggttacggtacccgtacccgttattcccgttacgccccgttaacccgg

SEQ ID NO: 138412 - DNA, 638 bp, Homo sapiens
  misc_feature: GYAE6OF01CIWDJ.46.67.G01.1.454.CMB.1.raw
  modified_base (403)..(403): a, c, t, g, unknown or other
  misc_feature (403)..(403): n is a, c, g, or t
tcagactagcagtacacgaccggtgctcgatttagagtatacatattggggtttggggagtctcggtcaggacacagcatggacatgagggtccccgctcagctcctggggctcctgctactctggctccggaggtgccagatgtgacatcgagctgacccagtctccatcctccctgtctgcaaccgtgggagacagtgtccaccatccacttcggccggggcaaggtcggaactattgaactaccttatttaaatggtatacaacatagacgagggaccgcctaagctacctaatctatgctgcattccagtttcgactaaggtcgggtcccagtcggtaggttcaggtggctaggtggatcgtagggactagtatttcactctcaccatctagtaactcngtacgaacgttgtaaagttattttgaactttaactttattaacgtacgtaactaaacgtaagtaactttaacgtaagttttcgggtttaccggaaccgtaacgggtaacctaaccgttaactaaactaaaacgttaaccgtaagtcggttacggccgttagacccgtaacttatttaccgttcgttacctttcctaccttaccccgtttcccgacccttaattccgtacgtaacg

SEQ ID NO: 138413 - DNA, 791 bp, Homo sapiens
  misc_feature: GYAE6OF01AC89E.46.67.G01.1.454.CMB.1.raw
  modified_base (179)..(179): a, c, t, g, unknown or other
  misc_feature (179)..(179): n is a, c, g, or t
tcagactagcagtacacgaccggtgctcgatttagagtatacatattgggtttgtcctcctgctggtggcagctcccagatgggtcctgtccctggtgcaactgcaggacgtccgggcccacgactggtgaggccttcgggacgacccctgtcccctcacctgcgctgtctcgtggtcnccctcatcagttgttgtttctcgtgggctcgggtccgcacgccgtccggaaggggacggctaggaatacgagttaggaacgttgtactctacgagttaggtggtacgttcctattaccgacgttccgtctcgtacgaagtacgtcgagtaccaacctatactcctacgtacggacctaccgtaccacgacctaacgttccgtttaccgttttacccgaaggaacgttacgttcggttacgtttccgtacggttacccggacccggtcccgtacgtaccggtaacccggttacgggtttaccttttaagttacgtcgggtacggacggaggtacgtaccggttatttagttagttagtttaggtttttaggtagtttacggtttaacttacccgaaccttacccggtagtaccggtacccggggccgggtaccctaccggacccggtagggaccgtaagggtaccttcggtccgttacccgtacccgttaccgtccgtaccgaccccgtaccgaacccggtacccggtacccttacccggttccccggttacccccgttcccccgacggtacccccttacccccgtacccgaccgtacggtcccgtaccccgg

SEQ ID NO: 138414 - DNA, 573 bp, Homo sapiens
  misc_feature: GYAE6OF01D9Y2G.46.67.G01.1.454.CMB.1.raw
  modified_base (379)..(379): a, c, t, g, unknown or other
  misc_feature (379)..(379): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagttagtggtttcttcgtggggctgggtccggcagcctccgagggaagggctggaatacattggaagtgtctctcatagtggtaggttcctattacagtccgtctctcaagagtcgagtcacatatctctggacacgtcagcatctacgtttccagaagntgagttctgtcgaccgcgctgacgacgggtacgtttattctgtgcgagagacggtctattgtgttagttttaggagttaggtttatttacgacctaccgtagtagtcgggacggggtccgtccggtaccccggtggggccgtacgggaattcggtcggtccgtaccggttccttcccgtacgtcccgtaccccg

SEQ ID NO: 138415 - DNA, 656 bp, Homo sapiens
  misc_feature: GYAE6OF01CLVWG.46.67.G01.1.454.CMB.1.raw
  modified_base (229)..(229): a, c, t, g, unknown or other
  misc_feature (229)..(229): n is a, c, g, or t
tcagactagcagtacacgaccggtgctcgatttagagtatacatattgggtttggggagtctcggtcaggacacagcatggacatgagggtccccgctcagctcctggggctcctgctactctggctccggaggtgccagatgtgacatcgagctgacccagtctccatcctccctgtctgcaaccgtgggagacagtgtcaccatcacttgccgggacaagtcggaanattgacacttatttaaatgtatcaacatagaccgagggaccgccctaagctctaatctatgctgcatccagtttcgacaagtgggtcccatcgagttcgagtgcagtgatcgtggatagatttcgactctacaccatcaagtatctagacgtaacgtagtaagttactttagacttaacttacttacgttagtacctaaagtagtaaacttaataacgttcgttttacggaaccggtaacggtaactaaccggttaacttaaaccgttaaaacgttaaaccggtaaaccgttagggttacggtaaccgttagtaacccgtaaacccgttaaccgtttacgttaccggtttcccttttaaccgttaccgttttaccccgtttaacccccgtacccgtttaaccgtttacgttaacccgtttaaaccgg

SEQ ID NO: 138416 - DNA, 500 bp, Homo sapiens
  misc_feature: GYAE6OF01E1PQZ.46.67.G01.1.454.CMB.1.raw
  modified_base (493)..(493): a, c, t, g, unknown or other
  misc_feature (493)..(493): n is a, c, g, or t
  modified_base (496)..(496): a, c, t, g, unknown or other
  misc_feature (496)..(496): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggccctaagctcctaatctatgctgcatccagtttgcaaagtgggtcccatcgaggttcagtggcagtgatctgggacagatttcactctcaccatcagtaatctgcaacgtgaagatttgctaacttattactgtcaacagaattacaatgttttacgaccaagggacacgaactaacaaattaaacgaactgtggctgcacatctctctctactcctcccacnctngtac

SEQ ID NO: 138417 - DNA, 533 bp, Homo sapiens
  misc_feature: GYAE6OF01C449L.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatgtatcaacatagaccagggacgccctaagctcctaatctatgctgcatccagtttgacaagtgggtcccagtcgaggttcagtgcagtggatcgtgggacagtatttcactctacacctatcagtaatctagacaacgtgaagttatttgactaacttattactgtacaatagtaattacaagtttcgtttacggaccgaagggactaacgaacttaactaaattaacgaacgttggtgctagaccacctattctcgttacttcacttcccttcccactactctgtac

SEQ ID NO: 138418 - DNA, 622 bp, Homo sapiens
  misc_feature: GYAE6OF01BCHYA.46.67.G01.1.454.CMB.1.raw
  modified_base (393)..(393): a, c, t, g, unknown or other
  misc_feature (393)..(393): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtggagacagtgtcaccatcacttggccgggcaaggtcggaacattgactaccttaatttaaattgttaatacaacataacgaccgagggaccggccctaagctacctaatcctatgctcgctactccgtagtttcgacgtaaaggtcgggtacccagtcggtaggttcaggtggcaggtgatcgagggacagtattcactctcacntacagtaatcgtagactaagtagaagttatttacgacgttaactttacgttaactgtaacctaaacgtataaacgtttaactaagtttccggttttacggaaccgtaagggtacctaacgtaaacctaaacgtaaaacgttaacgaacgttggtacgactacgtaccgaacctattccgttgttaccttacgtacttccccgttacccacctacgttaccgtgttaacg

SEQ ID NO: 138419 - DNA, 700 bp, Homo sapiens
  misc_feature: GYAE6OF01D8IC9.46.67.G01.1.454.CMB.1.raw
  modified_base (213)..(213): a, c, t, g, unknown or other
  misc_feature (213)..(213): n is a, c, g, or t
  modified_base (419)..(419): a, c, t, g, unknown or other
  misc_feature (419)..(419): n is a, c, g, or t
  modified_base (431)..(431): a, c, t, g, unknown or other
  misc_feature (431)..(431): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgccgctgtctctggtcncctccatcagtgttggtttctcgtggggctgggtccggcagcctcccggaggggaaggggcctaggaatacgtagttggaagtgtctctctataggtggacgttcctaattacgagttcccgtctcctacgaagtcgtacgagtccaacctattactctactaggacctacgtccagactaatcgttacgttttcccaggaacgtntcgtacgtttcncggtacgacccggtctcgtacggtaccgtacggggttcttttaagttcgtaggtcgacggtaggtaacggtacggtactttaagttacgttggtttagtttacgggtagtttacggttacgtttaccgacctacccggttaaggaccgttaccggggaccggggtaccgtaccccggtacccgggtggggtaacccgaagggttaccgttaccggtcgggttaccctacccggtttaccgtccccgtttaagcccccgttaaaccccgg

SEQ ID NO: 138420 - DNA, 592 bp, Homo sapiens
  misc_feature: GYAE6OF01EYI1Y.46.67.G01.1.454.CMB.1.raw
  modified_base (213)..(213): a, c, t, g, unknown or other
  misc_feature (213)..(213): n is a, c, g, or t
  modified_base (250)..(250): a, c, t, g, unknown or other
  misc_feature (250)..(250): n is a, c, g, or t
  modified_base (393)..(393): a, c, t, g, unknown or other
  misc_feature (393)..(393): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtcccctcacctgcgctgtctctggtcncctccatcagtagtggtttctctggggctgggtccgnagcctccgagggaagggctggaatacagttggaagtgtctctctagttacggtgggtacggtttcctaatttaccagttcccggtactctacaagagttcgagtccaccatatctcgtggacacgtcagcaatctagtttccngaatatgtagttctgtcgaccgcgcgtgacgtacgggtctttatacgtgtcggcgtagacggacgtcttagttagtgttagttttggtagtttggttatttcgtactaccgtagacgtccgggtaccggggctacccggtcccggtaggggccgaagggtaactcgttcggtcctaccgtcttccgtcgccctacccgg

SEQ ID NO: 138421 - DNA, 549 bp, Homo sapiens
  misc_feature: GYAE6OF01ELA5Z.46.67.G01.1.454.CMB.1.raw
  modified_base (193)..(193): a, c, t, g, unknown or other
  misc_feature (193)..(193): n is a, c, g, or t
  modified_base (341)..(341): a, c, t, g, unknown or other
  misc_feature (341)..(341): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtggganacagtgtcaccatcacttgccgggcaagtcgaacatgacactatttaaatgtatcaacatagaccagggaccgccctaagctacctaatctatgctgcactcctagtttgcaaagtcgggtcccatcgagttcagtggcagtgatcgngggacagtattcactctcaccatactagtaactctcgacaagttgaagtatttagactaactttatactcgtacaacagtaattactattcgtttcgacaagggtacaacgtaacctaaataaagttaacgtaacgtgtacggtctacggtaccaacctagtacttcgttaccttactacttcccttacccgcttaacgtctacgtac

SEQ ID NO: 138422 - DNA, 602 bp, Homo sapiens
  misc_feature: GYAE6OF01DZ19I.46.67.G01.1.454.CMB.1.raw
  modified_base (217)..(217): a, c, t, g, unknown or other
  misc_feature (217)..(217): n is a, c, g, or t
  modified_base (359)..(359): a, c, t, g, unknown or other
  misc_feature (359)..(359): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggnaagtcggaacattgacactattaaatgtatcaacatagaccgaggacggccctaagcctactaatctatgctgcatcctagtttagactaaggtcgggtacccagtcgtaaggttcaggtggcaggtgatcgtgggacagtnttcactctacactatacagtaatctgactaagtagaagttattttagacgttaacctttattacttacgtactaaactagtaaactttaactaagtttcggttttaacggaccgtaaagggacctacgtaaacttaaacttaaaacgttaaacgaacgttaggacggtacgtacgacctaacctagttcttacgttaccttccgtaacctttcccttaccccgaccttaattccgtaaggtac

SEQ ID NO: 138423 - DNA, 690 bp, Homo sapiens
  misc_feature: GYAE6OF01A2KNW.46.67.G01.1.454.CMB.1.raw
  modified_base (192)..(192): a, c, t, g, unknown or other
  misc_feature (192)..(192): n is a, c, g, or t
  modified_base (217)..(217): a, c, t, g, unknown or other
  misc_feature (217)..(217): n is a, c, g, or t
  modified_base (227)..(227): a, c, t, g, unknown or other
  misc_feature (227)..(227): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacgttgccggnaagtcgaacnttgacacttatttaaatgtatcaacatacgaccgagggaccgaccctaagctacctaatctatgctgcactccgtagtttcgacgtaaaggttcgggtacccagttacggtagttcgaaggttggacgtaggtggactcggtagggacagtactttcacgttctaccaacctatacgtaagtaactcgtacgacgtaacgtagtaaacgttacgtttacgaacttaaactttaagttaccgttaacgtaccaaaacgtaagttaaactttaacgtaaacgttttcggttttaaccggaaccgttaaacgggaacctaaccggtaaaccttaaacgtaaaacgttaaaccggaacgttacggtcggtaccttacggtacccgtaaccctaagtttaccgttcgttaccgttaaccctacgtttcccgttacccccggtaccttaacttccggttaagtaacccg

SEQ ID NO: 138424 - DNA, 563 bp, Homo sapiens
  misc_feature: GYAE6OF01A8B7W.46.67.G01.1.454.CMB.1.raw
  modified_base (307)..(307): a, c, t, g, unknown or other
  misc_feature (307)..(307): n is a, c, g, or t
  modified_base (336)..(336): a, c, t, g, unknown or other
  misc_feature (336)..(336): n is a, c, g, or t
  modified_base (397)..(397): a, c, t, g, unknown or other
  misc_feature (397)..(397): n is a, c, g, or t
  modified_base (502)..(502): a, c, t, g, unknown or other
  misc_feature (502)..(502): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctcgtggggctgggtccgcagcctcccgaggggaagggctggaatacattggaagtgtctctcatagtggaggttcctattacagtccgtctctcaagagtcgagtcaccatatctntggacacgtccagcaatctagttttcccngaagatgtagttctgtgaccgccgctgacgacgggtcgtttattactgtgcgagagacggntattatgtagttttggagttggttatttcgactacccgtagcgtcggacggggtcctcggccccgtgggccgagggtatacgtcggtcaccgtctcctacgcccnccaccgacggcccagtcccggtcccttcccccgtggtcccaccctccctccagcgtacccg

SEQ ID NO: 138425 - DNA, 503 bp, Homo sapiens
  misc_feature: GYAE6OF01EZ7H6.46.67.G01.1.454.CMB.1.raw
  modified_base (191)..(191): a, c, t, g, unknown or other
  misc_feature (191)..(191): n is a, c, g, or t
  modified_base (216)..(216): a, c, t, g, unknown or other
  misc_feature (216)..(216): n is a, c, g, or t
  modified_base (227)..(227): a, c, t, g, unknown or other
  misc_feature (227)..(227): n is a, c, g, or t
  modified_base (337)..(337): a, c, t, g, unknown or other
  misc_feature (337)..(337): n is a, c, g, or t
  modified_base (481)..(481): a, c, t, g, unknown or other
  misc_feature (481)..(481): n is a, c, g, or t
  modified_base (496)..(496): a, c, t, g, unknown or other
  misc_feature (496)..(496): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgganacagtgtcaccatcacttgccgggnaagtcggaacnttgacactatttaatggtatcaacatagaccagggacggccctaagctcctaatctatgctgcatccagtttgcaagtgggtcccagtcgagtcagtggcagtggatcgnggacagatttcactctacacatcagtaatctgcaacgtgaagtatttgactaacgttatactgtacaacagaattacatgtttacgactaacggactacgaactaacaaagtaacaactgtacgactgacactatctgtacttnacttcctcccgactntctgtac

SEQ ID NO: 138426 - DNA, 537 bp, Homo sapiens
  misc_feature: GYAE6OF01D6ABO.46.67.G01.1.454.CMB.1.raw
  modified_base (396)..(396): a, c, t, g, unknown or other
  misc_feature (396)..(396): n is a, c, g, or t
  modified_base (530)..(530): a, c, t, g, unknown or other
  misc_feature (530)..(530): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacggccctaagctcctaatctatgctgcatcctagtttgacaaaggtcggggtcccatcgaggttcaggtggcagtggatctgggacagtatttcactctcaccatcagtaatctcgactaacgtgaagtnttttagctaactttattacttgtcaactagaatttactaattcgtttcggaccaagggactacgaactaactaaattaacgaacttgtgactgaccgactatcttcgttcttctacttccttacccgcctactntcgtaac

SEQ ID NO: 138427 - DNA, 660 bp, Homo sapiens
  misc_feature: GYAE6OF01DZ2C4.46.67.G01.1.454.CMB.1.raw
  modified_base (232)..(232): a, c, t, g, unknown or other
  misc_feature (232)..(232): n is a, c, g, or t
  modified_base (255)..(255): a, c, t, g, unknown or other
  misc_feature (255)..(255): n is a, c, g, or t
tcagactagcagtacacgaccggtgctcgatttagagtatacatattgggtttgggggagtctcggtcaggacacagcatggacatgagggtccccgctcagctcctggggctcctgctactctggctccgaggtgccagatgtgacatcgagctgacccagtctccatcctccctgtctgcaaccggtgggagacagtgtccaccatcacttggccgggcaagtcggaacntgacacttatttaatgtatcaanatagaccaggacggaccctaagctctaatctatgctgcatcctagtttgacgaaaggtcgggtacccagtcgaggttcagtggctaggtggatcgtagggactagtactttcacttctacaacctatactaagtaactctagactaacgtagtaagttattttacgacttaactttattacgttagtaacctaaacgtaagttaaactttaactaaacgtttcggttttaacccgggaccgtaaacggggtaacctaaccggttaaaccttaaaacttaaaacgtttaaaaccgtaacgttacgggttacggtacttaccgacccgtaacctaacgttccgttacgtttaccttacgttaaccctttccccgttaccccgtaccctaacttccgttaggttaacc

SEQ ID NO: 138428 - DNA, 692 bp, Homo sapiens
  misc_feature: GYAE6OF01BMR8W.46.67.G01.1.454.CMB.1.raw
  modified_base (339)..(339): a, c, t, g, unknown or other
  misc_feature (339)..(339): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggacgacccctgtcccctcacctgcgctgtctctggtcgcctcatcagtgtgtttctcgtggggctgggtccgcagccgtccgaggggacgggctaggaatacagttggaagtgtctctcagtggtggtacggttctattacgacgttccgtctcgtacaagngtcgtactaccacctatacgtctcgtacggactacgtacagactaatctacgtttcccagaacgtagtgtacgttctgtcgaccgtccgtctacgacgtacggttactttacgtacgtcggtacggacgtacggtacgtaccgtattacgttagttacgtttaaggtttttacggagtttacgggttttactttaccggaaccgtacccgttaaggtacggttacccgggtaccgggggtaccttacccgggtaccccgggttacggggacccggtaaagggttaacgttacccggttacgggttaccgtaccccgttaccgttacccgttacccgtcccgttaaacccccgg

SEQ ID NO: 138429 - DNA, 635 bp, Homo sapiens
  misc_feature: GYAE6OF01BGAD9.46.67.G01.1.454.CMB.1.raw
  modified_base (210)..(210): a, c, t, g, unknown or other
  misc_feature (210)..(210): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccagactggtgaggccttcggagaccctgtccctcacctgcgctgtctctggtncctcatcagtgtgtttctcgtggggctgggtccgcagctccgagggaagggctaggaatacagttggaagtgtctctcatagtggtaggttcctattacgagtccgtctctacaagtagtcgagtcacctatactctctagactacgtccagctaatctacgttttccctagaagtatgtagttactgtcgaccgcgctagacgacgggttctttagtacgtgtgcgagagtcgtacttattacgtagttagttttagggtacgtttaggtttacctttacgtaacctaccgttaagtcgttaccgggtaccgggggtaccttacccgggtacccccgggtaggggtacccggtaacggggtaacttaaccggtcggttacccgtacccggttacccgtttaccgttccgtcccgtaacccccgg

SEQ ID NO: 138430 - DNA, 635 bp, Homo sapiens
  misc_feature: GYAE6OF01C5XFP.46.67.G01.1.454.CMB.1.raw
  modified_base (324)..(324): a, c, t, g, unknown or other
  misc_feature (324)..(324): n is a, c, g, or t
  modified_base (330)..(330): a, c, t, g, unknown or other
  misc_feature (330)..(330): n is a, c, g, or t
  modified_base (355)..(355): a, c, t, g, unknown or other
  misc_feature (355)..(355): n is a, c, g, or t
  modified_base (555)..(555): a, c, t, g, unknown or other
  misc_feature (555)..(555): n is a, c, g, or t
  modified_base (570)..(570): a, c, t, g, unknown or other
  misc_feature (570)..(570): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctaaaaagtctctggtcgcctccatcagtagttggtttctcgtggggctgggtccgcagcctcccgaggggaaggggctaggaaatacgagttggaagtgtctctcagtaggtggtaggttcctattacacgtccgtctctacaagagtcgagtcaccatatctntggacncgtcagcaatctagtttcccagaanatgtagtttctggtcgaccgccgtcgtaggaacccgtcggggttacttttaatttaccgtggtacgcggaaggacggtaccgggtacttaatttagtgtttagtttttgggtaagtttggtttactttacgacctacccgtagtacgtcggaccggggtctcccggacccgtcggggaccgagggtactacgtcgtaccnccgttcctccttacnccgtccgaccgacggtccctagtcccggttccctccccgcgtcccacccctcctaccagcgtccg

SEQ ID NO: 138431 - DNA, 668 bp, Homo sapiens
  misc_feature: GYAE6OF01BBXN9.46.67.G01.1.454.CMB.1.raw
  modified_base (250)..(250): a, c, t, g, unknown or other
  misc_feature (250)..(250): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctcgtgggctgggtccggcagctccgagggaggggctggaatacattggaagtgtctctnatagtggacggttcctattacagtccgtctctcaagagtcgagtcaccatatctctggacacgtccagcaatctacgttttccagaagtatgtagttcgtgtcgaccgccgctacggacgtacgggtcgttttatacgtgtcgcgtagacggtacggtcttagttagttgttagtttttagggagtttagggtttaactttaccggacctaacccgtagtaacggtccgggtaccgggggtcctacccggtaccccgggtacggggaccggtaacgggtaacgttaccggtggttacccgtaccgttcctcccgttacgccccgtaccgaacccgtaacgggtccctacggttcccgttaccccgttcccccgtacggtacccctaccccgtacccgtacccgaaggtcccgtacccg

SEQ ID NO: 138432 - DNA, 640 bp, Homo sapiens
  misc_feature: GYAE6OF01C52DW.46.67.G01.1.454.CMB.1.raw
  modified_base (179)..(179): a, c, t, g, unknown or other
  misc_feature (179)..(179): n is a, c, g, or t
  modified_base (211)..(211): a, c, t, g, unknown or other
  misc_feature (211)..(211): n is a, c, g, or t
  modified_base (233)..(233): a, c, t, g, unknown or other
  misc_feature (233)..(233): n is a, c, g, or t
  modified_base (360)..(360): a, c, t, g, unknown or other
  misc_feature (360)..(360): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtcctggtgcaactgcaggagtcgggcccacgactggtgaggccttcgganaccctgtccctcacctgcgctgtctctggtcncctccatcagtgtgtttctcgngggctgggtccgcagccgtaccgaggggagggctggaatacgtagttaggaagtcgtctctctagtaggtggtacgtttcctattacgacgttccgtctcctagaagtagtcgtagtacacctattntctcgtacgacctacgtccagactaatcttacgttttcccagtaatagtagtacttcgtgtcgaccgtcgcgtacgacggtcggttcgtttagtcgtggtgccggtagacggtcgtattagttacgtagtttaggttttaggtaggtttcggtttacttaccgacgtaccgttaaggtcgtaccggggaccgggtaccgttcccgggacccgggttggaccggtaagggtacttacggttcggtacctaccggttcctaccgttcgacccgtaccccggg

SEQ ID NO: 138433 - DNA, 614 bp, Homo sapiens
  misc_feature: GYAE6OF01CYUKN.46.67.G01.1.454.CMB.1.raw
  modified_base (227)..(227): a, c, t, g, unknown or other
  misc_feature (227)..(227): n is a, c, g, or t
  modified_base (250)..(250): a, c, t, g, unknown or other
  misc_feature (250)..(250): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtgggagacagtgtcaccatcacttggccggcaagtcgaanttgacactatttaatgtatcaanatagaccgagggaccgccctaagctacctaatctatgctgctatcctagtttgacgtaacggtcgggtcccagtcggtaggttcaggtcggcgtaggtggtactcgtagggaacagtactttacactctaccacctatacgtagtaacttctcgactaacgtagtaagttagtttacgaacttaactttacttactagtacaatagtaattacgtaagtttcgtttaccggacgtaaacgggacctaacgtaaaccttaaacgtaaaacgttaacgtaacgttggtacggtacctacgacctacctagttaccttcgttaccttactacctttcccgttacccctactacgtcgttgttaaccg

SEQ ID NO: 138434 - DNA, 563 bp, Homo sapiens
  misc_feature: GYAE6OF01B662E.46.67.G01.1.454.CMB.1.raw
  modified_base (192)..(192): a, c, t, g, unknown or other
  misc_feature (192)..(192): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtccaccatcacttgccgggcaagtcggaacattgacacctatttaaatgtatcaacatagaccagggaccggccctaagctacctaatctatgctgcatccagtttgacaagtgggtcccagtcgaggttcaggtggcagtggatcgtgggacagtatttcactctcaccatcagtatctgacaacgtgaagtattttacgacttaacttattacgtagtactaactataacttaactaattcgttttacggaccgtaacgggtaacctaacgtaactaaactaaacttaacgtaacgtgtaggcttacgacctacctattacttcgttccttactactttcccttacccgacctactctgtaac

SEQ ID NO: 138435 - DNA, 906 bp, Homo sapiens
  misc_feature: GYAE6OF01CP9L6.46.67.G01.1.454.CMB.1.raw
  modified_base (508)..(508): a, c, t, g, unknown or other
  misc_feature (508)..(508): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttggacgaccctgtccctcacctgcgctgtctcgtggtcgcctccatcgtaggttagttcggttttcttcggtgggggtccgtcggggtccggacgacggccgtacccggagggggaaggggtctagggtaatacgtagttaggaagtcgtctctagtagtaggttgggtacggtttacctaagttacgtacggtccgttactccttagaaacgtggtacgattaccaacctattactccgtacgacggacaccgtcaacgactaaacgttcttaccgttttcccgagtaaggtattagtacgtttacgtaggtaccgtaccggtcccgtacgtacggtaacccgggttacgggtttacgttttaaacgttacgngggtcggtaacgggtaacggaacgggtacggttactttaagtttagtttagggttttaaggttttagggttaaggtttacggttttacgtttaccggtaaacccgttaccgttaacgggtaccggttaacccggggggtaccgggggttccccgtaacccgggggtcccccgggttagggggtaacccgggtaaacggggttaacgttacccgggttcgggtaaccccttacccggttaccgttacccgttaccggtacccccttaccggaaaccccgggttaacccgggtccccttaccggtttccccgggtttaccccccgttaccccccggttccgggtaaccccccttacccccgttacccggaaacccgtaaccgggtaccccgtaaccccgg

SEQ ID NO: 138436 - DNA, 658 bp, Homo sapiens
  misc_feature: GYAE6OF01AOP7I.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtgggagacagtgtcaccatcacttgccgggcaagtcggaacattgactaccttatttaaatggtatacaacatacgaccgagggaccgaccctaagcctacctaatctatcgctgaccacttccgtagttttgaccgtaaaggtcgggtaccccagttcgtacggttcaggtggactaggtggactcgtagggactagtacgtttcctacgtcgtacctaacctagtacctaagttaattccgtagaccgtaaggttacggtaagttacttttacgaacctttaacgtttacttactagttaaccaactaagtaactttacgaagtttcggtttaccgaacggtaaggtacctaacgtaacttaacgtaaagttaaccgaacgttcgtacggtacgtaccgtaccgtacctagttccgttcgttaccgttaccgtcttaccccgttccccgtactacttccgtagtaaccg

SEQ ID NO: 138437 - DNA, 717 bp, Homo sapiens
  misc_feature: GYAE6OF01CBC8V.46.67.G01.1.454.CMB.1.raw
  modified_base (291)..(291): a, c, t, g, unknown or other
  misc_feature (291)..(291): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtcgcctcatcagtagtggtttcttcgtgggctgggtccgcagctcccgaggggaagggctaggaatacagttggaagtgtctctcatagtggtaggttcctattacagtccgtctctcaagngtcgagtcactatatctcgtcgacacgtccagcaatctacgtttccagaacgatgtagttctgtacgaccgtccgtcgtacgaccgtacgggttacgtttacttaccgtggtacggacggaggtacggtacgtacttaagttagttagttagtttttagggagttaggtttagtttaccgtaccgtaacccgtaggtacgtacgggaccggggtcctacccgggaccccgggttaggggacccggtaacggggtaacgtaccggttacgggtacccgtaccggttaccgtaccccgtttaccgtccccgtaaccccgaacccggtaaccggtaccccgtaccggttacccgggttcccccttcccccggttaccggtaccccttaccccccttacccgtaaccccgaacgtcccggtaacccccgg

SEQ ID NO: 138438 - DNA, 658 bp, Homo sapiens
  misc_feature: GYAE6OF01C6L4W.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtccgggcccacgactggtgaggccttcggagaccctgtccctcacctgcgctgtctcgtggtcgcctccatctagttagttggtttctcgtggggctgggtccgcagccgtaccgagggagggctggaatacgattggaagtgtctctcataggtggacggttcctattacagttccgtctctcaagagtcgagtcaccatatctctgacacgtcagcaactctacgttttcccagaagtattgtacgtttcgtggtacgacccgccgcgtagaaccgtacgggttacttttacgttacgtgtcggtaccgagacggtacgtcttaatttagttgttagtttttgggagttttagggtttactttaccgtaaccttacccgttaggtacgttaccgggaccgggggtccgtaccccggtaccccgggtacggggaccggtaacggggtaacttaccggttcgggtacccttacccggttccttaccccgttcgtccccgtaaccccgg

SEQ ID NO: 138439 - DNA, 660 bp, Homo sapiens
  misc_feature: GYAE6OF01EF52C.46.67.G01.1.454.CMB.1.raw
  modified_base (350)..(350): a, c, t, g, unknown or other
  misc_feature (350)..(350): n is a, c, g, or t
tcagactagcagtacacgaccggtgctcgatttagagtatacatattgggtttgtcctcctgctggtggcagctcccagatgggtcctgtccctggtgcaactgcaggagtccgggcccacgactggtgagggccttcggagaccctgtccctcacctgcgctgtctctggtgcctcatcagtagtgtttctcgtgggctgggtccgcagctcccgaggggaagggctaggaatacgagttggaagtgtctctcagtaggtggtacggttcctattacagttccgtctctacaagacgtcgagtcaccatactctcgtggacacgtccagcaatctacgttttccagaanatgtattctgtcgaccgcgctcgacgtacgggtcttttacttacgtgtcgacgagaggtaccggtacttagtttagttgtttaagtttttgggaggtttaggtttacttttaccggaaccttacccgttaaggtacgttaccgggtaaccgggggtccttacccggaaccccggttcggggtacccgaaggggttaaccttacggttcgggttacctacccgttccttaccgtacgtccctaccgaccgtaacggccctacgttcccgttcccttcccccgtcgccctaccctcccaccaacgcgacccg

SEQ ID NO: 138440 - DNA, 555 bp, Homo sapiens
  misc_feature: GYAE6OF01BFXGH.46.67.G01.1.454.CMB.1.raw
  modified_base (192)..(192): a, c, t, g, unknown or other
  misc_feature (192)..(192): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccgggcaagtcgaacatgactactattaaatggtatcaacatagacaggacgccctaagctcctaatctatgctgcatccagtttgacaaaggtcgggtacccagtcgagttcagtggcagtgatcgtgggacagtattcacgtctacacctatacagtaatctagactaacgtagaagtatttcgacttaactttattacgtgtacaacgtataacttactaagtttcgtttacggaccgaaagggtactaacgtaactaacgtaaaacttaacgaacgttgtagtactagtaccacctattacgtcgttaccttctacttccttacccactatcgtgtaacg

SEQ ID NO: 138441 - DNA, 690 bp, Homo sapiens
  misc_feature: GYAE6OF01EDR8P.46.67.G01.1.454.CMB.1.raw
  modified_base (388)..(388): a, c, t, g, unknown or other
  misc_feature (388)..(388): n is a, c, g, or t
  modified_base (398)..(398): a, c, t, g, unknown or other
  misc_feature (398)..(398): n is a, c, g, or t
tcagactagcagtacacgaccggtgctcgatttagagtatacatattgggtttggggagtctcggtcaggacacagcatggacatgagggtccccgctcagctccgtggggctcctgctactctggctccgaggtgccagatgtgacatcgagctgacccagtctccatcctccctgtctgacaaccggtgggagacagtcgtcaacctatcacgttggccggggtacaaggtcggaactagttcgaacctactttaatttaaacgttggtataccaaacattaacggaccgaggggaccggtaccctaagccttacctaatctatgctgcatcctagtttgacaaggtcgggtccctagtcggtagttcagtcggacaggtgatcgngggactagtntttcactctacacgatacaagtaactctacgacgtaacggtacgtaaagttacgttttacgtaaccttaaacttttaactttaacgttacgtaacctaaacgtaagttaaactttaacgttaacgtttcggttttaccggaaccggtaaacggtaacctaaaccgtaaacttaaacgttaaaagttaaaccggtaacgttacgggtacgtaaccgtacgtaacccgtaacgtacgttccttacggttacctttacgactttcccgttaccctacgtacttacgcgttaaccg

SEQ ID NO: 138442 - DNA, 606 bp, Homo sapiens
  misc_feature: GYAE6OF01ELCFI.46.67.G01.1.454.CMB.1.raw
  modified_base (210)..(210): a, c, t, g, unknown or other
  misc_feature (210)..(210): n is a, c, g, or t
  modified_base (534)..(534): a, c, t, g, unknown or other
  misc_feature (534)..(534): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggncctccatcagtagtggtttcttcgtggggctggggtccgcagcctcccgagggaagggctggaatacagttggaagtgtctctcagtacggtggacggtttcctaagtttaccagttcccgtctctacaagagtcgagtcaccatactctcgtggacctacgtccagacaatctacgttttccctgaaacgtattaggtagtttctggttacgaccgtccgcgttacggacctacggggttacttttattacgttcggtgcgtagacggtacggtacttattagtcgtttaagttttggagttaggtttattcgactaccgtancgttcggaccggggtcttccggccccggtgggaccagggactgtcggtccaccgtcttcctcgccctacccg

SEQ ID NO: 138443 - DNA, 635 bp, Homo sapiens
  misc_feature: GYAE6OF01AS0X6.46.67.G01.1.454.CMB.1.raw
  modified_base (209)..(209): a, c, t, g, unknown or other
  misc_feature (209)..(209): n is a, c, g, or t
  modified_base (286)..(286): a, c, t, g, unknown or other
  misc_feature (286)..(286): n is a, c, g, or t
  modified_base (405)..(405): a, c, t, g, unknown or other
  misc_feature (405)..(405): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctcgtggggctgggtccgnagctccgagggagggctggaatacattggaagtgtctctcagtagtggacgttcctattacagtccgtctctcaagngtcgagtcaccatactctcgtggacacgtccagcaatctacgttttccagaacgtatgtagttctgtcgaccgccgtctcgacgtacgggtctttatacgtgtcgacgagacgtacgtntagttagttgttagttttggagtttgtttacgttccgtaactacccgttagacgtcgggaccgggtccgtccggtaccccgtggggacccgtaagggtaacgttaccgttcggtaccgtacccgttccgtaccgtacgtccctaccgacccggtaccggtccctacggtcccggttcccgttacccccgtcggtacccctcccgtaccctacccgaacgtccgtaccccg

SEQ ID NO: 138444 - DNA, 633 bp, Homo sapiens
  misc_feature: GYAE6OF01DPULB.46.67.G01.1.454.CMB.1.raw
  modified_base (195)..(195): a, c, t, g, unknown or other
  misc_feature (195)..(195): n is a, c, g, or t
  modified_base (260)..(260): a, c, t, g, unknown or other
  misc_feature (260)..(260): n is a, c, g, or t
  modified_base (349)..(349): a, c, t, g, unknown or other
  misc_feature (349)..(349): n is a, c, g, or t
tcagactagcagtacacgaccggtgctcgatttagagtatacatattgggtttgggggagtctcggtcaggacacagcatggacatgagggtccccgctcagctcctggggctcctgctactctggctccggaggtgccagatgtgacatcgagctgacccagtctccatcctccctgtctgcaaccggtggganacagtgtcaccatcacttggccgggacaagtcggaacattgactacctatttaaatggtatcaanatagaccgagggaccggaccctaagcctactaatctatgctgctatcctagtttgacgtaaggtcgggtacccagtcgagttcagtggntagtgatcgtagggactagtacttcacttctacactatactaagtactcgtgacgtaacgtaggtaatattttagacttaactttattacgtataacaactaagttaactttaacgttaatttacggttttaccggaaccgtaaacgggaactaaccggtaaacttaaacttaaaacgttaaccgaaagttacggtaggtaccttacgaccctaaccgtattaccttacggttacctttacgtacctttccccttacccgaccttaacttccgtaagttaaccg

SEQ ID NO: 138445 - DNA, 593 bp, Homo sapiens
  misc_feature: GYAE6OF01E3E3D.46.67.G01.1.454.CMB.1.raw
  modified_base (363)..(363): a, c, t, g, unknown or other
  misc_feature (363)..(363): n is a, c, g, or t
  modified_base (472)..(472): a, c, t, g, unknown or other
  misc_feature (472)..(472): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagttggtttcttcgtggggctcggggtccgcagctcccgaggggaacgggctggaatacagttggaagttgtctctcagttaggtggtaggtttacctaattacgagtccgtctctacaagagtcgagtccaccatactctcgtggaccacgtccagcaactctacgttttccagaacgtntgtagttctgcgaccgcgctacgacgtacgggtctttatacgtggtcgcgaggacggacgtcttagttagtgttagttttggagtttgttagtttccgactaccgtagngtccggacgggtctccggacccggtggggccgagggtatacggtgctaccgtctctacgccgtaccacgtcggaccacgtccgtccctcccgcgtccctaccctcccgactagcgtacccg

SEQ ID NO: 138446 - DNA, 524 bp, Homo sapiens
  misc_feature: GYAE6OF01CRZ6I.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaaccgtgggagacagtgtcaccatcacttgccgggcaagtcggaacattgacacctatttaaatggtatcaacatagaccaggtacgccctaagctctatctatgctgcatccagtttgcaaggtgggtcccagtcgaggttcagtggcagtggatcgtgggacagatttcactctcaccatcagtatctgcaacgtgaagtattttgactaacttattactagtacaataagtaattactaatgttttcggacctaagggacacgtaactaactaaattaacgaactgtagactcgactacctattctcgtcttctaacttccttacccgcctactctgtaac

SEQ ID NO: 138447 - DNA, 639 bp, Homo sapiens
  misc_feature: GYAE6OF01AICCY.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatccctccctgtctgcaaccgtgggagacagtgtcaccatcacttggccggcaagtcggaacattgactactaattttaaatggtatacaacaatacgaccgagggaccggccctaagcctacctaatctatgctgctactcctagtttcgactaaaggtcgggtaccctagtacggtaggttcgaggtggactaggtggatcgtagggaactagtatttcactctacacctatacgagttaactcgtagacgtaacgtagtaagttatttacgaaccttaactttacttaacgttacgtacctaaagtaacgtaaactttaacttaacgtttcgggtttaaccgaaccgtaacgggaacctaaaccgtaaactaaactaaaacgttaaaccgacgttagtgtactacgtaccgtaactattcgttacgttaccttctaaccgttcccgttacccactaacttcgtagtaacc

SEQ ID NO: 138448 - DNA, 651 bp, Homo sapiens
  misc_feature: GYAE6OF01BSXA2.46.67.G01.1.454.CMB.1.raw
  modified_base (231)..(231): a, c, t, g, unknown or other
  misc_feature (231)..(231): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtgggagacagtgtcaccatcacttgccgggacaagtcggaactnttcgactaccttatttaaattggtatacaacatacgaccgagggaccgaccctaagctacctaatctatgctgctatcctagtttcgacgtaaaggtcgggtccagtcggtagttcgaggtggacgaggtggatcggtaggacgtaagtacttacacgtctaccgacctattacaagttaactcgtacgactaacggtagtaacgttatttacgaacttaaactttattaactacgtaacctaaataacgttaaatttactaagtttcggtttaccggaaccgtaaacgggtaacctaaccgttaacttaaactaaacgttaaacgtaacgtaggtacgacttacgaccgtaaccgtattaccgttcgttacctttaccgaactttcccgttacccgaccttaattccgttagttaaccg

SEQ ID NO: 138449 - DNA, 668 bp, Homo sapiens
  misc_feature: GYAE6OF01D9CC6.46.67.G01.1.454.CMB.1.raw
  modified_base (191)..(191): a, c, t, g, unknown or other
  misc_feature (191)..(191): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtcgccagatgtgacatcgagctgacccagtctccatcctcctgtctgcaccgtggganacagtcgtcacatcacttcggccggacaacgtcggaacattgacctaccttatttaaagttggtatacaatatacgaccgagggaccgccctaagcctactaatctatcgctgctactcgtagtttcgacgtaacggtcgggaccctagtcggtaggttcaggtcgcgtaggtggtactcggtaggactagtactttcactctcaactatacgtagtaactcgtacgacgtaacgtgtaaagttactttacgacttaactttattacgttacgtaaacctaacgtataaacgtttaacttaacgtttcggtttaaccggaaccgtaaacgggtaccgtaacgttaaaccttaaaacgttaaacgttaaaccgacgttacgggacggttactaaccggaccttaacccgttattacggttcttaacccgttcgtaaaccctttcccggtaccccgtacttacgttaccgtaggtaacc

SEQ ID NO: 138450 - DNA, 616 bp, Homo sapiens
  misc_feature: GYAE6OF01CAA4S.46.67.G01.1.454.CMB.1.raw
  modified_base (283)..(283): a, c, t, g, unknown or other
  misc_feature (283)..(283): n is a, c, g, or t
  modified_base (287)..(287): a, c, t, g, unknown or other
  misc_feature (287)..(287): n is a, c, g, or t
  modified_base (306)..(306): a, c, t, g, unknown or other
  misc_feature (306)..(306): n is a, c, g, or t
  modified_base (339)..(339): a, c, t, g, unknown or other
  misc_feature (339)..(339): n is a, c, g, or t
  modified_base (539)..(539): a, c, t, g, unknown or other
  misc_feature (539)..(539): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctcgtgggctgggtccgcagctcccgagggaggggctaggaatacattggaagtgtctctcatagtggaggttcctattacagtccgtctctnaagngtcgagtcaccatatctcnggacacgtcagcaatctacgttttcccagaagntgtacgttctggtcgaccgccgtcgtcgacgtacgggtactttagttacgttggtcgacggtagacggtacggtcttaagttagttagttagttttggaagttggtttacttacgacctacccgtagacgtaccgggacggggcctccggacccggttcgggaccgagggtactacgtcggtaccaccgtccttacgtcncccgtacccacgaccggtcccagttcccgtcccttccccgtcgtaccctacccctacctacccaacgacgtaccccg

SEQ ID NO: 138451 - DNA, 532 bp, Homo sapiens
  misc_feature: GYAE6OF01BA6DM.46.67.G01.1.454.CMB.1.raw
  modified_base (192)..(192): a, c, t, g, unknown or other
  misc_feature (192)..(192): n is a, c, g, or t
  modified_base (217)..(217): a, c, t, g, unknown or other
  misc_feature (217)..(217): n is a, c, g, or t
  modified_base (228)..(228): a, c, t, g, unknown or other
  misc_feature (228)..(228): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccgggnaagtcggaacnttgacacttattaaatgtatcaacatagaccagggaccgccctaagctcctaatctatgctgcatccagtttgacaaaggtcgggtcccatcgaggttcagtggcagtggatcgtgggacagtatttcactctcaccatcagtaatctgacaacgtagaatatttcgactaacttattactgtacaactagtaattactaattgtttaccggaccgtaagggacctaacgaactaactaaacttaacgaactgtagactagacctactatctgtcttactacttcctacccgcctatctagtac

SEQ ID NO: 138452 - DNA, 661 bp, Homo sapiens
  misc_feature: GYAE6OF01ET1NV.46.67.G01.1.454.CMB.1.raw
  modified_base (193)..(193): a, c, t, g, unknown or other
  misc_feature (193)..(193): n is a, c, g, or t
  modified_base (218)..(218): a, c, t, g, unknown or other
  misc_feature (218)..(218): n is a, c, g, or t
  modified_base (251)..(251): a, c, t, g, unknown or other
  misc_feature (251)..(251): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtggganacagtgtcaccatcacttgccgggnaagtcgaacatgacacttattaaatgtatcaanatagaccagggacgccctaagctacctaatctatgctgcactccgtagtttgacgtaaaggtcgggtcccagtcgagttcagtggcagtggatcgtagggacagtacttcacttcgaccactatctaagttaatcgtacgactaacgtagtaagttatttacgaccttaatttacttaacgtcgtaacaaactagttaaactttaacgtaagtttacggttttaccggaacccgtaaagggtaacctaacggtaaaccttaaacgttaaaaacgttaaaccggtaacttgggtaacggtaccgttaacggtaccctaaaccgttactttaccgttgtttaccccgtttaactacccgttttacccccgttaccccgtaaccctttacgtttaccgtaacgtttaaacccg

SEQ ID NO: 138453 - DNA, 569 bp, Homo sapiens
  misc_feature: GYAE6OF01B8VGB.46.67.G01.1.454.CMB.1.raw
  modified_base (211)..(211): a, c, t, g, unknown or other
  misc_feature (211)..(211): n is a, c, g, or t
  modified_base (250)..(250): a, c, t, g, unknown or other
  misc_feature (250)..(250): n is a, c, g, or t
  modified_base (372)..(372): a, c, t, g, unknown or other
  misc_feature (372)..(372): n is a, c, g, or t
  modified_base (376)..(376): a, c, t, g, unknown or other
  misc_feature (376)..(376): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtncctccatcagtagtggtttctcgtggggctgggtccggnagctccgagggaagggctggaatacattggaagtgtctctcatagtggaggttctattacagtccgtctctcaagagtcgagtcaccatatctctgacacgtcagcaatctagttttcctanaagntagacttctgtcgaccgcgtctagacgacgggtcgtttattactgtcgcgagagacgactattatgtagttttgagttgtttattacgaccaccgtagtacgtcggacggggtcctccggaccccgtggggacccaggggtaacttaccgttcggtccgtaccgttccgttacccttagtcccgtaaccccgg

SEQ ID NO: 138454 - DNA, 542 bp, Homo sapiens
  misc_feature: GYAE6OF01APAJT.46.67.G01.1.454.CMB.1.raw
  modified_base (377)..(377): a, c, t, g, unknown or other
  misc_feature (377)..(377): n is a, c, g, or t
  modified_base (434)..(434): a, c, t, g, unknown or other
  misc_feature (434)..(434): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctcgtggggctgggtccggcagctcccgagggaaggggctgggaatacattggaagtgtctctcatagtggaggtttcctattacagtccgtctctcaagagtcgagtcaccatatctctggacacgtccagcaatcagttttcccngaagatgagttctgtgaccgcgctgacgcgggtcgtttatactgtgcgagagacggntattatgtattttggagttggttatttcgactaccgtagtagtcggacggggctccggacccgttggggccagggatacgtggtccaccgtctccttagccctacccg

SEQ ID NO: 138455 - DNA, 672 bp, Homo sapiens
  misc_feature: GYAE6OF01CH6I9.46.67.G01.1.454.CMB.1.raw
  modified_base (213)..(213): a, c, t, g, unknown or other
  misc_feature (213)..(213): n is a, c, g, or t
  modified_base (238)..(238): a, c, t, g, unknown or other
  misc_feature (238)..(238): n is a, c, g, or t
  modified_base (251)..(251): a, c, t, g, unknown or other
  misc_feature (251)..(251): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctcgtggtcncctccatcagtagtggtttcttcgngggctgggtccgnagcctccgagggagggctaggaatacagttggaagtgtctctcagtagtggagttctattacagtccgtctctcaagtacgtcgagtcaccattactctcgtagactacgtccagacaatcgtacgtttccctagaagagtagtacgttcgtgtcgaccgccgtctacggacgtacgggttcgttttaacttacgtggtcgacggtagagggtaccggtacttaagttacgttggtttaagtttttgggtaaggtttcggttttaacgtttaccggtaaccctacccggttaacgtacggttccggggaccgggggtccctacccgggtaccccgggtacgggggacccgtaagggtaaccgtaccggttacggtcccgtacccggttaccttcccgttacccggtcccgtaaacccccgg

SEQ ID NO: 138456 - DNA, 627 bp, Homo sapiens
  misc_feature: GYAE6OF01EMFYA.46.67.G01.1.454.CMB.1.raw
  modified_base (260)..(260): a, c, t, g, unknown or other
  misc_feature (260)..(260): n is a, c, g, or t
tcagactagcagtacacgaccggtgctcgatttagagtatacatattgggtttgggggagtctcggtcaggacacagcatggacatggagggtccccgctcagctcctgggggctcctgctactctggctccgaggtgccagatgtgacatcgagctgacccagtctccatcctccctgtctgcaaccggtgggagacagtgtcaccatcacttggccgggacaagtcggaacattgacacttattaaattggtatcaanatagaccgaggggacgccctaagctcctaatctatgctgcatcctagtttgaccgtaaaggtcggggtccccagtcggaaggtttcaggtggcgagtgggatcgtgggactagtatttcactctacaccatcaagttaatctagactaaggtagaagttacgttttagacttaaactttattaacctagtacctaaacggtaataaactttactaacgtttcggttttaccgggaaccgtaaagggaacctaaccgaacttaaaactaaaacgtttaaaccgaagttggtacggtcgtacgaccctaacctagtttacttcgttacctttacaacgtttccctaccccgaccttagttcctagtaac

SEQ ID NO: 138457 - DNA, 619 bp, Homo sapiens
  misc_feature: GYAE6OF01D4VPR.46.67.G01.1.454.CMB.1.raw
  modified_base (174)..(174): a, c, t, g, unknown or other
  misc_feature (174)..(174): n is a, c, g, or t
  modified_base (346)..(346): a, c, t, g, unknown or other
  misc_feature (346)..(346): n is a, c, g, or t
tcagactagcagtacacgaccggtgctcgatttagagtatacatattgggtttgtcctcctgctggtggcagctcccagatgggtcctgtccctggtgcaactgcaggagtccgggcccacgactgggtgaggccttcggagacccctgtccctcacctgcgctgtctctggtncctccatcagtagtggtttcttcgtggggctgggtccggcagcctcccgaggggaaggggctaggaatacagttggaagtgtctctcagtagtggaggttcctattacagtccgtctctacaagagtcgagtcaccatatctctggacacgtccagcaatctagttttcccngaagatgagttctgtcgaccgccgctggacctacggggtcgtttaattacgtgtgtcgagagacggtactatttatgttagttttggtagttggtttatttcgtactaccctagacgtcgggacgggggcctccggacccgtggggaccgaagggtacttacgtaggtcctaccgtccttacccttacgccctacccaacccgaacgggtcccctacgttcccggttcccttcccccgtcggccctaccccctccctacccaacgcgtacccg

SEQ ID NO: 138458 - DNA, 545 bp, Homo sapiens
  misc_feature: GYAE6OF01BTN5W.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacactattaaatgtatcaacatagaccagggacgccctaagctcctaatctatgctgcatccagtttgacaaagtcggggtcccatcgaggttcagtggcagtggatcgtgggacaggtatttcactctcaccatcagtaatctgacaacgtgaagtatttgactaactttattactgtacaactagtaatttactaatttgtttaccggaccgtaagggaccaacgtaacttaacaaagttaaacgaacgtgtaggactagacctacctattctcgttaccttacacttccttacccgactacttcgtgtaac

SEQ ID NO: 138459 - DNA, 543 bp, Homo sapiens
  misc_feature: GYAE6OF01A1BFT.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggaccggccctaagctcctaatctatgctgcatccagtttgcaagtcgggtcccagtcgaggttcagtggcagtggatcgtgggactagtatttaccgactctacacctatcctaagtaatctacgcaacgtgtaagtattttgactaactttattactgtacaacagtaacttacaattgtttcgacgaaggactacgaacttaacaaattaacgaacttgtgtactagacctacctattctgttccttactacttccttacccgacctattctgtac

SEQ ID NO: 138460 - DNA, 647 bp, Homo sapiens
  misc_feature: GYAE6OF01EI09J.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcagtcggaacattgacacctattaaattggtatcaacatagaccagggacggccctaagctcctaatctatgctgcatcctagtttgactaaaaggtcggggtccccattacggccggtttacaggtggctaggtaggtactcgtaggggacaagtatttacgaactctaccaaccattcaagttaactctagacaacgtagaagtattttgctaaactttattactgtacaaactagtaaattaactaagttcgttttaccggaccgaaaggggtacctaaacccggtaaactaaacgtaaaacgttaaaaccgtaacgttggttaccgggctaggtaacccgtaacctattaccgttcggtttacctttaaccctacccgttacccccttttacccggaaccccttaacgtttcccgtaggttaaaccc

SEQ ID NO: 138461 - DNA, 717 bp, Homo sapiens
  misc_feature: GYAE6OF01C2PQN.46.67.G01.1.454.CMB.1.raw
tcagactagcagtacacgaccggtgctcgatttagagtatacatagttgggtttggggagtcgtcggtcaggacacagcatggacatgagggtccccgctcagctcctggggctcctgctactctggctcgaggtgccagatgtgacatcgagctgacccagtctccatcctcctgtctgcgaaccggtgggagacagttcgtccaccagtcgtacgtttggtccgggtactaacggtcggaactagttcgacctaccgttaagtttaaagttggtactacaaacgtagttaggaaccgaggggtacccgtacccttaagccttacctaatcctatcgaccgtgacgtagtccgtagtttgactaaggtcgggtaccagtcggtagttacgaggtcgctagtcggatcgacgggatgtactttaccgacgttcctaccgacctataccgaagttaactcgtacgtaaccgtaaggtacgtaaacgttcgtttacgacctttaacgtttacgttacgttacgtaactaacgtaagttaaacttaccgttaaggtttcggtttaccggaaaccgggtacggtaacccgtacgtaaccttaaacttaaacgtaaccgtacggttacggtacgacgtccgtaccgtaccgtacttcgttacggttcccttaaccggttaccttaccccgttacccgacctttacgtccgttcggtaacccg

SEQ ID NO: 138462 - DNA, 768 bp, Homo sapiens
  misc_feature: GYAE6OF01BKM71.46.67.G01.1.454.CMB.1.raw
  modified_base (213)..(213): a, c, t, g, unknown or other
  misc_feature (213)..(213): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctcgtggtcncctccatcagtgttggtttcttcgtggggctgggtccggcacgcgtccgagggaagggctggaatacagttggaagtgtactctcataggtggtagttcctattacacgtccgtctctacaagtgtcgagtccacatactctctggaccacgtccacgtctaactcgtacgttttcccagtaaacgtagttcgtaagtttccgtagttcggacccggtcccgtcgttacggtaaccggtacggggttaccgttttaagttaccgtgggttaggtacccggtaagggaccggttaaccggtcgtttaacgttttaaggttcggttttaagggttttttagggaacgggttttagggttttaaccttttacccgggaacccgtttaaccccggtttaaggacggttttacccggggggacccggggttaccgtacccccggggtacccccgggtttacgggggacccgtaaacgggggtaaactttacccgggtacggttacccgtaccccggttacccttttaccccggttaacccggaccccctttaaccccggg

SEQ ID NO: 138463 - DNA, 590 bp, Homo sapiens
  misc_feature: GYAE6OF01A7WK8.46.67.G01.1.454.CMB.1.raw
  modified_base (337)..(337): a, c, t, g, unknown or other
  misc_feature (337)..(337): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctcgtggggctgggtccggcagctcccgaggggaaggggctggaatcattggaagtgtctctcatagtggaggttcctattacagtccgtctctcaagagtcgagtcaccatatctctggacacgtccagcaatctacgttttcccngaagatgagttctgtcgaccgccgctgaccgtacgggtcgtttattacgtgtgcgagagacggtctattatgttattttggagtttggtttactttcgacctacccgtagtactcggacggggtcctccgacccggtgggaccgagggtaactacgtggtcctaccgtcctccgtagccctacccaccgtaacggcccaggttcccggttcccttcccccgtcggtccctacccttcccaccagccgtacccg

SEQ ID NO: 138464 - DNA, 566 bp, Homo sapiens
  misc_feature: GYAE6OF01AX7IM.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacgccctaagctcctaatctatgctgcatccagtttgacaaagtgggtcccagtcgaggttcagtggcagtggatcgtgggacaggtatttcgactctcaacctatctaagtaatctagacaacgtgaaagtattttgactaactttattactgtaccaatagtaattaacaattggtttaccgaccgtaagggacctaacgtaactaaactaaacgttaaaccgaactaggtcgacgttacgaccgtacctattccgttgtccttctacttcccttccccgacctacttcctagtaccg

SEQ ID NO: 138465 - DNA, 550 bp, Homo sapiens
  misc_feature: GYAE6OF01A2DDR.46.67.G01.1.454.CMB.1.raw
  modified_base (362)..(362): a, c, t, g, unknown or other
  misc_feature (362)..(362): n is a, c, g, or t
  modified_base (482)..(482): a, c, t, g, unknown or other
  misc_feature (482)..(482): n is a, c, g, or t
  modified_base (527)..(527): a, c, t, g, unknown or other
  misc_feature (527)..(527): n is a, c, g, or t
  modified_base (540)..(540): a, c, t, g, unknown or other
  misc_feature (540)..(540): n is a, c, g, or t
  modified_base (546)..(546): a, c, t, g, unknown or other
  misc_feature (546)..(546): n is a, c, g, or t
tcagactagcagtacacgaccggtgctcgatttagagtatacatattgggtttgtcctcctgctggtggcagctcccagatgggtccctgtccctggtgcaactgcaggagtcgggcccacgactggtgaggccttcggagaccctgtccctcacctgcgctgtctctggtgcctccatcagtagtggtttctctggggctgggtccggcagctcccgagggaggggctggaatacattggaagtgtctctcatagtggaggttcctattacagtccgtctctcaagagtcgagtcaccatatctctggacacgtccagcaatcagttttcctgaagatgagttctgtgaccgccgctgacncgggtcttttatactgtgcgagacgacggtctattatgttagttttggagttggttatttcgactacccgtagagtcggacggggctacggacccgtgggccgagggtactacgtcgtcnccgtctcctagccctccaccgacggcccagtccgtccttccccgngtcccaccctccnccaagngccg

SEQ ID NO: 138466 - DNA, 564 bp, Homo sapiens
  misc_feature: GYAE6OF01D7XMW.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacatgacacctattaaatgtatcaacatagaccaggacgccctaagctacctaatctatgctgcatccagtttgacaaagtcgggtccagtcgaggttcagtggcagtgatcgtggacagtattcactctcacatacagtaatctgacaacgtagtaagtatttagactaactttattactagtacaataagtaatttaactaattgtttacggacgtaaggactaacgtaactaactaaagttaaacgaacgtagtagtactacgtacctacgtaattcgttacgttacctttaccgtaaccttcccgttaccccgacctttactccgttggtaaacc

SEQ ID NO: 138467 - DNA, 587 bp, Homo sapiens
  misc_feature: GYAE6OF01EMVE6.46.67.G01.1.454.CMB.1.raw
  modified_base (331)..(331): a, c, t, g, unknown or other
  misc_feature (331)..(331): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtcccctcacctgcgctgtctctggtcgcctccatcagtagtggtttctcgtggggctgggtccggcagcctccgagggaaggggctggaatacattggaagtgtctctcatagtggaggttcctattacagtccgtctctcaagngtcgagtcaccatatctctggacacgtccagcaatctagtttcccagaagtatgtagttctgtcgaccgccgctcgacgacgggtctttatacgttgtcgcgagaggacgtctagttagtgttagttttggagttagtttacttacgactaccgtagacgtcgggacggggtcctccggaccccggttggggacccgtaggggtaacttacgtcggttacccgacccggttacctcccttccggccctaaccccgg

SEQ ID NO: 138468 - DNA, 518 bp, Homo sapiens
  misc_feature: GYAE6OF01EB2HB.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacgccctaagctcctaatctatgctgcatccagtttgacaaagtgggtcccagtcgaggttcagtgcagtggatcgtgggacagtattcactctcacatcagtatctagacaacgtgtaagtatttgactaacttattactgtacaactataattactaattgtttacgacgtaaggactaacgaactaacaaattaacgaactgtagtctagctaccattctgtcttacacttccttcccactactctgtac

SEQ ID NO: 138469 - DNA, 612 bp, Homo sapiens
  misc_feature: GYAE6OF01AZ5NA.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggcagctcccgaggggaaggggctggaatacattggaagtgtctctcatagtggaggttcctattacagtccgtctctcaagagtcgagtcaccatatctctggacacgtccagcaatctagttttcccagaagatgagttctgtcgaccgccgctcgacgacgggtcttttaatcgtgtgcgagagacggtctattatgtattttggagttgttattcgactacctagtacgtacggcggggtcctccggaccccgtgggggcccgaaggggtacttacggtcggtaccgtacccgttcctacccgttacgcccctacccgaacccgtaaccgggtccctaacggtcccggttcccttcccccgtcggtcccctaccccgttccctacccgaagccgtacccg

SEQ ID NO: 138470 - DNA, 605 bp, Homo sapiens
  misc_feature: GYAE6OF01C51Q2.46.67.G01.1.454.CMB.1.raw
  modified_base (190)..(190): a, c, t, g, unknown or other
  misc_feature (190)..(190): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtcctccatcctcctgtctgcaccgtgganacagtgtcaccatcacttcggccgggacaaggtcggaacattgactacctatttaatggtatcaacatagaccgaggaccgccctaagcctctaatctatgctgctatccgtagtttgacgtaaggtcgggtacccagtcgtaggttcagtggctaggtggatcgtgggactagtactttcgctctccactatacagttactctagacgtaagtgtaagttatttacgaacttacttattactacgtactaaactagtaacttacgtaagtttacggtttccgaaccgtaaggactaaccgtactaaacgtaaacgttaaccgtaacgtggtacgacgtacgacctacctattaccgttcgttaccgttacctaccgtttcccttacccctacccttacgttccgttcggtaacc

SEQ ID NO: 138471 - DNA, 583 bp, Homo sapiens
  misc_feature: GYAE6OF01AJ3H7.46.67.G01.1.454.CMB.1.raw
  modified_base (288)..(288): a, c, t, g, unknown or other
  misc_feature (288)..(288): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctctggggctgggtccggcagctcccgagggaaggggctggaatacattggaagtgtctctcatagtggaggttcctattacagtccgtctctcaagngtcgagtcaccatatctctggacacgtccagcaatctacgttttccctgaagtatgtagttctgtcgacccgccgctgacgacgggtcttttaatctgtgcgagagacgctattatgtattttggagttggttatttcgactacccgtagagtcggacggggtctccgacccgtggggccgagggtaactcgtcggtccacgtcctccttacgccctacccaccgaacgggccctacgttcccggttcccttcccccgtcggtccctacccctaccctacccaacggcgtacccg

SEQ ID NO: 138472 - DNA, 648 bp, Homo sapiens
  misc_feature: GYAE6OF01B9BZM.46.67.G01.1.454.CMB.1.raw
  modified_base (293)..(293): a, c, t, g, unknown or other
  misc_feature (293)..(293): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggcccttcggagaccctgtccctcacctgcgctgtctctggtgcctcatcagtagtggtttctcgtggggctgggtccgcagcctcccgaggggaagggctaggaatacgagttggaagtgtctctcagtagtggaggttcctattacagtccgtctctcaagngtcgagtcaccatatctctggacacgtcagcaatctagtttccctagaagatgtagttctggtcgtaccgccgcgtcgaacgacgggtcgttttaattactggtacgcgaaggacgtacggtcttaagtttatgttagttttggtagtttaggtttactttcggaccttacccgtagtacgtaccggaacggggtcctaccggaccccggtacgggacccggaagggtactacgttacggtaccgtaccgtcttacccgttacgccctacccgaccgtaaccggtaccctacgttacccgttcccgttcccccgtacggtcccctaccctccccgtaaccgtacgacggtacccg

SEQ ID NO: 138473 - DNA, 525 bp, Homo sapiens
  misc_feature: GYAE6OF01EMPHV.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgactaccttatttaaattggtatcaacatagaccagggacggccctaagctcctaatctatgctgcatcctagtttgctaaaggtcgggtcccagtcgtaggttcaggtggcagtggatcgtgggactagtatttcactctcacatcagtatctgacaacgtgaatatttgactaactttattactgtacaactataattactaattcgtttcgacaaggacacgtaactaactaaattaacgatgtgactgacactatctcgtaccttcacttccttacccgacctatctgtac

SEQ ID NO: 138474 - DNA, 662 bp, Homo sapiens
  misc_feature: GYAE6OF01C76UT.46.67.G01.1.454.CMB.1.raw
  modified_base (182)..(182): a, c, t, g, unknown or other
  misc_feature (182)..(182): n is a, c, g, or t
  modified_base (213)..(213): a, c, t, g, unknown or other
  misc_feature (213)..(213): n is a, c, g, or t
  modified_base (251)..(251): a, c, t, g, unknown or other
  misc_feature (251)..(251): n is a, c, g, or t
  modified_base (292)..(292): a, c, t, g, unknown or other
  misc_feature (292)..(292): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggcctttcggganaccctgtccctcacctgcgctgtctctggtncctcatcagtagtggtttctcgtggggctgggtccggnagctccgagggagggctggaatacagttggaagtgtctctnatagtggacgttctattacagtccgtctctacaagatcgagtacaccatatctctggacacgtcaagcaatctacgttttcccgagaagtatagtagttctggtagaccgcgacgtacgtacgtacgggtcgtttaagttacgtgttgcgaaggtaggtacggtacttaagttagttaggttaagtttttgggtaagtttggtttacgtttacgtaacctacccgtaagtacgttaccgggaaccgggggttcccgtacccggtaacccccgggttaggggacccggtaaaggggtaaaccgttacggttaccgggttccctaaacccggtttcccgttacccgttaaccgggtccccttaaacccccgg

SEQ ID NO: 138475 - DNA, 550 bp, Homo sapiens
  misc_feature: GYAE6OF01A2JT0.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctattaaatgtatcaacatagaccagggacgccctaagctccaatctatgctgcatccagtttgacaaagtggggtcccatcgaggttcagtggcagtgatcgtggacagattcactctcaccatctaagtatcgtgctaacgtgaaagtattttagactaaacttattactagtactaacagtaaacttacaattcggttttacggaccgaagggaccaacgtaacctaataaaacttaacgaacgtggtacgcgtagaccaccgtattaccgtgtacctttcacttccttaccccgctactccgttgtaaccg

SEQ ID NO: 138476 - DNA, 536 bp, Homo sapiens
  misc_feature: GYAE6OF01EHOYP.46.67.G01.1.454.CMB.1.raw
  modified_base (341)..(341): a, c, t, g, unknown or other
  misc_feature (341)..(341): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacactattaaattgtatcaacatagaccaggacgccctaagctcctaatctatgctgcatccagtttgacaaagtcgggtcccatcgtaggttcagtggcagtggatcgngggacagtattcactctacacatcagtaatctgacaacgtagaatatttgactaacttattactgtacaacagtaattactaattgtttacgacctaagggactaacgtaacttaacaaattaaacgtaactagtggactagaccacctattcttcgttacttacacttcccttaccccgacctacttctgtaac

SEQ ID NO: 138477 - DNA, 1044 bp, Homo sapiens
  misc_feature: GYAE6OF01B9MJ5.46.67.G01.1.454.CMB.1.raw
  modified_base (196)..(196): a, c, t, g, unknown or other
  misc_feature (196)..(196): n is a, c, g, or t
tcagactagcagtacacgaccggtgctcgatttagagtatacatattgggtttggggagtctcggtacaggacacagaatggaacatcgagggtccccgctcagctcctggggctcctgctactctggctccgaggtgtccagatgtgacatcgagctgacccagtcctcatcctcctgtctgcaaccggtggganacgtagtcgtccaccagtcctacgttcggccggggtactaacggtcggaacctagttcgaacctaccgttaaatttaaagttcggtactacaaactagtaacgaaccgtaacggggacccggtaccccgtaaggcccttaacccgttaaacttccgttaacgtcggtaccgtacggtacctaacgttacccggttaagggtttttacggaaaccggttaaaacggggtttcccggggggttaacccccctaaagggtttacccggggtttaaacggggtttaccgtaaacggggttaccgggtaaccggttaaacggggttacgggggtaaccgttttaaccgggggttaacgggggtaaaccttaaacggggtttaaccctttttacccggtaaaccccgtttaccctttaaaacccccgtaaaccccgttaaaccggtttaacccgtaaaaacgggttttaaaaccctttacccggttaaaccgtaaaccccggtttaaaaagggtttaaccggttaaaaacgggttttacggtttttaaacccgggtaaccctttaaaaccgtttttaaacgttttaacccgttaacggtttaaaccctaaaaacgttaaacgtttaaacgttttaaaaccgtaaacggtttttaccgggttttaacccgggtaaaccggtaaacggggttaacccttaaaccgggtaaaccttaaaaccgttaaaaacgttaaaccggttaacgttaacgggtacgtaaccgtacggtaccctaacgttaccgttacttacggttacccttacctactttccccgttacccgtaccttacgttacctacggttaaccgttaccg

SEQ ID NO: 138478 - DNA, 754 bp, Homo sapiens
  misc_feature: GYAE6OF01CU6W0.46.67.G01.1.454.CMB.1.raw
tcagactagcagtacacgaccggtgctcgatttagagtatacatattgggtttggggagtctcggtcaggacacagcatggacatgacgggtcccgctcagctcctggggctcctgctactctggctccgaggtgccagatgtgacatcgagctgacccagtctccatcctccctgtctcgcgaacggtgggagacagtgtcaccatctacgttcggccgggataacggtccggaactagtttacgacctaaccttaagtttttaaaacgttggtaacttaccaaactagtaacggaccggaacggggtacccggaccctaagtcctacctaactcttaactcggtctcgacctatcccgtaggtttacgacgtaacggtcgggtcccagtcggtacggttcgaggtcgacgtaggtcggtactcggtgggtaactaggttacttcctacgttactacctaacgtactacgtaagttactaccgtacggaacgttaacggtacgttaaagttttacgtttacgtaaccttaacgtttaacttacggttaactaacgtaaaacgttaacgttaaacttaacgttaacgttttaccggtttaccgaaaccggttaaccggggtaactaaccgttaaacgttaaacgttaaaacggtactaaacggttacggtacgacgttaccgacgtaaccttagttaccgtactttcgtacccttaccgttacccttacccgtacgtaactcgtaacggttacc

SEQ ID NO: 138479 - DNA, 665 bp, Homo sapiens
  misc_feature: GYAE6OF01B23VK.46.67.G01.1.454.CMB.1.raw
tcagactagcagtacacgaccggtgctcgatttagagtatacatattgggtttgggggagtctcggtcaggacacagcatggacatgagggtccccgctcagctcctggggctcctgctactctggctccgaggtgccagatgtgacatcgagctgacccagtctccatcctccctgtctgcaaccggtgggagacagtgtcaccatcacgttggccgggactaaggtcggaacattgactaaccttattttaaagttggtaatacaacagtacgaccgagggaccgaccctaagcctacctaatctatgctgctactcctagtttcgacgtaaagggtcgggtacccagtcggtaggttcgaggtggctaggtggactcgtagggactagtactttcactctacactatacgtaagttaactcgtagactaaggttgtaaagttatttacgaacttaacgtttacttaacgtagtaactaaactaagttaactttaactaagtttcggtttaaccggaacgtaaagggacctaacgtaacttaaactaaaacgttaaacgtacgttaggtacgtactacggtaccctaaccgttattccgttacgttaccctttacctaccgtttaccccttaccccgaacttactttcgttaacgttaaaccg

SEQ ID NO: 138480 - DNA, 713 bp, Homo sapiens
  misc_feature: GYAE6OF01CAD73.46.67.G01.1.454.CMB.1.raw
  modified_base (174)..(174): a, c, t, g, unknown or other
  misc_feature (174)..(174): n is a, c, g, or t
tcagactagcagtacacgaccggtgctcgatttagagtatacatattgggtttgtcctcctgctggtggcagctcccagatgggtcctgtccctggtgcaactgcagggagtcgggcccacgactggtgaggcccttcggagacccctgtccctcacctgcgctgtctctggtncctccatcagtagtggtttcttcgtggggctgggtccgcacgcctcccgaggggagggctaggaatacagttaggaagtgtctctctataggttggtacggttcctattacgtaggttcccgtactcctacgaaaggtcgtccggtaagtccaaccctaattactctcgtaggaccacggtcaagcaattctacgtttccagaatatgtagttctggcgacccgcgacgtagaccgtacgggttacttttacgtactgggttcgacggtaagtacggtacggtacttaagtttagtgtttaacgttttgggtaggtttagtttacgttcgtaaccctaccgtagtacgtaccgggtaccggggtcctacccggtaccccggtgggaccgaacgggtaactccgttcgtacccgtcccgttacccttccgttaccgccccttaccgaacccgtaccgggtaccctaccggttcccggttacccccgttcccccgtacgggtccccctaaccccttccctaacccgaaggccccgtacccg

SEQ ID NO: 138481 - DNA, 657 bp, Homo sapiens
  misc_feature: GYAE6OF01D64L6.46.67.G01.1.454.CMB.1.raw
  modified_base (194)..(194): a, c, t, g, unknown or other
  misc_feature (194)..(194): n is a, c, g, or t
tcagactagcagtacacgaccggtgctcgatttagagtatacatattgggtttggggagtctcggtcaggacacagcatggacatgagggtccccgctcagctcctggggctcctgctactctggctccggaggtgccagatgtgacatcgagctgacccagtctccatcctccctgtctgcaaccggtggganacagtgtcaccatcacgttggccgggacaagtcggaacattgacctacttaatttaaagtgtatcaacatagaccgagggaccgtccctaagctacctaatctatgctgcatcctagttgacgtaaggtcgggtccagtcgaggttcaggtgcagtgatcgtagggactagtctttcactctacactatcgtaatactcgtacgactaacggttgtaaacgttatttcgtaacttaacgtttatttaactacggtaacctaaacgtaagttaaactttaactaaggtttcggtttacccgggaaccgtaaacggggtacctaaccgtaaacttaaacgtaaaacgttaaacggtaaccgttaggtacggtactacgtacccgtaaccgttagttaccgtttcggttaccttttaccgtacctttaccccgttaccccgaactttaacgttctacgggttaacc

SEQ ID NO: 138482 - DNA, 608 bp, Homo sapiens
  misc_feature: GYAE6OF01DMSBW.46.67.G01.1.454.CMB.1.raw
  modified_base (424)..(424): a, c, t, g, unknown or other
  misc_feature (424)..(424): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaaccgtgggagacagtgtcaccatcacttggccgggcaagtcggaacattgacactatttaatgtatcaacatagaccagggaccgccctaagctactaatctatgctgctatcctagtttcgacgtaaaggtcggggtacccagtcggaaggtttcgaggtggctaggtggaattcgtagggactagtatttcaccttctacacctatactaagtaattctagaacctaaggtagtaaagttnttttacgacttaactttatttaactcgtacaacgtaataacttaactaagtttcgtttaacggaccggtaaaggtacctaaccgtaactaaacttaaaacgttaaccgaagttacgtaggactacgaccaaccgtatacttcgttccttactactttcccgttacccgacctattcctgtaacc

SEQ ID NO: 138483 - DNA, 526 bp, Homo sapiens
  misc_feature: GYAE6OF01CEQDD.46.67.G01.1.454.CMB.1.raw
  modified_base (414)..(414): a, c, t, g, unknown or other
  misc_feature (414)..(414): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatgtatcaacatagaccagggacgccctaagctctaatctatgctgcatccagtttgactaaaggtgggtcccagtcgaggttcagtggcagtggatcgtgggacagatttcactctcacctatcagtaatctgactaacgtgaagtattttagactaactttattacgtntacaactagtaattactaatttcgtttacggactaagggactaacgaactaacaaattaacgaactgtagctagacactatctgtcttcacttcctcccgactactctgtac

SEQ ID NO: 138484 - DNA, 723 bp, Homo sapiens
  misc_feature: GYAE6OF01CML5W.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactgggtgaggccttcggacgaccctgtccctcacctgcgctgtctctggtcgcctccatcagttagttggtttcttcgtggggtcgtcggggtccggcacggcctaccggagggggaacgggggcgtggaaattaaccgagtttagggaaaggttggttcctcttacgataggttggggtaggtttccttatttaaccgagtcccgttccttctactaagacgtcggacgtacaccaatacttctcgtggacccaccgtccagtacaacttcctagttttccctgaacgtactgtagtttcgtggttcgccgtccgcgtacggtaccgtacggggttacgttttacttacgtggtcggcgagtacggacggtacttaagtttattggtttagtttttagggtaggtttacggttttatttaccggtaccttaccgtaagttcgtacccgggtaccgggggtccgtacccggtccccgggtacggggaccgtaacggggaaccttacgggtacggtacccgttacccggtttccttacccgttacgtccccgttaaccccgg

SEQ ID NO: 138485 - DNA, 589 bp, Homo sapiens
  misc_feature: GYAE6OF01DB62Y.46.67.G01.1.454.CMB.1.raw
  modified_base (214)..(214): a, c, t, g, unknown or other
  misc_feature (214)..(214): n is a, c, g, or t
  modified_base (336)..(336): a, c, t, g, unknown or other
  misc_feature (336)..(336): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtccgggcccacgactgggtgaggccttcggagaccctgtccctcacctgcgctgtctctggtcncctccatcagttagttggtttcttcgtggggctggggtccgcagcctccgagggaagggctggaatacattggaagtgtctctcattagtggacggttcctattacagtccgtctctcaagngtcgagtcaccatactctctggacaccgtcacgacaactctacgttttcccgagaacgtatgtagtttcgtgtcgaccgcgctgacgtacggtctttattacgtgtcgcgagagacgtctattgtgttagtttggtagttggtttattcgactaccgtagtacgtcgggacgggtcctccggtcccggtggggacccgagggaactacggtacggttcccaccgttccgttcccgttcgtccccgtaaccccg

SEQ ID NO: 138486 - DNA, 791 bp, Homo sapiens
  misc_feature: GYAE6OF01DP2TK.46.67.G01.1.454.CMB.1.raw
  modified_base (174)..(174): a, c, t, g, unknown or other
  misc_feature (174)..(174): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggacgaccctgtccctcacctgcgctgtctcgtggtcncctccatcagtgtgtttctcgtgggctgggtccggcagcctccggaggggacgggctaggaatacgtagttggaagttcgtcctctagaagttaggtgggtacggtttacctaagttaccgtacggttcccgttctactacgaaggtacgtccgagttacccaacctaattacttccgtcgtacggaacctaccggtacccaaggtacctaaacttccgttaaccggtttttcccaggaaacgtgttacggttaacgtttcgtggttaccgaacccggcccgtcgtacggaaccggtaccggggttacttttaagttaccgttggtacggacgaggacggtacggtacttaagtttagttaggtttagtttttacgggaggtttcggtttaacgtttccgaacctaccgtagtacgtccggggaccggggtacctacccgggacccggtacgggaccgtaagggtacgtaccggttcggtaccctcccggttaccttacccgttaccgtaccccgtacccgtaacccgggaccggtaccctacggttccccggttaccccgttccccccggtacgtaccccctacccctacccgtacccaacggccgttaaccccgg

SEQ ID NO: 138487 - DNA, 648 bp, Homo sapiens
  misc_feature: GYAE6OF01BMQ6I.46.67.G01.1.454.CMB.1.raw
  modified_base (194)..(194): a, c, t, g, unknown or other
  misc_feature (194)..(194): n is a, c, g, or t
  modified_base (221)..(221): a, c, t, g, unknown or other
  misc_feature (221)..(221): n is a, c, g, or t
tcagactagcagtacacgaccggtgctcgatttagagtatacatattgggttttgggagtctcggtcaggacacagcatggacatgagggtccccgctcagctcctggggctcctgctactctggctccggaggtgccagatgtgacatcgagctgacccagtctccatcctccctgtctgcaaccggtggganacagtgtcaccatcacttggccggganaagtcgaacatgacacttattaaatgtatcaacatagacagggacgccctaagctcctaatctatgctgcactcctagtttgacgtaaagtcgggtaccagtcgtaggttcagtggcaggtggatcgtagggactaggatttacactacgtaccaactataccgaagttaactacgtaggacctaacgtagtaaagttatttacggtaactaaacgtttaattaacgttacggttaacctaaacgtaaggttaaaactttacgtaaacgtttcggttttaaccggaaccgttaaacgggaacctaaccgtaaacgttaaactaaaagttaaaccgaacgttaggtacgtcttaacggacctaacgtacttacgttacgttaccttactaccgttacccgttaccgtacctacgttccgtagttaacg

SEQ ID NO: 138488 - DNA, 556 bp, Homo sapiens
  misc_feature: GYAE6OF01BMR5A.46.67.G01.1.454.CMB.1.raw
  modified_base (227)..(227): a, c, t, g, unknown or other
  misc_feature (227)..(227): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcgaacnttgactacttattaaatgtatcaacatagaccagggacgccctaagctctaatctatgctgcatcctagtttgacgaaaggtcgggtacccagtcggtaggttcaggtggcaggtgatcgtggacagtacttcactctacacatctagtatctgacgtaagtagaagttagtttgacttaattagttactagtacaacgtagtaattaacaagtttcgttacgacgtaacggactaacgtaactaactaaattaacgtacgtgtacgtctacgtacctactagtcttgttaccttactacttcccgttacccgtactacttcgtgtaac

SEQ ID NO: 138489 - DNA, 584 bp, Homo sapiens
  misc_feature: GYAE6OF01CS4C0.46.67.G01.1.454.CMB.1.raw
  modified_base (342)..(342): a, c, t, g, unknown or other
  misc_feature (342)..(342): n is a, c, g, or t
  modified_base (504)..(504): a, c, t, g, unknown or other
  misc_feature (504)..(504): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggcacgctcccgaggggaaggggctagggaatacattggaagtgtctctcatagtggaggttcctattacagtccgtctctcaagagtcgagtcaccatatctctggaccacgtccagcaatcagttttccccngaacgatgagttcctgtcgaccgccgctcgacgcgggtctttattacgtggtgacgagaggacggacttattatagttagttttggagtttggttattacgtacaccgtagacgtcggacggggctaccgacccgtcgggaccgtagggatacgtcggtccnccgtctccttacgcctcccaacgaccggtccacgtccggtcccttcccccgtcgtcccacccctcctaccagcgtacccg

SEQ ID NO: 138490 - DNA, 497 bp, Homo sapiens
  misc_feature: GYAE6OF01AU8UI.46.67.G01.1.454.CMB.1.raw
  modified_base (191)..(191): a, c, t, g, unknown or other
  misc_feature (191)..(191): n is a, c, g, or t
  modified_base (226)..(226): a, c, t, g, unknown or other
  misc_feature (226)..(226): n is a, c, g, or t
  modified_base (474)..(474): a, c, t, g, unknown or other
  misc_feature (474)..(474): n is a, c, g, or t
  modified_base (487)..(487): a, c, t, g, unknown or other
  misc_feature (487)..(487): n is a, c, g, or t
tcagactagcagtacacgaccggtgctcgatttagagtatacatattgggtttggggagtctcggtcaggacacagcatggacatgagggtcccgctcagctcctggggctcctgctactctggctccgaggtgccagatgtgacatcgagctgacccagtctccatcctccctgtctgcaaccgtggganacagtgtcaccatcacttgcgggcaagtcggaacnttgacacctatttaaatggtatcaacatagaccagggacgccctaagctcctaatctatgctgcatccagtttgcaaagtgggtcccatcgaggttcagtggcagtgatcgtgggacagatttcactctcaccatcagtaatctagcaacgtgaagtattttagactaacttattactgtacaacagtaattacaattgtttacgacgaaggacacgactaactaaataacgactgtgctgcacatcntctcactcctccncactctgtac

SEQ ID NO: 138491 - DNA, 790 bp, Homo sapiens
  misc_feature: GYAE6OF01BLJG5.46.67.G01.1.454.CMB.1.raw
  modified_base (214)..(214): a, c, t, g, unknown or other
  misc_feature (214)..(214): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctcgtctcgtggtcncctccatcagtgtgtttctcgtgggctgggtcgcagcctccgagggacgggctaggaatacagttaggaagttcgtactcgtactagtaggtggtacggtttccttaagttacgtacgttcccgttcctcgtacgaaagtcggttacgacgtaccaaccgtattactccgtacgtacggaaccctaccgtccacgacctaacttccgttaaccgtttttacccaggtaaagtacgttagtacggttttccgtgggtaccggaccccggttcccgtacgttacggaaaccggtcgggggtttacttttaacgttaccggttggtcggacggacggtacggaccggttactttaagttacgtttaggtttacggtttttagggacggttttggtttttaaaccgtttccggtaaaccccttaaccggttacggtaccgggttaccggggtaccgggggttaccctaccccggggtaccccgggttgggggaccccgttaaaggggtaaccttaccggtaccgggtttcccgtaacccgtttaccccgtttccgttaccccgccccggttaacccccgg

SEQ ID NO: 138492 - DNA, 570 bp, Homo sapiens
  misc_feature: GYAE6OF01D3TPH.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacactatttaaatgtatcaacatagaccaggacgccctaagctctaatctatgctgcatcctagtttgacaaagtcgggtcccagtcgtaggttcagtggcagtggatcgtgggacagtatttcactctcacatacagtaatctgacaacgtagaagtatttagactaacttattactgtacaactagtaattaactaattcgttttacggaccgtaacgggaactaacgtaacttaactaaaagttaaacgaacgttgtaggaccttaggacctaaccgtaattccttcgttacctttaccaacttccctttaccccgaccttaacttcgtgtaaacc

SEQ ID NO: 138493 - DNA, 830 bp, Homo sapiens
  misc_feature: GYAE6OF01DF2CS.46.67.G01.1.454.CMB.1.raw
  modified_base (196)..(196): a, c, t, g, unknown or other
  misc_feature (196)..(196): n is a, c, g, or t
  modified_base (217)..(217): a, c, t, g, unknown or other
  misc_feature (217)..(217): n is a, c, g, or t
  modified_base (245)..(245): a, c, t, g, unknown or other
  misc_feature (245)..(245): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactgggtgaggtccttcggacgaccctgtcccctnacctgcgctgtctctgggtcncctaccatcaggtagttggtttcttcgnggggtctcggggtccgcagccgtaccggaaggggaagggtctagggaactaacgtagttagggtaagtcgtccttctacgtaagttagggtagggtacgttaccttaagttaccgtacgttcccgttcctctaacgaaaggtcgtacgtacgtaccaaccgtatactcctcgtacggacaccgtaccaagtactaaacttcgttacgttttaccgagtaaaggtcgttagtacgtttcgtagtccggaccccggtccgtacgtacggtaaccggttacgggttaccgtttttaacgttaccggtgttacgggaccgggtaaggtaacgggtaccggtttaatttagtttaacgttgggttttaacggttttgggtacgtttagggtttaacctttaccgaacccgttaacgtacgggtacggtacccgggggtaccgggggtaccccttacccccggggtaacccggggtcggggtaacccggtaaaggggtttaaacccgtacccgggtttacccggggtaacccttacccccggtttaccctttacccccggtttaaccggtacccccctaaacccccggggg

SEQ ID NO: 138494 - DNA, 681 bp, Homo sapiens
  misc_feature: GYAE6OF01B0ICU.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcactatcacttgccgggcaagtcggaacattgacacctattaaatgtatcaacatagaccagggacggccctaagctcctaatctatgctgcactcctagttttcgactaaaggtcggggtccctagtcgaggttcgaggtggcaggtggatcgtaggactagtactttcgactcctactaccgtatactaagttaatccgtagaccgtaaacggttagtaaacgttaagttttcgaaccttaaacgttttactttaaccgttaggttaacctaaaccgtaaggtaaacttttaaccgtaaagtttcggtttttaaccgggacccgtaaacggggtacctaaacccggtaaacttaaaccgtaaaacgtttaaaacggaaccgttaggttacggacgttagaccccgtaacgtattaccgtttcgtacctttaccaactttccccgtttacccgtacccgttaccttcgttacggttaaacc

SEQ ID NO: 138495 - DNA, 619 bp, Homo sapiens
  misc_feature: GYAE6OF01CG9VL.46.67.G01.1.454.CMB.1.raw
  modified_base (172)..(172): a, c, t, g, unknown or other
  misc_feature (172)..(172): n is a, c, g, or t
  modified_base (291)..(291): a, c, t, g, unknown or other
  misc_feature (291)..(291): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggcccttcggagaccctgtccctcacctgcgctgtctctggtncctccatcagtagtggtttcttcgtggggctgggtccgcagctcccgagggaagggctggaatacgattggaagtgtctctcagtagtggaggttcctattacagtccgtctctcaagngtcgagtcacctatactctcgtggacctacgtaccaggcctaagtcctacgttttcccctagaacgtatggtacgttctgtcgaccgacgtctacgaaccgtcgggtactttatacgtgtgacgtagagtacggtctagttatgttagttttggagttggttacttcgtaactcccgtagacgtcgggtacgggtctcccggacccgtcgggaccgtagggtaacttacgtcggtccaccgttcttccgttacgccctaccgtaccgtaccggccctacgtccggtcccttcccgcgtccctaccctcccaccgtacgtcgtacccgg

SEQ ID NO: 138496 - DNA, 610 bp, Homo sapiens
  misc_feature: GYAE6OF01EXHJS.46.67.G01.1.454.CMB.1.raw
  modified_base (336)..(336): a, c, t, g, unknown or other
  misc_feature (336)..(336): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggcagctcccgaggggaagggctggaatacattggaagtgtctctcatagtggaggttcctattacagtccgtctctcaagagtcgagtcaccatatctctggacacgtccagcaatcagttttcccngaagatgagttctgtgaccgccgctgacgacgggtctttagtactgtgcgagagacggctattagtgttagtttttaggagttggtttacgtttcgtaaccgtaccctagtacgttacggacgggggtcctacggacccccggtggggacccgtaggggaacttacgtcggtaccgaccgttctccgttacgccctacccgaaccgacgggtccccacgttccggtccccttcccccgtcggtccctaccccctaccctcccgaagcgtacccg

SEQ ID NO: 138497 - DNA, 588 bp, Homo sapiens
  misc_feature: GYAE6OF01BGCAP.46.67.G01.1.454.CMB.1.raw
  modified_base (192)..(192): a, c, t, g, unknown or other
  misc_feature (192)..(192): n is a, c, g, or t
  modified_base (406)..(406): a, c, t, g, unknown or other
  misc_feature (406)..(406): n is a, c, g, or t
  modified_base (414)..(414): a, c, t, g, unknown or other
  misc_feature (414)..(414): n is a, c, g, or t
tcagactagcagtacacgaccggtgctcgatttagagtatacatattgggtttggggagtctcggtcaggacacagcatggacatgagggtccccgctcagctcctggggctcctgctactctggctcgaggtgccagatgtgacatcgagctgacccagtctccatcctccctgtctgcaaccggtggganacagtgcaccatcacgttggccgggacaaggtcggaactattcgaactaccttaattttaaatggtattacaacatagaccagggaccggaccctaagctactaatctatgctgctatccagtttgactaacggtcgggtacccagtcgtaggttcaggtcggacaggtaggatgtacgggacagtatttcactctacacatacagtaatctanactagtanacgttattgactaatttatactagtaactaactaagtaacttaataacgtttcggtttacggaacgtaacggtacaaccgtaactaaacgtaaacttaaacgtaactaggtacgacgtacgactaaccgtattcgtacgtctttacactttccctacccgacttatcctgtaac

SEQ ID NO: 138498 - DNA, 610 bp, Homo sapiens
  misc_feature: GYAE6OF01CUEXA.46.67.G01.1.454.CMB.1.raw
  modified_base (195)..(195): a, c, t, g, unknown or other
  misc_feature (195)..(195): n is a, c, g, or t
tcagactagcagtacacgaccggtgctcgatttagagtatacatattgggtttggggagtctcggtcaggacacagcatggacatgagggtccccgctcagctcctggggctcctgctactctggctccggaggtgccagatgtgacatcgagctgacccagtctccatcctccctgtctgccaaccggtggganacagtgtccaccatcacttggcccggggacaaggtcggaactattacgaacctaaccttattttaaagttggtaatcaaacatagaaccgagggaccggaccctaagcctacctaatctatcgctgctatcctagtttcgacgtaaggtcgggtaccctagtccggtaggttacgaggtcggcgtaggtggacgtcgtaggggaactagtactttcacttctaccactatacgtaagtaactcgtacgactaacggtagtaagttagttttacgaacttaactttattactacgtacaaatagtaattaactaagttcggtttacgacgtaaggacacgtaactaactaaacttaacgaactgtacgactgacctactatcttcgtccttacacttcctaccactactcgtgtac

SEQ ID NO: 138499 - DNA, 584 bp, Homo sapiens
  misc_feature: GYAE6OF01A4FUS.46.67.G01.1.454.CMB.1.raw
  modified_base (293)..(293): a, c, t, g, unknown or other
  misc_feature (293)..(293): n is a, c, g, or t
  modified_base (342)..(342): a, c, t, g, unknown or other
  misc_feature (342)..(342): n is a, c, g, or t
  modified_base (564)..(564): a, c, t, g, unknown or other
  misc_feature (564)..(564): n is a, c, g, or t
  modified_base (573)..(573): a, c, t, g, unknown or other
  misc_feature (573)..(573): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggcagctcccgaggggaaggggctggaatacgagttggaagtgtctctcatagtggaggttcctattacagtccgtctctcaagngtcgagtcaccatatctctggaccacgtccagcaatctacgttttcccngaagtatggtagttctggtcgacccgccgctcgacgtacgggtctttatctggtgcgagaggacggcttattatgtagttttggagttgtttagttccgactacctagacgtcggacgggtctccggacccggtgggaccgagggtaacgtacgtcggtccaccgtctccgtacgccctccaacgtaccgggccacgttcccggttccctccccgtcgtccncccctaccnccagcgtcccg

SEQ ID NO: 138500 - DNA, 874 bp, Homo sapiens
  misc_feature: GYAE6OF01D87Y2.46.67.G01.1.454.CMB.1.raw
  modified_base (98)..(98): a, c, t, g, unknown or other
  misc_feature (98)..(98): n is a, c, g, or t
tcagactagcagtacacgaccggtgctcgatttagagtatacatattgggtttgtcctcctgctggtggcagctcccagatgggtcctgtccctggtncaactgcaggacgtccgggcccacgacgtgggtgaggcccttcggacgaccctgtccctcacctgccgctgtctcgtggtcgcctccatcagttgttggtttctcgtgggctcgggtccgcacgcgtaccggaggggacgggctaggaatacgtagttacgggaagttcgtcctctacgtaagttaggttcgggttacggtttaccttaagttaccgtacgtttcccgttcctacgtacgaagtacgtcgtacgtccaacctattacttctacgtacggaaccaccgtccaagtacctaacttaccgttacgttttacccgaggtaacgtagttacggtactttcgtcggtacccggtacccgcccggtaccgtacggtaacccgggttaccggggtttacctttttaacgttaccggttagggtacggtaacgggtaaggtaaccgggttaccggttaacttttaagtttaggtttacggttttaaggttttttcgggggtaagttttacgggtttttaacttacccgggtaacctaacccgggtttaagtaccgggtaccgggggtaccggggtccctacccgggttacccgggacggggtacccgaagggttaaccgttccggtacgttaccccgttaccgtttaccgtaccgttacccgaccccgttaaccggaacccggtacccggtcccgttacgtttccccccggttaccccgttccccgacccggttccccctaaccccttaccgaaccggtaaccgtcccgtacccg

SEQ ID NO: 138501 - DNA, 802 bp, Homo sapiens
  misc_feature: GYAE6OF01EZEDT.46.67.G01.1.454.CMB.1.raw
  modified_base (194)..(194): a, c, t, g, unknown or other
  misc_feature (194)..(194): n is a, c, g, or t
tcagactagcagtacacgaccggtgctcgatttagagtatacatattgggtttggggagtctcggtcaggacacagcatggacatgagggtccccgctcagctcctggggctcctgctactctggctccggaggtgccagatgtgacatcgagctgacccagtctccatcctcctgtctgccaaccggtggganacagtcgtacacctatcacgttcggcccgggacaacggtccggaaactatttacggaacctaacctttaaattttaaaagtttggtaacttaccaaactaagttaacggaaccgaacgggggacccgtacccctaaaggtccttaccctaattccgtaagtcgctacgtactacttccgtaggttttacgaccgtaaagggttccggggttacccagttaccggtaacgggttcgaaggtcggtacgtagggttacggtacttacggtaggggaacctaggttacctttaccgaccttacgtaccaccgtactacgtaacgttactcgttacgacgtaacggtagtaaacgtttactttacgaactttaacgtttacgttaacgtcgttaaaccgtaacgtaagttaaacttttaaccgttagtttaccgggtttaacggaaccggtaacgggtaacctaacggttaaacttaaacgtaaaacgtttaaccggaacgttcggtacggtaccgttacgaaccgttaaccgttagtttaccgttacgtttaccgtaacccttaccgtttccccgtaaccccgtacctttacctaaccggttgtaaacccg

SEQ ID NO: 138502 - DNA, 705 bp, Homo sapiens
  misc_feature: GYAE6OF01E5I72.46.67.G01.1.454.CMB.1.raw
  modified_base (193)..(193): a, c, t, g, unknown or other
  misc_feature (193)..(193): n is a, c, g, or t
  modified_base (247)..(247): a, c, t, g, unknown or other
  misc_feature (247)..(247): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatccctccctgtctgcaaccgtggganacagtgtcaccatcacttgccgggacagtcggaacattgacactattaatgtancaacatagacagggacgaccctaagctcctaatctatgctgacatcctagtttcgacgtaaaggttcgggtcccagtcgtaggttcaggtcggacaggtggatcgtagggactagtactttcgactccgtacaccgtactacgtaacgtaactcgtagtactaacggtaggtaaagttacttttacgaacctttaaacgtttactttaacgttaggttaaccgaaacttaaggttaaactttaacgtaagtttacggttttaccggaacccggtaaagggtaaccctaaccgttaaaccttaaaccgttaaaacgtttaaaaccggaacggtttacggtaaccgggttaccgtaacggtaaccccgtaaccgttaacgtttaccgttacgtttacccgttaccttacccgtttacccgttacccccggaaccctttccgtttacgtccggttaaaccg

SEQ ID NO: 138503 - DNA, 808 bp, Homo sapiens
  misc_feature: GYAE6OF01AJPB7.46.67.G01.1.454.CMB.1.raw
  modified_base (174)..(174): a, c, t, g, unknown or other
  misc_feature (174)..(174): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactgggtgaggccttcgggagaccctgtcccctcacctgcgctgtctctggtncctcatcagtagtggtttctcgtggggctgggtccgcagcctccgaggggagggctaggaatacgagttagggaagttcgtctctacagtaggtggtacggttcctattacagtccgtctctacaagagtcgagtccactatactctctggactacgtccagcgtaactctacgtttttcccagaacgtacttaggtacgtttcgtggtccggaacccgtcccgtacgtcggaacccggtaccggggttacttttacgttaaccgtgggttacggaccggtaaggtaacgggtaccggttacgtttaacgtttaagttcgtttaaggttttttacgggtagggttttacgttttacgtttacccggtaacccttacccggttaagtaccggttacggggtacccgggggttccgttaccccggtacccccgggttagggggtaccccgaaagggggttaaaccttaccgggttacgggttaccccgtaacccgggttcccttacccggttaccggttaccccttccccggtaaaccggaccgggtacccctaacggttccccggtaccccgttttcccccccgagggtccccctacccccgtacccgttaccccgtaaggtccggtacccccgg

SEQ ID NO: 138504 - DNA, 754 bp, Homo sapiens
  misc_feature: GYAE6OF01AKG2J.46.67.G01.1.454.CMB.1.raw
  modified_base (194)..(194): a, c, t, g, unknown or other
  misc_feature (194)..(194): n is a, c, g, or t
  modified_base (232)..(232): a, c, t, g, unknown or other
  misc_feature (232)..(232): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgacaaccggtggganacagtgtccaccatcacttcggccggcaagtcggaacnttcgacacttatttaatgtatcaatatacgaccgagggaccgtaccctaaggtcctaccttaatcgttaatcggcctagcctattccgtagtttgaccgtaaaagggttccggggtaccctaagtaccggtaggtttaccagggttcggactaaggtggttaactcggtagggtacgtagtacttttcaaccgttcctacacctacttcgttaaagtacttcgtacgaaccgtaacgtagtaagttacgttttacacgttaaactttacttaacttacggtacctaaacgtagttaacttacggtaacttacggtttacggtttacccggtaacggtaaccggggttaacgaaccggttaaactaaaccgttaaaaacggtttaaaacccggtaacgtttacggtaaccgggtacgttaaccggtaaccggttaacccttaacggtttccttaaggttttacccttaaccggtttacccttaccgggtttacccccctactttaaccgttcgtttaaaccgg

SEQ ID NO: 138505 - DNA, 885 bp, Homo sapiens
  misc_feature: GYAE6OF01ELUSI.46.67.G01.1.454.CMB.1.raw
  modified_base (199)..(199): a, c, t, g, unknown or other
  misc_feature (199)..(199): n is a, c, g, or t
tcagactagcagtacacgaccggtgctcgatttagagtatacatattgggtttggggagtctcggtcaggacacagcatggacatgagggtccccgctcagctcctggggctcctgctactctggctccggaggtgccagatgtgacatcgagctcgacccagtcctccatccctccctgtctgaccaaccggtggganacagtcgtacaccatcacgttcggccgggacaaggtccggaactattcgaactaacctttaatttaaagttcggtaatacaaactagtacgaccgacgggaccgaccctaagctacctaatctatcgctgctactccgtagttacgacgtaaacggtcgggtacccagtcggtaggttacgaggtcggtacgtaggtcggtacttcggagggtactaaggttacttttacccaccttccgtaccaaccgttaacgtaccgttaacggttaacttacccggttagtaacccggttaaacgggttaaggttaaacggttttaagttttaccgggtaaaccttttaaaacgttttaccgtttaacccgtttacgggttaaaccctaaaacggttaacgtttaaaacgttttaaaccggttaacgttttttaacccgggtttttaacccggggaaacccggttaaaaccgggggtaaaccttaaacccggtaaaacccgtttaaaaccgtaaaaaaccggtttaaacccggttaaaacgttcggggttaacccggtacgttaaacccggtaacccgttaaaccgttaacggtttacccgttacggttttaaccccgtttacccgttaacccgtttacccccggtttaaccccgacccgtttaaagtttacccgtaacgtttaaaccccgg

SEQ ID NO: 138506 - DNA, 737 bp, Homo sapiens
  misc_feature: GYAE6OF01D8YR6.46.67.G01.1.454.CMB.1.raw
  modified_base (192)..(192): a, c, t, g, unknown or other
  misc_feature (192)..(192): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaacggtggganacagtgtcaccatcacgttcggccgggacaaggtccggaaactagttcggaacctaacctttaaattttaaagttggttaactaccaaacgagttaacggaccgaacgggggacccggtacccctaaaggtcccttaccctaattcctaagtcgcttggacctacgttcccgtaggttttacgacgtaaacgggttccggggtaccctaagtcggtagggtttcagggttcggacgaggtaggtatcggtaggggactaggttactttcgactcctacgtaacctattacgtaagttaacttccgtagtaaccgtaaggttagtaagttacttttacggactttaaacgtttactttaacgttacgtaacctaacgtaagttaactttaacgtaacgtttcgggtttaaccgaaccggtaaacgggtacctaaaccgtaaactaaacgttaaacgttaaacgacgttagtacggactacgacctacgtattcgttcgttaccttactacctttcccgttacccgtactacttaccgtgttaaccg

SEQ ID NO: 138507 - DNA, 1011 bp, Homo sapiens
  misc_feature: GYAE6OF01C1SCA.46.67.G01.1.454.CMB.1.raw
  modified_base (197)..(197): a, c, t, g, unknown or other
  misc_feature (197)..(197): n is a, c, g, or t
tcagactagcagtacacgaccggtgctcgatttagagtatacatattgggtttggggagtctcggtcaggacacagcatggacatgagggtccccgctcagctccgtggggctcctgctactctggctccgaggtgccagatgtgacatcgagctgacccagtctccatccctcctgtctgaccaaccggtgggaanactagtcgtaccaccatcctacgttcggcccgggactaaaggttacggaactatttacggaaccttaacctttaagttttaaaagttggtaaacttaccaaaacgtaagttaacggaacccggaagggggtacccggtaacccctaaaggtccctttaacctaaaacttccttaagttcggtaccttacggtacctaacgttaccccgttaaggttttccggaaacgttaaaacgggggttccgggggttaccccctaagggttacccgggttaaacgggtttaccgaagggtttacgggaccggttaaggggttaacggggtaaccgtttacccggtaaggggggtaaacccgttaacggtttaaacctttttcccggtaaccctttacccggtttaaaccccgaaaactttaaacccgtaaccggtttaaacggtttaaacctttacccggttaaccgtaaaaccgggttaaaccccgggttaaagggttaaaacggtttttaacgtttttaaaccgggtaaccttttaaaacctttttaaccggtttaaccgttttaaacgtaaaccgtaaaaccgttaaaacgtttaaacttttaaaccggttaaaccgtttttaacggggtttttaacccgggaaacccggttaaaacggggtaaacccgttaaacccgtaaaaccgttaaaaccgttaaaaacgtttaaccggtaaacgtttcgggtacggtaacctacggtaccctaaacgtacgttaccgtttaacgttcccttacgttaccttcccttaaccccgactaccttagctttaaaccg

SEQ ID NO: 138508 - DNA, 569 bp, Homo sapiens
  misc_feature: GYAE6OF01DVW87.46.67.G01.1.454.CMB.1.raw
  modified_base (366)..(366): a, c, t, g, unknown or other
  misc_feature (366)..(366): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggcagctcccgaggggaaggggctggaatacattggaagtgtctctcatagtggaggttcctattacagtccgtctctcaagagtcgagtcaccatatctctggacacgtcagcaatcagttttccctgaacgatgagttctgtcgaccgcgctgacncgggtcgtttattacgtgtgcgagagacggctattagtgtattttggagttggtttatttcgactaccctagacgtcggacggggctcggacccgtgggccgaagggatacgtggtacaccgtctccgttagccctccgaccgacgggacccacgttccggtccttcccccgtcgtccctacccctcctccaacgcgtacccg

SEQ ID NO: 138509 - DNA, 591 bp, Homo sapiens
  misc_feature: GYAE6OF01EKCMG.46.67.G01.1.454.CMB.1.raw
  modified_base (334)..(334): a, c, t, g, unknown or other
  misc_feature (334)..(334): n is a, c, g, or t
  modified_base (338)..(338): a, c, t, g, unknown or other
  misc_feature (338)..(338): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctctggggctgggtccggcagctcccgaggggaggggctggaatacattggaagtgtctctcatagtggaggttcctattacagtccgtctctcaagagtcgagtcaccatatctctggacacgtccagcaatctagtttcccngaanatgagttctgtcgacccgccgctgaccgtacgggtcgttttatacgtgtgcgagagacggtctattatgtagttttggagttggttattcgactaccctagacgtcggacggggtctccggaccccgtggggtaccgagggtaactacgtcggtaccgtacccgttctccttacgcccgtacccaccgtaacggcccagtcccggttccctcccccgtcggtacccacccctccctacccgaacgcgtacccg

SEQ ID NO: 138510 - DNA, 674 bp, Homo sapiens
  misc_feature: GYAE6OF01CZQIH.46.67.G01.1.454.CMB.1.raw
  modified_base (137)..(137): a, c, t, g, unknown or other
  misc_feature (137)..(137): n is a, c, g, or t
  modified_base (145)..(145): a, c, t, g, unknown or other
  misc_feature (145)..(145): n is a, c, g, or t
  modified_base (194)..(194): a, c, t, g, unknown or other
  misc_feature (194)..(194): n is a, c, g, or t
  modified_base (237)..(237): a, c, t, g, unknown or other
  misc_feature (237)..(237): n is a, c, g, or t
  modified_base (464)..(464): a, c, t, g, unknown or other
  misc_feature (464)..(464): n is a, c, g, or t
tcagactagcagtacacgaccggtgctcgatttagagtatacatattggggtttggggagtctcggtcaggacacagcatggacatgacgggtccccgctcagctcctggggctcctgctactctggctccgaggtnccagatgngacatcgagctgacccagtctccatcctccctgtctgcaaccgtggganacagtgtcaccatcacgttcgccggggataaaggtccggaaanatttacgaacctaaaccttaagttttaaaagttgggtaactacaaaacaataacggaccgaacggggaaccggacccttaaagacctacctaaagtctaatgcctgactactcctagtttgactaaaacggtggggtcccaagttccgaggtttacgaaggtggctaggtggatacggtaggggaactaggtaactttcacgtcctacaccgtaattcgaaagttanccgtagaccgaagtagtaaagtatttacgacttaaatttacgtatactacgaaactaagtaaacttaacaatttcggtttaacggaacccgtaaagggaacctaaccgtaaactaaactaaatttaaaaccggaactttggtacggtactacgaccacctattaccttagttccttacgtacttcccgttaccgaccattccgtagtacc

SEQ ID NO: 138511 - DNA, 568 bp, Homo sapiens
  misc_feature: GYAE6OF01AS1LH.46.67.G01.1.454.CMB.1.raw
  modified_base (193)..(193): a, c, t, g, unknown or other
  misc_feature (193)..(193): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtggganacagtgtcaccatcacttggccgggcaagtcggaacattgacacctatttaaatggtatcaacatagaccagggacgccctaagctcctaatctatgctgcatccagtttgctaaaggtcggggtcccatcgaggttcaggtggcagtggatcgtgggacagtactttcactctacaccatcagtatctgcaacgtgaagtatttgactaactttattactagtactaactagtaattacaatttcgtttacggaccgtaacgggtactaacgaacttaaacaaacttaaaccggaacttggtacggtacctaggacctacctattccttgttaccttactacgttcccttccccgacctacttccgttgtaacg

SEQ ID NO: 138512 - DNA, 596 bp, Homo sapiens
  misc_feature: GYAE6OF01EHR73.46.67.G01.1.454.CMB.1.raw
  modified_base (192)..(192): a, c, t, g, unknown or other
  misc_feature (192)..(192): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttggccgggcaagtcggaacattgactaccttaatttaaattggtatacaacatagaccagggaccgccctaagctacctaatctatgctgcatcctagtttgacgtaaaggtcgggtaccctagtcggtaggttcaggtggcgaggtggtatcgtggacagtattcactctacaccatacagtaatctagacgtacgtagtaagttatttagacttaaacttactttactgtaactaactagtaaacttacgtaagttcgtttacggaacctaagggtaacctaacgtaactaactaaagttaaacgaactggtacgacgtacgaccgtacctagttcttacgttccttacctaccttcccgttacccgaccttacttccgtgtaac

SEQ ID NO: 138513 - DNA, 663 bp, Homo sapiens
  misc_feature: GYAE6OF01BVPNZ.46.67.G01.1.454.CMB.1.raw
  modified_base (298)..(298): a, c, t, g, unknown or other
  misc_feature (298)..(298): n is a, c, g, or t
  modified_base (357)..(357): a, c, t, g, unknown or other
  misc_feature (357)..(357): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtcgcctccatcagtagtggtttctcgtggggctgggtccggcagctccgaggggagggctaggaatacagttgggaagttgtctctcagttaggtggaggtttcctagttacagtccgtctctacaagngtcgagtcacatactctctggacacgtccagactaactcttacgttttcccagtaagtntagtacgttcgtgtacgacccgcccgtctacggaccgtacgggtcttttaagttaccgtgtcggacgaaggtacggacggtcttaagttagttagttagttttgggtaggttggtttatttaccgtacctaccgtagtacgtcgggacgggtacctccggaccgaggtcggggaccgtaagggtaactacgttcggacctacccggttccttaccgttccgccctacccgaaccggtaccggccctacgttccggttcccctttaccccgacgggtcccaccccgttcccacccgtaagtacccgg

SEQ ID NO: 138514 - DNA, 550 bp, Homo sapiens
  misc_feature: GYAE6OF01DTSVV.46.67.G01.1.454.CMB.1.raw
  modified_base (192)..(192): a, c, t, g, unknown or other
  misc_feature (192)..(192): n is a, c, g, or t
  modified_base (195)..(195): a, c, t, g, unknown or other
  misc_feature (195)..(195): n is a, c, g, or t
  modified_base (217)..(217): a, c, t, g, unknown or other
  misc_feature (217)..(217): n is a, c, g, or t
  modified_base (389)..(389): a, c, t, g, unknown or other
  misc_feature (389)..(389): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacngtgtcaccatcacttgccgggnaaggtcggaacattgacactatttaaatggtatcaacatagaccaggacgccctaagctcctaatctatgctgcatccagtttgacaaagtgggtccatcgagttcagtgcagtggatcgtggactagtatttcactctacacatacagtaatctgactaacgtgaaagttntttagactaacgtttattactagtacaactagtaatttactaagtttgtttaccggacgtaaggacctaacgtaacttaacaaattaacgaacgtgtaggctgacctaccgtattactcgttaccttactaacttcccttacccgactacttctgtaaccg

SEQ ID NO: 138515 - DNA, 690 bp, Homo sapiens
  misc_feature: GYAE6OF01DLGZ7.46.67.G01.1.454.CMB.1.raw
  modified_base (443)..(443): a, c, t, g, unknown or other
  misc_feature (443)..(443): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccagactggtgaggccttcggagccctgtccctcacctgcgctgtctctggtgcctcatcagtagtggttttcttcgtgggggctcggggtccgcagtccgtaccgaggggaaggggctggaatacgagttaggaagttgtctctcataggtggtaggttcctattacaggtccgtctctacaagtgtacgagtcaaccatactctcgtcggacacgtccagacaatcgtacgttttcccagaagtatagtagttctagtcgaccgtccgactgaccgtaacgggtntttaacgttacgtggtacgtcgaagtacggtaacggactttagtttacttaggttacgtttttagggtagtttggtttaacttttaccggaaccttcccggtaggggttaccgggtaccgggggtccgttacccggaccccggttacgggggtacccgtaaggggtaacctaaaccggtttcgggtacccctaaccgggtttacccttcccggtttaaccgtccccgttccccgtaaaacccccggg

SEQ ID NO: 138516 - DNA, 632 bp, Homo sapiens
  misc_feature: GYAE6OF01BFUG1.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtgggagacagtgtccaccatcacttggccgggacaagtcggaacattcgactaccttaatttaaattggtatacaacatacgacgagggaccgaccctaagctactaatctatgctgacatccgtagtttacgacgtaaaggtcgggtcccagtcggaggttcaggtgacgaggtgatcgtgggactagtatttcactctcacatcagtactctagacaacgtagaattatttagacttaacttattaactgtaactaacgtaagttaaactttaacgtaagtttacgggtttacggaaaccgtaaacgggtacctaaaccgtaaaccttaaactaaaacgttaaaccgaacgttggtacggtactaacggtactaaacctattaccgttcgttacctttaccgactttaccccgttaccccgacttacgttcctaagttaaccg

SEQ ID NO: 138517 - DNA, 663 bp, Homo sapiens
  misc_feature: GYAE6OF01C9UPH.46.67.G01.1.454.CMB.1.raw
  modified_base (177)..(177): a, c, t, g, unknown or other
  misc_feature (177)..(177): n is a, c, g, or t
  modified_base (267)..(267): a, c, t, g, unknown or other
  misc_feature (267)..(267): n is a, c, g, or t
  modified_base (305)..(305): a, c, t, g, unknown or other
  misc_feature (305)..(305): n is a, c, g, or t
  modified_base (367)..(367): a, c, t, g, unknown or other
  misc_feature (367)..(367): n is a, c, g, or t
tcagactagcagtacacgaccggtgctcgatttagagtatacatattgggtttgtcctcctgctggtggcagctcccagatgggtcctgtccctggtgcaactgcaggagtccgggcccacgactgggtgaggccttcgggacgaccctgtccctcacctgcgctgtctcgtggtcncctccatcagttagttggtttctcgtggggctcgggtccggcagcctccgaggggaagggctaggaatacgagttaggaagtgtctcgtnagtaggtggaggtttcctattacacgttccgtctcctnaagtgtcgagtcaacctatactctcgtggacctacgtccagctaatctacgtttccagaagntagtacgttctagtcgaccgtccgctacggacgtacgggtcttttaatcgtggtcgacgtaggacgtacggtacttagttataggtttagttttaggaggtttaggtttacgttcgacctaccgtagtacgtcgggacggggtcctaccggacccggtgggaccgaagggtaactccgtacggtcctaccgtccgtccgtacgtccccgtaccgaaccgtacggaccctacggttcccggttacccgttccccgtacggacccctacccctcccgtacccgaaggcccgtacccgg

SEQ ID NO: 138518 - DNA, 674 bp, Homo sapiens
  misc_feature: GYAE6OF01CWRAT.46.67.G01.1.454.CMB.1.raw
  modified_base (195)..(195): a, c, t, g, unknown or other
  misc_feature (195)..(195): n is a, c, g, or t
tcagactagcagtacacgaccggtgctcgatttagagtatacatattgggtttggggagtctcggtcaggacacagcatggacatgagggtccccgctcagctcctggggctcctgctactctggctcgaggtgccagatgtgacatcgagctgacccagtctccatccctccctgtctgaccaaccggtggganacagtcgtcaccatcacgttcggccgggacaaggtcggaactagtttagaacctaacctttaatttaaacgttggtatacaaacatacgaaccgagggaccgaccctaagtcctaccgtaatctatcgtctcgtacctacgtcctaggtttcgacgtaaacgggtcgggtaccctagttcggaggttcgaggtcgagacgtggatcgtagggactagtactttcacgttcaccgaactactactaagtaactcgtacgacgtaacggttagaacgtttagtttacgaactttaactttacgttacgtaacgtaacaaactaagtaactttacgaacgttttcggtttaaccggaaccgttaacgggaaccttaacgaaacttaaacgtaaacgttaacgaaccgttggtaacgcctagtacccgtaactactcgttcgttacctacgtacttacccggtcctagtactcgttgtaaccg

SEQ ID NO: 138519 - DNA, 774 bp, Homo sapiens
  misc_feature: GYAE6OF01CT72M.46.67.G01.1.454.CMB.1.raw
  modified_base (172)..(172): a, c, t, g, unknown or other
  misc_feature (172)..(172): n is a, c, g, or t
  modified_base (262)..(262): a, c, t, g, unknown or other
  misc_feature (262)..(262): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtcncctccatcagtagtggtttctcgtggggctgggtccgcagcctacccgaggggaacgggctaggaatacgtagttggaagttgtcttctntagtagtggtacggtttacctaattacgtacgtccgttctactacgaagtacgtcgagtccaaccgtatctctcgtaggacctacgtcagactaatcgtacgttttaccagaagtctggtacttcgtacgtcgtaccgccgtcgtacgtaaccgtacgggttacgttttaacgttcgtacggttcgacggtaagacggtacgttacttaagttagttagtttaggttttaggacgtttaggtttaaccgttccggtaaccgtacccgtaagtacggtacccgggtaccggggtcccttaccgggtaaccccggtggggtaacccgtaaagggttaacgtaccggttacgttacccgtacccgttcgttacccgtttaaccgccccgttaacccgtaacccgggtaaacccggtcccgttaacccgtttaccccgggttaccccccgtttacccccggtacggttcccccctaaccccgtcccgttaaacccgaaccggtacccgtaccccgg

SEQ ID NO: 138520 - DNA, 568 bp, Homo sapiens
  misc_feature: GYAE6OF01BZPHE.46.67.G01.1.454.CMB.1.raw
  modified_base (331)..(331): a, c, t, g, unknown or other
  misc_feature (331)..(331): n is a, c, g, or t
  modified_base (495)..(495): a, c, t, g, unknown or other
  misc_feature (495)..(495): n is a, c, g, or t
  modified_base (509)..(509): a, c, t, g, unknown or other
  misc_feature (509)..(509): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcgggagaccctgtccctcacctgcgctgtctctggtgcctccatcagtagtggtttcttctggggctgggtccgcagctccgagggagggctggaatacattggaagtgtctctcatagtggaggttcctattacagtccgtctctcaagagtcgagtcaccatatctctggacacgtccagcaatcagtttcccngaagatgagttctagtcgaccgtccgcttagacgtacgggtcgttttaattacgtgtgacgaggacgacggtcttattattgtagttttggagttgttatttcgactaccctagtatcggacggggtctccggaccccgtggggccgagggaactcgtcggtcnccgtctcctagccnccaccgacggccacgtccggtccttccccgtcgccctaccctcctaccgagcgtacccg

SEQ ID NO: 138521 - DNA, 906 bp, Homo sapiens
  misc_feature: GYAE6OF01A8CS5.46.67.G01.1.454.CMB.1.raw
  modified_base (208)..(208): a, c, t, g, unknown or other
  misc_feature (208)..(208): n is a, c, g, or t
  modified_base (289)..(289): a, c, t, g, unknown or other
  misc_feature (289)..(289): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactgggtgaggccttcggagaccctgtccctcacctgcgctgtctctggtgcctcatcagtagtggtttctcgtgggctgggtccgnagctccgagggaagggctaggaatacagttggaagtgtactctcagtagtggaggttcctattacagtccgtctctcaagngtcgagtcacatatctctggacacgtccagctaatctacgttttcccagtaagtcgttagtacgtttacgtggtacgacccggtccgtacgtcggaacccgtacggggttccgtttttaacgttaccgttgggtacggtaccggtaaggtacggtaaccgggttacttaagtttaggttacggtttaggtttttttaggggtaacggtttttagggttttaaccgttttaccgggtaaacccgttaaccccggtttaacggttaaccgggtttacccggggggtaaccgggggttacccgttaccccgggtaacccccgggttaccgggggggtaaccccggtaaaacgggggtaacccgttttaaccgggttccgggttaaccccgttaccccgggtttaaccccgttttacccggtttaaaccccgggtacccccttttaacccccgggaaaaccccgggtaaccccgggggtacccccgttaaaccgggtttccccccggggttttacccccgtttacccccccccgggttaccggggtaaccccccctttaaccccccccggttacccccgtttaacccccgtaaaaccggggtcccccgttaaacccccggg

SEQ ID NO: 138522 - DNA, 583 bp, Homo sapiens
  misc_feature: GYAE6OF01CKCGW.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcgggagaccctgtccctcacctgcgctgtctctggtgcctccatcagtagtggtttcttcgtggggctgggtccgcagctcccgaggggaaggggctggaatacattggaagtgtctctcatagtggaggttcctattacagtccgtctctcaagagtcgagtcaccatatctctggacacgtcagcaatctagttttccagaagatgagttctgtcgaccgccgctgacgacgggtctttattacgtgtgcgagacgacggtctattagtgttagttttggagttggtttatttcgtactacccgtagacgtcggacggggcctcggaccccgtcgggaccgagggtactacgtcggtcaccgttctccttacgccctaccgaccgacgggcccacgtccggtcccttccccgtcggtccctaccccgtcctcccgaagcgtacccg

SEQ ID NO: 138523 - DNA, 980 bp, Homo sapiens
  misc_feature: GYAE6OF01AHMR4.46.67.G01.1.454.CMB.1.raw
tcagactagcagtacacgaccggtgctcgatttagagtatacatattgggtttggggagtcgtcggtacaggaccacaggcatcggacatgagggtccccgctcagctcctggggctcctgctactctggcttccgaggtgccagatgtgacatcgagcctggacccagtctccatcctccgtgtctgcgaaccggtgggagacgaggtcgtccaaccgattccgaccgtttcggccggggacaaaggttccgggtaaacctagttttacggaacctaacctttaaagtttttaaaaacgtttgggtaacttaccaaaacgtaagttaaccggtacccggaagggggaccccgggtacccctaaaagggtccccttaccccgttaaaagttacccgttaacgttcgggtaccgttacggacctaacggtttacccgtaaggtttttacggaaccgtaaaacggggtttccgggggttaccccctaaggttaccgggtaacgggttttaccgaagggttcggggtaccgtaagggttacggggtaacttaccggggttaaggggtaacctaacggggttaacttttacccggaaaccctttcccgtaaccctaacccgtaaagttacccggtaaaacgggtttaaacttcccgttaacggtaacccggtaaaaccggttacgggttaaaacggtttacgtttttaacggaaccctttaaaaccgttttacgtttaaacccgtttacggtaaaccgttaaaacgtaaggttaaaactttaaccggtaaacgtttttcgggttttaaacccggaacccggttaaacggggtaaaccgtaaccggtaaaccttaaacgttaaaaccgtttaaacggtaacgtttagggtacgtaaccgttacggacccgtaaccgtagttaccgttacgttacccgtttacgaccgttttcccgttaccccggtactacgttccgtgttaaccg

SEQ ID NO: 138524 - DNA, 706 bp, Homo sapiens
  misc_feature: GYAE6OF01DH3D8.46.67.G01.1.454.CMB.1.raw
  modified_base (171)..(171): a, c, t, g, unknown or other
  misc_feature (171)..(171): n is a, c, g, or t
  modified_base (206)..(206): a, c, t, g, unknown or other
  misc_feature (206)..(206): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtncctccatcagtagtgttctcgtgggctgggtccgnagcctccgaggggagggctaggaatacagttggaagttgtctctcagtaggtggtacggttcctattacgagtccgtctctacaagtagtcgtagtccactatatctcgtcggacacgtccagactaatctacgttttccagaagtatgtacgttcgtgtcgacccgcgtcgtaggaccggtacgggttactttaacttacgtggtcggtacgaaggtacggtaggtcttaagtttacgtagttttaggtttttagggtaggttttaggtttacgtttaccgaccgtaacccgttaggtacggtaccggggtacggggtcctaccgggtaccccggtcggggaccggtaacgggtaacgttacgtcggtacctacccggttccttaccgtaccgtacccgtacccgtaacccggtaccgtacccgtacggttccccggttaccccttcccccggcgtaccccctaccccgttaccctaccgtaaacggcgtaccccccgg

SEQ ID NO: 138525 - DNA, 1002 bp, Homo sapiens
  misc_feature: GYAE6OF01BYAQR.46.67.G01.1.454.CMB.1.raw
  modified_base (155)..(155): a, c, t, g, unknown or other
  misc_feature (155)..(155): n is a, c, g, or t
tcagactagcagtacacgaccggtgctcgatttagagtatacatattgggtttgtcctcctgctggtggcagctcccagatgggtcctgtccctggtgcaactgcaggacgtcgggcccacgactggtgaggtccttcggagacccctgtccctnacctgcgctgtctctggtcgcctcatcagtagtggtttctcgtggggctgggtccgcagctccgaggggaagggtctaggaatacgagtttgggaacgttcgtcctacgtcagttaaggtgggtacggttcctaagttaccgtaacggttcccggttctaccgtaccgtaaaggtacggttcccggaaggttaccctaaccgtaacgttaacgttcccgtttaccgtacggggtaaccctaacccggttacccaacggtaccttaaaaccgttccgttaaaccggttttttcccccaggtaaacggtacgttacgggttaacggtttccgttacgggttaccgaccccggttacccggtaccggttaaccggaaacccgggttaccgggggtttaccgttttttaaacggtttaacccggttcggggttccggtaaccggggtaaacgggttaccgggtaaccggggttacctttaaacggttttaacggttggttttaaacgggttttttaggggaacgggttttacggttttaaccgtttttaccggaacccgttaaccccgtttaagggaccggtttaccggggtacccgggggttaccttacccggggtacccccgggttaacgggggtaccccgtaaagggggttaaccttaccgggtttacggggttaccccgtaacccgggtttcctttacccggttaccgggtacccccttaacccggtaaccccgggtaaaccgggtccccgttaacggtttccccgggttcccctttacccccccgggtacgtaccccccgttaacccctcccccggttaaaccgaacccggtaaccggtaccccgg

SEQ ID NO: 138526 - DNA, 609 bp, Homo sapiens
  misc_feature: GYAE6OF01DYTK0.46.67.G01.1.454.CMB.1.raw
  modified_base (332)..(332): a, c, t, g, unknown or other
  misc_feature (332)..(332): n is a, c, g, or t
  modified_base (336)..(336): a, c, t, g, unknown or other
  misc_feature (336)..(336): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctcatcagtagtggtttctcgtgggctgggtccgcagctccgaggggagggtttcaggaatacagttggaatgtctctcatagtggaggttcctattacagtccgtctctcaagagtcgagtcacctatatctctggacacgtcagcaatcagttttccngaanatgagttctgtcgaccgcgctcgacgacggtgtttatacgtgtacgcgagagtacggtacttagttagtgttagttttaggagtttggttatttccgaactacccgtagacgtcgggaacggggtcctccggaccccgtggggacccgaagggtaacttacgtcggtacctacccgtccttacccttacgtccctaccgacccgaacgggtccccacgttccggtacccttccccgaccggtcccaaccccgtcctacccgaagcgtaccccg

SEQ ID NO: 138527 - DNA, 679 bp, Homo sapiens
  misc_feature: GYAE6OF01A76TV.46.67.G01.1.454.CMB.1.raw
  modified_base (193)..(193): a, c, t, g, unknown or other
  misc_feature (193)..(193): n is a, c, g, or t
tcagactagcagtacacgaccggtgctcgatttagagtatacatattgggtttggggagtctcggtcaggacacagcatggacatgagggtccccgctcagctcctggggctcctgctactctggctccggaggtgccagatgtgacatcgagctgacccagtctccatcctccctgtctgcaaccgtggganacagtgtcaccatcacttgccggacaagtcggaacattcgactacgttaatttaaattcggtaatacgaactatacgaccagggaccgacccgtaagcctacctaatctatgctgctatccgtagtttgacgtaaggtcgggtacctagtccgtaaggttcaggtggacgagtggatcgtgggaactagtatttcgactctacacctagtactagtaacttcgtacgacgtacgtaggttaaagttattttacggtaacttaactttaacttacgtttaccggttaacctaaacgtaagtaaacttttaaccgtaagttttacgggtttaccgaaccggtaaacgggtaactaaaccggtaaccttaaacgtaaaacgttaaaccgtaacgtaggtacgtacgtagtaacccgtacttaacgtcctttcgttacccttccttaacgttccccgttacccgtaccttaacgttccgagtttaacccg

SEQ ID NO: 138528 - DNA, 676 bp, Homo sapiens
  misc_feature: GYAE6OF01BBMOL.46.67.G01.1.454.CMB.1.raw
  modified_base (192)..(192): a, c, t, g, unknown or other
  misc_feature (192)..(192): n is a, c, g, or t
tcagactagcagtacacgaccggtgctcgatttagagtatacatagttgggtttggggagtctcggtcaggacacagcatggacatgagggtccccgctcagctcctggggctcctgctactctggctccgaggtgccagatgtgacatcgagctgacccagtctccatcctccctgtctgcaaccgtgganacagtgtcaccatcacttgccgggacaaggtcggaacattcgactaccttaatttaaagttcggtactacaacagtacgaccgagggaccgccctaagcctactaactctatgtctgactactcctaggtttcgacgtaaaggtcgggtcccagtcgacggttcagtggactaggtcggaatcggtagggactagtactttccacgtctaccaactactacgtagtactcgtagacgtaagttcgtaaattacgtttacgactttaaactttacgttacttacggtaaccaaacgtaagttaaactttactaaacggttttcggttaaccggtaaccggtaaaggtacccgtaaaccggttaacttaaaaccgttaaacgttaaacggaacgttggtaacgggtcctaaccggtactaacccgtagtttacccttgttaccttaccgaacctttcccgtaccccgattacttcgtactaacccg

SEQ ID NO: 138529 - DNA, 540 bp, Homo sapiens
  misc_feature: GYAE6OF01BK48A.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacgccctaagctcctaatctatgctgcatccagtttgcaaagtgggtcccatcgaggttcagtggcagtgatcgtgggacagtattcactctcaccatcagtaatctgacaacgtgaagtatttgactaacttattactgtacaacagtaattactaagttcgttttacggacctaagggactaacgtaactaactaaattaaaccgaacgtgtagtactagacctaaccattcttgtccttacacttccttacccgacctacttccgtgtaac

SEQ ID NO: 138530 - DNA, 659 bp, Homo sapiens
  misc_feature: GYAE6OF01C8PX5.46.67.G01.1.454.CMB.1.raw
  modified_base (210)..(210): a, c, t, g, unknown or other
  misc_feature (210)..(210): n is a, c, g, or t
  modified_base (248)..(248): a, c, t, g, unknown or other
  misc_feature (248)..(248): n is a, c, g, or t
  modified_base (361)..(361): a, c, t, g, unknown or other
  misc_feature (361)..(361): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttggagaccctgtccctcacctgcgctgtctctggtncctcatcagttagtgtttctcgtggggctggggtccgnagccgtccgagggagggctggaatacgagttggaagtgtctctcagtagtggtacgttcctattacgtacgttccgtctctacaagtagtcgacgtcaccatatctctggacncgtcagacatctagtttccagaagtatagtagttctgtcgtacccgcgtacgacgtaccgtacgggttacgttttaagttacgttggttacggacggaggtacgggtacggtactttaagttagtttagtttaggtttttaggtacgggtttaggtttaacgtttaccggtacctacccgttaaggtacgtccgggtaccggggtctacccggtacccgggtggggtacccggtaagggtaaccttacggtacggttcccgtaacccggttccgtacccttccgcccgtaacccccgg

SEQ ID NO: 138531 - DNA, 597 bp, Homo sapiens
  misc_feature: GYAE6OF01B56UT.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggacaagtcggaacattgacacctatttaaattggtatcaacatacgaccgagggaccggccctaagcctactaatctatgctgacactctagtttagacgtaaaggtcggggtacccagtcggagttcgaggtggcgtaggtggagtcgtgggactaggtatttcactctcacatactagtatctagacaacgtagtaagttatttagttaactttattactagtacaaacgtaagtaattacgtaatttacggtttcgaacgtaaggacaagtaactaactaaataacgtatggtacgatacgacctaacgtactttacctacgtttaccttccgttaaccttcccgttaccccgaccttaagttccgttagttacctacg

SEQ ID NO: 138532 - DNA, 578 bp, Homo sapiens
  misc_feature: GYAE6OF01C0NDG.46.67.G01.1.454.CMB.1.raw
  modified_base (171)..(171): a, c, t, g, unknown or other
  misc_feature (171)..(171): n is a, c, g, or t
  modified_base (373)..(373): a, c, t, g, unknown or other
  misc_feature (373)..(373): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtncctccatcagtagtggtttctcgtggggctgggtccggcagcctcccgaggggaagggctaggaatacgagttggaagtgtctctcaagtagtggaggttcctattacagtccgtctctcaagagtcgagtcaccgatatctctgacacgtccagcaatctagtttccctagaagtatgagttctgtcgaccgccgctgacncgggtcgtttattactgtgcgagagacgctattatagtattttggagttgttagttcgacctacctagctcggacggggctccgaccccgtagggccgaagggtactacgtggtacctaccgtctccgttacgcctaccaccgaacggcccacgttccgttacccttccccgtcgtacccctacccttcccaccagacgtacccg

SEQ ID NO: 138533 - DNA, 599 bp, Homo sapiens
  misc_feature: GYAE6OF01CF1B5.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctggggtccgcagcctcccgagggaaggggctggaatacattggaagtgtctctcatagtggaggttcctattacagtccgtctctcaagagtcgagtcaccatatctctggacacgtccagcaatctagttttcccagaagtattgtacgtttctgtcgacccgccgtctgacgacgggtcgttttattacgtgtcgcgagacgcgcttattatgtattttggagtttggtttactttcgactacccgtagtacgtccgggaccggggtctcccggaccccggtgggggacccgtaaggggtaacttaccggttcggtaccctacccggttccttcccgttacgccccgtaaccccgg

SEQ ID NO: 138534 - DNA, 689 bp, Homo sapiens
  misc_feature: GYAE6OF01ED4WQ.46.67.G01.1.454.CMB.1.raw
  modified_base (296)..(296): a, c, t, g, unknown or other
  misc_feature (296)..(296): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtcgcctccatcagtagttggtttctcgtgggctgggtccgcagcctccgaggggagggctaggaatacagttggaagtgtctctacagtaggtggtaggttcctattacagttccgtctctacaagngtcgagtccaaccatactctacgtcgacctaccgtcaagtacaattccgtacgttttcccgagtaaagtactaggtacgttcgtaggtcgacccgtcctcgtagaaccgtacggggttcttttaacgtaacgtgtaggacggagtacggtacggtacttagtttaagtaggtttagtttttaggaggtttagttttagttacgtacctaaccgtagtacggtacgggaccgggtcctacccggtcccggtacggggaccgtaaggggtaacttaccggtcggttacccgtaaccgttcccgttaccgttaccgccctacccgaacgtaccggtccctacgttcccgttcccgttccccgcgtaccccacccttaccaccgaacgccgtacccg

SEQ ID NO: 138535 - DNA, 767 bp, Homo sapiens
  misc_feature: GYAE6OF01ENMZ6.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctgggctgggtccggcagctcccgaggggaaggggctaggaatacagttggaagtgtctctcatagtggaggttcctattacagtccgtctctcaagagtcgagtcaccatatctcgtggacacgtccagcaatctacgttttcccagaagtatgtagttcgtggtcgacccgtccgctcggaacgtaccggggtcgttttaacttaccgtgtcgacggtaggaacggtaccggtacgttaatttacgttaggtttaacgttttttgggtaaggttttacggttttaacgttttacccggaacccttaaccccgttaaggttaaccggttaccggggacccggggggtccttacccgggtaacccccggtcggggggaccccgtaaagggggtaacttaccgggttacgggttacccgtaccccgggttaccttacccgttacgcccccgttacccgaaaccccggtaaccggggtaccccctacggtttccccgggttaccccctttcccccccggtcgggtacccccaccccccgtttacccctaccccggaaacggtcccgtaacccccgg

SEQ ID NO: 138536 - DNA, 693 bp, Homo sapiens
  misc_feature: GYAE6OF01AU5UQ.46.67.G01.1.454.CMB.1.raw
  modified_base (237)..(237): a, c, t, g, unknown or other
  misc_feature (237)..(237): n is a, c, g, or t
tcagactagcagtacacgaccggtgctcgatttagagtatacatattggggtttggggagtctcggtcaggacacagcatggacatgagggtccccgctcagctcctggggctcctgctactctgggctccgaggtgccagatgtgacatcgagctgacccagtcctccatcctccctgtctgacaaccggtgggagacagtgtacaccatcgacttggccgggcaagtcggaactnttgacactatttaaatggtatacaacatacgaccagggaccgaccctaagctcctaatctatgctgcactccgtagtttgacgaaggtcggggtacccagtacggaggttcgtaggtcggacgaggtaggatcgtagggactaggtactttcactactacctactactactaagttaactccgtagacctaaacgtaggaaacgttattttacggacttaacgtttacttaacgttaggtacctaaacgtaaggttaacttaactaacggtttggttttaaccgggaaccggtaaacgggtaacctaaccggtaaacttaaaccgtaaaacgtttaaaaccggtaacgttagggttacggtaccgtacggtacctaaccgtaatttcgttacgtttacccttaacgttactttaccccgttacccgtacccgtttaacttccgttacgtaaacccg

SEQ ID NO: 138537 - DNA, 684 bp, Homo sapiens
  misc_feature: GYAE6OF01AU7M2.46.67.G01.1.454.CMB.1.raw
tcagactagcagtacacgaccggtgctcgatttagagtatacatattggggtttggggagtctcggtcaggacacagcatggacatgagggtccccgctcagctcctggggctcctgctactctggctccggaggtgccagatgttgacatcgagctgaccagtctccatcctccctgtctgcgaaccggtgggaggacagtcgtcaccatcacttggccggactagtcggaacattgactacttatttaaagttgtactacaacataacgaccgagggaccgaccctaagtcctacctaatctactcgctcggactacttccgtaggtttcgacggtaacggtcgggtacctagtcggtaagttcggaaggtggacgtagttacggacgttacgtacgggaactacggttaactttccacgttcctacaaccgtactacgtaagtactctaggaactaacggtaataagttagtttacgaactttaactttaacttacgtaacgtaacaacgtaacgttacttaaacgtagtttcgggtttaaccgaacggtaacgggtaaacctaacgtaacttaaactaaagtaaccgtacggttggacgtaccgtagtaacctaccttaggtcttaacttcgttaacctaccgtttaccctaccgtaccttagttacccgtggttaaccg

SEQ ID NO: 138538 - DNA, 670 bp, Homo sapiens
  misc_feature: GYAE6OF01CUXUQ.46.67.G01.1.454.CMB.1.raw
  modified_base (193)..(193): a, c, t, g, unknown or other
  misc_feature (193)..(193): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtggganacagtgtcaccatcacttggccggacaagtcggaacagttcgaccacttatttaaatggtaatcaacatagaccgagggaccgaccctaagctctaatctatgctgctatcctagtttcggactaaagggtcgggtaccctagtccggtaggttcgtaggtcggacgtaggtcggtaagtccggtagggaacctaggtacttttacccgaaccttcctacctaacctacgtaccgtaagttaacttccgtacgtaccgtaacgtagtaagttagtttacgtaaccttaactttacttaacgttacgtaactaacgtaagtaactttaactaacgtttcggtttaaccgaccggtaaaggtaacctaacgtaaaccttaaactaaaacgttaaccgtaacgttcggtacgactacgaccgtaactacttcgtacgttccttacctacttcccttacccgactacttccgtagtaaccg

SEQ ID NO: 138539 - DNA, 718 bp, Homo sapiens
  misc_feature: GYAE6OF01CPW04.46.67.G01.1.454.CMB.1.raw
  modified_base (221)..(221): a, c, t, g, unknown or other
  misc_feature (221)..(221): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaaccggtgggagacagtcgtcaccatcacgttggccggganaaggtccggaactagtttcgaacctaccttaattttaaagtggtaactcaaacatagaccgaaggggaccgaccctaagcctacctaaatctagtcgctagcctattcctaggtttcgacgtaaacgggttcggggtaccctagtcggtaggtttccgaaggttcggacgtaaggttgggaacttccggtagggtaacctaggtactttccactctacctacaacgttcgtaacgtaactcgtagactaacggtagtaaacgttatttacgaaccttaatttacgttacgttacgtaactaaacgtaagttaaactttaacgtaagttttccggttttaaccggaaccggttaaacgggtaacctaaccggtaaacttaaacgttaaaacgttaaccgtaaggttacggtcgtacgtaccgaccgtaaaccgtatttaccgtcgtttaccttaccgtactttccccgttaccccagttaccttagttaggttaaccc

SEQ ID NO: 138540 - DNA, 627 bp, Homo sapiens
  misc_feature: GYAE6OF01CI5FJ.46.67.G01.1.454.CMB.1.raw
  modified_base (292)..(292): a, c, t, g, unknown or other
  misc_feature (292)..(292): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggacaaggtcggaacattgactacctatttaaatggtatacaacatagaccgagggaccgccctagctcctaatctangctgcatcctagtttacgactaaaggtcgggtacccagtcgaggttcgagtggacaggtggatcgtagggactgtatttcactctacacatcaagtactctcgacgtaacgtagtaagttaacttttcgaacttaacgttaactttacgttgtaacctaaactaagttaaacttaacgtaaatttcggttttaaccggaaccgtaagggtaaaccctaacgtaacgtaaaactaaaacgttaacggtaaccgttgttacggactagtaccgaaccttaagttccgttgttacccttacgtaccttcccttacccgaccttacttacgtggttaac

SEQ ID NO: 138541 - DNA, 710 bp, Homo sapiens
  misc_feature: GYAE6OF01DMD47.46.67.G01.1.454.CMB.1.raw
  modified_base (332)..(332): a, c, t, g, unknown or other
  misc_feature (332)..(332): n is a, c, g, or t
tcagactagcagtacacgaccggtgctcgatttagagtatacatattgggtttggggagtctcggtcaggacacagcatggacatgagggtccccgctcagctcctggggctcctgctactctggctccggaggtgccagatgtgacatcgagctcgacccagtcctccactcctccctgtctcgcgaaccggtgggagacagtcgtccacctatccacgttcggccgggactaaggtccggaatacgttacgaactacctttaatttaaacgtggtacacaacagtacgaccgagggaccgtaccctaagtcctacctaatctatcgtacngcctaactccgtagtttagaccgtaaaggtccgggtacccagttccggtaggttcgaggttcggacgtaggtggacgttcggtagggtactaagttaccttcacgtcctacgacctataccgaagttactcgtacgacgtacgtagtattactttacgacttaacgttattacgtactactaacgtaagtaacttaacgtagttacggtttccggaacgtaacgggtaaccctaacgtaaaccttaaacgttaaaacttaaaccggtaacgttcgggtaaccgtacctacggtacccttaaccgtagtttcgttaccgtttaccttacgttacccctttacccgtacccgtaacccttcgttaaccttacggttaacc

SEQ ID NO: 138542 - DNA, 579 bp, Homo sapiens
  misc_feature: GYAE6OF01BOSUX.46.67.G01.1.454.CMB.1.raw
  modified_base (192)..(192): a, c, t, g, unknown or other
  misc_feature (192)..(192): n is a, c, g, or t
  modified_base (574)..(574): a, c, t, g, unknown or other
  misc_feature (574)..(574): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccgggcaagtcgaacattgactactatttaaatgtatacaacatagaccagggaccgaccctaagcctactaatctatgctgctatccgtagtttgacgtaaaggtcgggtacccagtcgagttcagtggcagtgtatcgtaggactagtactttcactctacaccatactaagtaatcgtagacgaacgttagtaactatttacgacttaaactttacttacttacgtactaaacgtaagtaacttaactaagtttggtttacccggacgtaaacggactaacgaaacttaacgaaacttaacgactggtacgtactagacactatacttcgttactactactcccttaccactacttcgtntaacg

SEQ ID NO: 138543 - DNA, 774 bp, Homo sapiens
  misc_feature: GYAE6OF01AGRWU.46.67.G01.1.454.CMB.1.raw
  modified_base (182)..(182): a, c, t, g, unknown or other
  misc_feature (182)..(182): n is a, c, g, or t
  modified_base (234)..(234): a, c, t, g, unknown or other
  misc_feature (234)..(234): n is a, c, g, or t
tcagactagcagtacacgaccggtgctcgatttagagtatacatattgggtttgtcctcctgctggtggcagctcccagatgggtcctgtccctggtgcaactgcagggacgtccgggcccacgactgggtgacggccttgggacgaccctgtccctcaccgtgccgtctgtctcgtggtcncctccatcgtaggttggttcggtttcttcggtggggtccgtcggggtccggnacgccgtaccggaggggtaacgggctaggaatcgtagttggagtcgttacctcgtacgtagttacggtcgggttacgttacccttaagttaccgtacgggttcccttcctacgtaacgaaggacgttaccggatccaacctattactcgtacgacggacctaccggtaccagtacctaacgttccgtttaacggtttccaaggtaagtacttcggtactttcgcggtacgacccgtcgtacggtacgtaacggtccgggttatttacgtcgagggtcgacgacggtagtacgtattagtttgtaggtttagtttcggtagtttacgtttactaccgtactaccgtaggtaccggtcgggtaccggcccgtacggtcccgggaacgggtacgtacgggtaacttccggtaccggtaccttcccgtacttacccgtaccgtaccctacccggaacccggtccggtacccttacgtccccggttaccccttcccgacccgtaccccttacccggtaccctacggaacccgtccgtaccccggg

SEQ ID NO: 138544 - DNA, 714 bp, Homo sapiens
  misc_feature: GYAE6OF01CLZFD.46.67.G01.1.454.CMB.1.raw
  modified_base (290)..(290): a, c, t, g, unknown or other
  misc_feature (290)..(290): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctcgtgggctgggtccggcagcctcccgaggggaaggggctggaatacagtggaagtgtctctcatagtggaggttcctattacagtccgtctctcaagngtcgagtcaccatatctctggacacgtcagacaatctagttttcccagaagtatgtagttctggtcgacccgccgtcgtcgaaccgaccggggtcgttttaagttacctggttacgcggaaggacggacggtacgttaagttagttcggttaagtttttgggtagtttgggtttactttacggtaacctaaccccgtagtacgtccggggaccggggtccgttcccgggaaccccggtcgggggacccgtaaagggggtaacttaccgttcgggtacccgtacccgttcccgttacccgtttaccggaccccgtcccgaaacccggtaaccgggtaccccgtaccggttcccgggttacccctttccccccgtacgggtcccctaccccccgttacccgtaccccgaaacggcccgtaccccgg

SEQ ID NO: 138545 - DNA, 600 bp, Homo sapiens
  misc_feature: GYAE6OF01EG23G.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgactaccttatttaaattggtatacaacatagaccgagggaccggccctaagcctacctaatctatgctgcatctagtttgacaaggtcgggtcccagtcgtaggttcaggtggcaggtgatcgtgggacagtactttcactctcaccatacaagtatcgtagactaacgtgtaagtatttgactaactttacgttactacgtacaaactagtaaatttacgtaatttcggtttaccgaccggtaaagggtacctaaccgtaacttaaactaaacgttaacgaacttgggtacgtacgtacgtaccaccgtattacgttcttaccgttacctaccttcccgttaccccgacttacgttccgtagtaaccg

SEQ ID NO: 138546 - DNA, 542 bp, Homo sapiens
  misc_feature: GYAE6OF01A9SR2.46.67.G01.1.454.CMB.1.raw
  modified_base (192)..(192): a, c, t, g, unknown or other
  misc_feature (192)..(192): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccgggcaagtcggaacattgacacctatttaaatggtatcaacatagaccagggaccgccctaagctcctaatctatgctgcatccagtttgacaaagtgggtcccatcgagttcagtggcagtggatcgtgggacagtattcactctacacctatactagtaactctagacaacgtgaagtattttagacttaaactttattactgtaaccaactaagtaaattactaagtttgtttaccggaccgtaagggactaacgtaactaataaacgttaaacgaacttggtacgctagcactatctctcttcacttcttcccgactatctgtac

SEQ ID NO: 138547 - DNA, 664 bp, Homo sapiens
  misc_feature: GYAE6OF01CPYUC.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtgggagacagtgtcaccatcacttggccgggcaaggtcgaacattgacacttatttaaattgtatacaacatagaccaggacgccctaagctcctaatctatgctgcatccagttgacaagtcgggtcccatcgagtcagtgcagtgatcgtgggacagtatttcactctacgactacactagtaatcgttacgaccgtaaacggttagaaacgttagttttgaactttaactttaacgtttacgtacgttaacgaaactaagtaaactttaacgtaagttttacggtttttaccggaaccgtaaacggggtacctaaaaccgggttaacttaaaaccgtaaaacgtttaaacccgtaaagttccggttaacggtaccgttacggaacccttaaacccgtaacgtttacctttcggttaccttaccgttaaccgttacccctttaccccggtacctaaccgttcttaacggttaacc

SEQ ID NO: 138548 - DNA, 524 bp, Homo sapiens
  misc_feature: GYAE6OF01A4ANM.46.67.G01.1.454.CMB.1.raw
  modified_base (518)..(518): a, c, t, g, unknown or other
  misc_feature (518)..(518): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacgccctaagctcctaatctatgctgcatccagtttgcaaagtcgggtcccatcgaggttcagtggcagtggatcgtgggacagatttcactctcaccatcagtaactctgcaacgtgaagtattttgactaactttattactgtacaactagtaatttacaattgtttcgaccgtaaggactaacgaactaacaaataacgaactgtagctacgctacctatctgttctctactccttacccgcctacttntcgtac

SEQ ID NO: 138549 - DNA, 632 bp, Homo sapiens
  misc_feature: GYAE6OF01CS0AG.46.67.G01.1.454.CMB.1.raw
  modified_base (218)..(218): a, c, t, g, unknown or other
  misc_feature (218)..(218): n is a, c, g, or t
  modified_base (256)..(256): a, c, t, g, unknown or other
  misc_feature (256)..(256): n is a, c, g, or t
  modified_base (260)..(260): a, c, t, g, unknown or other
  misc_feature (260)..(260): n is a, c, g, or t
  modified_base (319)..(319): a, c, t, g, unknown or other
  misc_feature (319)..(319): n is a, c, g, or t
  modified_base (518)..(518): a, c, t, g, unknown or other
  misc_feature (518)..(518): n is a, c, g, or t
  modified_base (591)..(591): a, c, t, g, unknown or other
  misc_feature (591)..(591): n is a, c, g, or t
tcagactagcagtacacgaccggtgctcgatttagagtatacatattgggtttgtcctcctgctggtggcagctcccagatgggtcctgtccctggtgcaactgcaggagtccgggcccacgactggtgaggccttcgggacgacccctgtcccctcacctgcgctgtctctggtcgcctccatcgagtagttggtttctcgtggggctgggtccgcncgcctccgaaggggagggctggaatcagttggatgtcncgtnagtgtggaggttcctatactagtcccgtctctcaagtcgtcgagtccaaccattatctntacgactaccgtcagacatctacgttttccagaagtctgattctggtcgacccgtcgcctggaaccctcggggtacttttacgttacctgtacgcgaagacgtaccggctttaagtattgttacgttttggagtttgttacttcgaacctaccgtagcgtcgggtacggtcctccgtaccgcgggtacagggtaatcgngttcctacggtccttaccgtacgcccgtccaaccggtaccggccctacggttcccggtacccgttccccccgnggtacccctaccccgttcccgaacccgaacgtccgtacccg

SEQ ID NO: 138550 - DNA, 659 bp, Homo sapiens
  misc_feature: GYAE6OF01DAIUR.46.67.G01.1.454.CMB.1.raw
  modified_base (221)..(221): a, c, t, g, unknown or other
  misc_feature (221)..(221): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaaccgtgggagacagtgtccaccatcacgttggcccggganaagtcggaactattacgactaaccttaatttaaattggtatacaacatagaccgagggaccggaccctaagcctacctaatctatgctgcatcctagtttcgacgaaggtcgggtacccagtcgtaggttcaggtgacaggtgtatcgtgggactagtactttaccacttctacacctatactagtaactcgtacgaacgtaacggtagtaacgttattttacgaacttaacttttattacctacgtaactaacgtaagttaaacttactaagtttcggtttaaccggaaccgtaacgggtactaaccgtaaacttaaactaaaacgtttaaacgaaccgttaggttcggaccttacgacccgtaacctaactttcctttacgttacctttaccgtacctttaccccgttaccccgtacttacgttcgttaggtaacc

SEQ ID NO: 138551 - DNA, 743 bp, Homo sapiens
  misc_feature: GYAE6OF01AW4L0.46.67.G01.1.454.CMB.1.raw
  modified_base (218)..(218): a, c, t, g, unknown or other
  misc_feature (218)..(218): n is a, c, g, or t
  modified_base (229)..(229): a, c, t, g, unknown or other
  misc_feature (229)..(229): n is a, c, g, or t
tcagactagcagtacacgaccggtgctcgatttagagtatacatattgggtttggggtagtcgtcggtcaggacacagcatggacatgagggtcccgctcagctcctgggctcctgctactctggctccgaggtgccagatgtgacatcgagctgacccagtctccatcctccctgtctgcaaccgtgggagacagtgtacaccatcacttgccgggnaagtcggaacnttgactacctatttaattgtatcaacatagaccaggacgccctaagctccgtaatctatgctgcatccagttgcaaagtcggggtaccagtcgtaggttctaggtcggcaggtgatcgtgggactagtagtttcacgttctaccgactactctaagtaactacgtacgaccgtaacgttagaaagtacgttttagaaccgttaacgtttaacttttaaccgttagtaaccgttaactaaacggtaaactttaaacgttaacgttttagttttacccgggtaaacttaaaccgggggtaacctaaccggttaaaccgttaaaccgtttaaaacgtttaaaaacccggtaaacgttaacgggttacgggtaaccgtttaacccgggtaaccgtaaaccccggttaattacccggttaaacgttttcccgtttaacccggttaaaccctttaaccccgttttaccccccccggtaaacctttaccccttaaaccggttttccggttaaaaaccccgg

SEQ ID NO: 138552 - DNA, 600 bp, Homo sapiens
  misc_feature: GYAE6OF01DYA7K.46.67.G01.1.454.CMB.1.raw
  modified_base (191)..(191): a, c, t, g, unknown or other
  misc_feature (191)..(191): n is a, c, g, or t
  modified_base (213)..(213): a, c, t, g, unknown or other
  misc_feature (213)..(213): n is a, c, g, or t
  modified_base (221)..(221): a, c, t, g, unknown or other
  misc_feature (221)..(221): n is a, c, g, or t
  modified_base (368)..(368): a, c, t, g, unknown or other
  misc_feature (368)..(368): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaaccggtgganacagtgtcacatcactgccggnagtcgacntcgacacttattaagtgtatacaacagtacgaccgagggaccggtccctaagcctactaatctatgactgactatccgtagttcgagtaacggtcgggtaccagtcggtagttacaggtggcgtaggtggactcggtaggactagtnttcgactctacacctatcgtaacgtaatcgtacgactagtagtagttatttacgacttatttacgtactacgtaacaacgtaataacttaacgtatttcggttaccgaacgtaaggacctaacgtaactaaacgtaaacgtaaccgtagtcggtagtccgtacgaccgtacctacgtttactcggttaccttacgacctttccccgtacccgacttaacttcgtacgtaacg

SEQ ID NO: 138553 - DNA, 592 bp, Homo sapiens
  misc_feature: GYAE6OF01DPRF3.46.67.G01.1.454.CMB.1.raw
  modified_base (377)..(377): a, c, t, g, unknown or other
  misc_feature (377)..(377): n is a, c, g, or t
  modified_base (403)..(403): a, c, t, g, unknown or other
  misc_feature (403)..(403): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagttagtggtttcttcgtggggctgggtccgcagcctccgagggaaggggctggaatacattggaagtgtctctcatagtggaggttcctattacagtccgtctctcaagagtcgagtcaccatactctcgtggacacgtcagcaatcagttttcccngaagatgtagttctgtcgaccgccgngtacgacgaccgggtcttttacgttactgtgtcgaagacggtacggtcttaagtttagtgttagtttttggaggtttggtttatttccgactaccgtagacgttacggaccggggtctccggtaccccgtggggtaccaggggtaacttacgtcggtcctacccgttcttcccttagccccgtaccccg

SEQ ID NO: 138554 - DNA, 757 bp, Homo sapiens
  misc_feature: GYAE6OF01AILU4.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggaccgccctaagctcctaatctatgctgcactccagtttgactaaaggtcgggtacccagtcggaggtttacgaggttcggactaggtggtatcgtaggggaactaggtacttttcgacctccttaccaacctacttctaaacggttaactcgttagaccgtaaacggttagtaaacgtttagtttttacggaacctttaaactttaacttttaaccgttacggttaaccctaaaacgtaacgttaaacttttaaaccgtaaagttttacgggtttttaacccgggaaccggtaaaacggggtaacctaaaccggttaaaccttaaaaccgttaaaaacgtttaaaaccggtaaaccggtttacggttaacgggtaccgttaacggtaaacccgtaacccgttaatttacccgtttacggtttacccttttacccgtaaacgtttccccgtttacccccgtacccttaacgttccgtttaacggttaaaccg

SEQ ID NO: 138555 - DNA, 892 bp, Homo sapiens
  misc_feature: GYAE6OF01CNCU9.46.67.G01.1.454.CMB.1.raw
  modified_base (216)..(216): a, c, t, g, unknown or other
  misc_feature (216)..(216): n is a, c, g, or t
  modified_base (247)..(247): a, c, t, g, unknown or other
  misc_feature (247)..(247): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggacgaccctcgtccctcacctgccgctgtctcgtggtcgccctccatcagtagttggtttctcgtggggctgggtccgnagcctccgaaggggaaggggctaggaactanagttggaagttgtctctagaagtaggtgggtaaggtttcctatttaaccgagttcccgtctacctacgaaaggtagtacggagttaccaccaattactccgtctacggaccaccggtaccaaggtacctaaagtttccgtaacgttttttccccgaaggaaacgtaagttcggtaaacgtttcgtttacggtaccggtacccggcccgtaccgtagggtaaaccccggtacgggggtttaccttttttaaacgtaccgttgggtaggtaccggaaggacggtacggtacttaagttagttaggtttaagttttacgggtaaggtttacggtttaacgtttaccgtaaccgtaacccgttaggaccggtaccggggaaccgggggtacccgtacccggtaacccccgggtcgggggtacccggtaaacggggtaacgttacgtaccgggttaccgtaccccggttcccgttaaccgttacccggacccccgtttaaccccgaaaccccgggtaaacccggggtacccccgttaacccggtttcccccggggtttaccccccgtttccccccccggttacggtaacccccccgtaacccccgttacccccgttaaccccgaaaccgggtaacccgtaaccccccggg

SEQ ID NO: 138556 - DNA, 603 bp, Homo sapiens
  misc_feature: GYAE6OF01C0PI1.46.67.G01.1.454.CMB.1.raw
  modified_base (223)..(223): a, c, t, g, unknown or other
  misc_feature (223)..(223): n is a, c, g, or t
  modified_base (427)..(427): a, c, t, g, unknown or other
  misc_feature (427)..(427): n is a, c, g, or t
  modified_base (547)..(547): a, c, t, g, unknown or other
  misc_feature (547)..(547): n is a, c, g, or t
  modified_base (563)..(563): a, c, t, g, unknown or other
  misc_feature (563)..(563): n is a, c, g, or t
  modified_base (590)..(590): a, c, t, g, unknown or other
  misc_feature (590)..(590): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatccctccctgtctgccaaccggtgggacacagtgtcaccatcacgttggaccgganaaggtcggaactgttacgactaccttaatttaaatggtatacaactatacgacgagggaccgaccctaagctaccgtaatctatcgctgaccatcctagttcgactaaggtcggtccagtcgagtcaggtgcgagtacggatcgtaggactagtacttccactcgtacacgtatactaagtactctacggctaacgtgaagttnttacgactaattactacgtcgtaactaagtacttaaacgttactaagtttaccggttacggaacgtaaccgggtaactaacgtaaacgttaacttaaagtaaccgacgtgttagaccgtnaaccgtacctattacncgttactacccttacgtccttacccgntactcgtagtacc

SEQ ID NO: 138557 - DNA, 638 bp, Homo sapiens
  misc_feature: GYAE6OF01BS2WL.46.67.G01.1.454.CMB.1.raw
  modified_base (221)..(221): a, c, t, g, unknown or other
  misc_feature (221)..(221): n is a, c, g, or t
tcagactagcagtacacgaccggtgctcgatttagagtatacatattgggtttgggggagtctcggtcaggacacagcatggacatgagggtccccgctcagctcctggggctcctgctactctggctccgaggtgccagatgtgacatcgagctgacccagtctccatcctccctgtctgcaaccggtgggagacagtgtcaccatcacgttggccgganaaggtcggaacattcgactaccttatttaaatggtatcaacatagaccgagggacggtaccctaagctactaatctatgtactgacactacctagtttagacgaaacggtcgggtacccagttcggtaggttcgaggtcggacaggtcggtagtcgtagggacagtattcgtactctacaccgatacgaagttactcgtgactaacgtagaagtatttcgaactattacttacgtagtactaaactagtaattaactaagtttcggtttaccggaacgtaagggtaacctaacgtaaccgtaaataaaacgttaaaccggtaacgttagacggtaccttacggacctaacccgtattaccgttgttaccgttactacgtttccctaccccggtactaacttccggttacgttaaccg

SEQ ID NO: 138558 - DNA, 610 bp, Homo sapiens
  misc_feature: GYAE6OF01BYV4N.46.67.G01.1.454.CMB.1.raw
  modified_base (209)..(209): a, c, t, g, unknown or other
  misc_feature (209)..(209): n is a, c, g, or t
tcagactagcagtacacgaccggtgctcgatttagagtatacatattgggtttggggggagtctacggtcgaggacacagcagtggacatgaggtccccgctcgagctcctgggctcctgctactctggctccgaggtgccagatgtgaccatcgagcctgacccagtcctccatccctccctgtcctggccaaccgtgggacacagtntccaccatccacttgccggacaagtaccggaacattgacacttatttaaagtgtatcaactatagaccaaggaccgaccctaagcctaacctaactactatgctgtcagtccagtttgacaaggtcgggcccagtcggagttcagtgcagtgtatcgtggacagtacttcgactcaccaccgtactcaagtaactctacgctaacggtagtaacgtagttttcggacttaacttagttaccgtagtaactaaactagttaaacgttactaagttttcgtttaccggaaccgtaagggtacctaaacggtaacttaaacgtaaacgttaaacggagttaggtacggtacacggacctaacgtatacgttgtcctacacgtcccttaccgctactccgtgtac

SEQ ID NO: 138559 - DNA, 621 bp, Homo sapiens
  misc_feature: GYAE6OF01EBUSQ.46.67.G01.1.454.CMB.1.raw
  modified_base (228)..(228): a, c, t, g, unknown or other
  misc_feature (228)..(228): n is a, c, g, or t
tcagactagcagtacacgaccggtgctcgatttagagtatacatattggggtttggggagtctcggtcaggacacagcatggacatgagggtccccgctcagctcctggggctcctgctactctggctccgaggtgccagatgtgacatcgagctgacccagtctccatcctccctgtctgcaaccggtgggagacagtgtcaccatcacttcgcggcaagtcgaacntgactacttattaaatgtatcaacatagaccagggacgccctaagctacctaatctatcgctgcatccgtagtttgacgtaaaggtcgggtacccaagtcggaaggttcaggtggacagttggatcgtgggacagtattacactctacacatcaagttaatctagactaacggtgtaaacgttagttttacgaacctaaacttttacttaacttacgttaacaaacctaaggttaaactttaaactaaggttttacggttttacccggaaccgaaacgggtacctaaacggtaaacctaaagttaaaacgttaaaacgacgtttacggtagtactacggacctaacgtaactcttagtcttacacgttcccgtacccacttactcgtagtaac

SEQ ID NO: 138560 - DNA, 596 bp, Homo sapiens
  misc_feature: GYAE6OF01C59WR.46.67.G01.1.454.CMB.1.raw
  modified_base (191)..(191): a, c, t, g, unknown or other
  misc_feature (191)..(191): n is a, c, g, or t
  modified_base (216)..(216): a, c, t, g, unknown or other
  misc_feature (216)..(216): n is a, c, g, or t
  modified_base (250)..(250): a, c, t, g, unknown or other
  misc_feature (250)..(250): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaaccgtggganacagtgtcaccatcacttgccgggnaagtcggaactatgacactatttaatgtatcaanatagaccgaggaccgccctaagctcctaatctatgctgcatcctagtttgacaaaggtcgggtacccatccggaggttcaggtggcgtagtgaagtcgtagggatagtatttcactctcacgtatacctaagttaactctacgtactaacggtagaacgttatttacgaacttaactttaattactacgtactaaactaagtaaattactaagttggtttacggaaccgtaaggtactaacgtaactaaactaaacgttaaacgaacttaggtacggcttacggacctaacctattcgttcgttacttacctacttcccttacccgaccttactcgttacgtaacg

SEQ ID NO: 138561 - DNA, 576 bp, Homo sapiens
  misc_feature: GYAE6OF01A0674.46.67.G01.1.454.CMB.1.raw
  modified_base (211)..(211): a, c, t, g, unknown or other
  misc_feature (211)..(211): n is a, c, g, or t
  modified_base (326)..(326): a, c, t, g, unknown or other
  misc_feature (326)..(326): n is a, c, g, or t
  modified_base (383)..(383): a, c, t, g, unknown or other
  misc_feature (383)..(383): n is a, c, g, or t
  modified_base (416)..(416): a, c, t, g, unknown or other
  misc_feature (416)..(416): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtncctcatcagtagtgtttctcgtggggctgggtccgcagctccgagggagggctggaatacagttggaagtgtctctcataggtggagttcctattacagttccgtctctacaagngtcgagtcacatatctcgtagacacgtccagactaatcgtacgttttcccagaagtntgtacgttctgtcgaccgcgctagacgtcggtntttatcgtgtgacgagagcgtactagttagtgttagttttggagtttggtttacttacgactaccgtaggacgtaccgggaccggggtcctcccgggacccggttgggggacctagggtaactcgtcggtacctaccgttctaccgttcgccctaacccg

SEQ ID NO: 138562 - DNA, 559 bp, Homo sapiens
  misc_feature: GYAE6OF01ED55K.46.67.G01.1.454.CMB.1.raw
  modified_base (246)..(246): a, c, t, g, unknown or other
  misc_feature (246)..(246): n is a, c, g, or t
tcagactagcagtacacgaccggtgctcgatttagagtatacatattgggtttgggggacctcctgtgcaagaacatgaagcacctgtggtttgtcctccttctggtggcagctcccagatgggtcctgtccctggtgcaactgcaggagtcgggcccagactggtgaggccttcggagaccctgtccctcacctgcgctgtctctggtgcctcatcagtagtggtttctctggggctgggtccgnagctccgagggaagggctggaatacattggaagtgtctctcatagtggaggttcctattacagtccgtctctcaagagtcgagtcaccatatctctggacacgtccagcaaatcagttttcccagaagattgagttctgtcgaccgccgctgacgacgggtcgtttaattactgtgcgagacgacggcttattatgtatttttggagttggtttatttcgactacccgtagacgtcggacggggtctccggaccccgtggggcccagggaactacgtggtacctaccgtcttaccttcgccctccgaacccgg

SEQ ID NO: 138563 - DNA, 632 bp, Homo sapiens
  misc_feature: GYAE6OF01B1PLO.46.67.G01.1.454.CMB.1.raw
  modified_base (193)..(193): a, c, t, g, unknown or other
  misc_feature (193)..(193): n is a, c, g, or t
  modified_base (230)..(230): a, c, t, g, unknown or other
  misc_feature (230)..(230): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtggganacagtgtcacatcacttggccgggacaagtcggaacnttcgactaccttatttaaaattggtaatacaacatagaccagggaccggccctaagctacctaatctatgctgcatcctagtttagacaaaggtcgggtaccagtccgagttcgagtggcaggtgatcgtgggacagtattcactctcaccatcaagtactctagacaacgttagtaattagtttacgactaaactttattaacgttctaactaacaagttaaactttaacgtaagtttacggttttaccggaaccgtaaacgggaaccgtaaccgtaaaccttaacgtaaaacgttaaccgtaacgttacggtaggaccttacgaccgtaaccttaattccgttaccttactttaccaccgtttcccttacccccgtaccttacgttaccgtcgttaaccg

SEQ ID NO: 138564 - DNA, 686 bp, Homo sapiens
  misc_feature: GYAE6OF01DRFEW.46.67.G01.1.454.CMB.1.raw
  modified_base (251)..(252): a, c, t, g, unknown or other
  misc_feature (251)..(252): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtcctggtgcaactgcgaggagtccgggcccacgacgtgggtgaggccttcggacgaccctgtccctcacctgcgctgtctctggtcgcctccatcagtgtgtttctcgtgggctgggtccgnngcctccgagggaagggcgtggaatacagttggaagtgtctctcataggtggtacggttccttattacgtacgtcccggtcttctacaagtagtcgagtcaacctatactcctctacggactaccgccaagacaactcgtaccgtttttcccctagtaaacgtagtaggtacgtttcgtcgttcggaaccccgtcccggtcgttacggtaacggtaccggggttcgttttacgttaacttggtcggtacggtagacggtacggtactttaagttacgttggtttaagtttttgggtagttaggttttacgtttcggaacctaccgtagtaccggtcgggaccgggtcgtcccggtacccggtcgggggtaccgtacggggtacttaccggtcggtaccgtacccgttccttacccgttccgcccgtaacccccgg

SEQ ID NO: 138565 - DNA, 570 bp, Homo sapiens
  misc_feature: GYAE6OF01EX4AR.46.67.G01.1.454.CMB.1.raw
  modified_base (227)..(227): a, c, t, g, unknown or other
  misc_feature (227)..(227): n is a, c, g, or t
  modified_base (285)..(285): a, c, t, g, unknown or other
  misc_feature (285)..(285): n is a, c, g, or t
  modified_base (360)..(360): a, c, t, g, unknown or other
  misc_feature (360)..(360): n is a, c, g, or t
  modified_base (382)..(382): a, c, t, g, unknown or other
  misc_feature (382)..(382): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggacacagtgtcaccatcacttgccgggcaagtcgaacntgacactatttaaattgtatcaacatagaccagggacgccctaagctcctaatctatnctgcatccctagttttgacgtaaaggtcggggtccctagtcgtaggtttcaggtggcagtggatcgaggacagtntttcactctcaccatcaattanctgacaagtagaagtatttgactaacttattactagtacaatagtaattaactaatttcggtttacgacgaaaggtacaacgtaactaaactaaattaaacgaacttggtagtaccgtagtaccacctaattcgttcgttaccttaccgtactttccgttaccccgtattaccttcttcgttaaaccg

SEQ ID NO: 138566 - DNA, 543 bp, Homo sapiens
  misc_feature: GYAE6OF01ANOQC.46.67.G01.1.454.CMB.1.raw
  modified_base (331)..(331): a, c, t, g, unknown or other
  misc_feature (331)..(331): n is a, c, g, or t
  modified_base (443)..(443): a, c, t, g, unknown or other
  misc_feature (443)..(443): n is a, c, g, or t
  modified_base (449)..(449): a, c, t, g, unknown or other
  misc_feature (449)..(449): n is a, c, g, or t
  modified_base (474)..(474): a, c, t, g, unknown or other
  misc_feature (474)..(474): n is a, c, g, or t
  modified_base (480)..(480): a, c, t, g, unknown or other
  misc_feature (480)..(480): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagttggtttctcgtggggctgggtccggcagcctccgaggggaggggctggaatacgattggaagtgtctctcatagtggaggttcctattacagtccgtctctcaagngtcagtcacatatctctggacacgtcagcaatctacgttttcccagaacgtatgtacgtttctggtcgaccgccgtctgaccgtagggtctttattcgtgtgcgagagcgtnttagtntgtagtttggagttgttattcgacncgtagngtcggacgggtctcggtccggtgggccgtagggactcgtgtcctacgtcctcgtcgcctaccg

SEQ ID NO: 138567 - DNA, 631 bp, Homo sapiens
  misc_feature: GYAE6OF01EG0JS.46.67.G01.1.454.CMB.1.raw
tcagactagcagtacacgaccggtgctcgatttagagtatacatattgggtttggggagtctcggtcaggacacagcatggacatgagggtccccgctcagctcctgggggctcctgctactctggctccgaggtgccagatgtgacatcgagctgacccagtctccatcctccctgtctgcaaccgtgggagacagtgtcaccatcacttgccggcaagtcggaacattgacacctatttaaatggtatcaacatagaccagggaccggccctaagctacctaatctatgctgcatccgtagtttgacaaaggtcggggtacccagtacgtggttacaggtcggactagtggatcgtagggacagtactttcactctcacatcagtaatcgtagactaacgtagaagtatttgactaacttattaactgtactaacgtaataactttaataagtttacggttttaccggaaccgtaaagggtaacctaaaccgtaacttaaactaaaacgtttaaaacccggaagtttacggtacggtacgtacggaccctaaccgtattctttacggtttaccctttaaccacctttaccccgttacccccgtacccttaacttcctaacggttaaccg

SEQ ID NO: 138568 - DNA, 565 bp, Homo sapiens
  misc_feature: GYAE6OF01BVHPO.46.67.G01.1.454.CMB.1.raw
  modified_base (437)..(437): a, c, t, g, unknown or other
  misc_feature (437)..(437): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatgtatcaacatagaccagggaccgccctaagcctacctaatctatgctgcatccagtttcgacgtaaaggtcggggtacccagtcggtaggttcaggtggactaggtggatcgtgggacagtattcactctcacatacgagtaactctgactaacgtagaagttatttagacttaacttattactagtacaanataattaactaagttcggtttacgaccgtaacggaactacgtaacttaaactaaacgttaaaccgaactgtacgtctacgacctactatctgttccttactacttccttacccgacctactctgtaac

SEQ ID NO: 138569 - DNA, 651 bp, Homo sapiens
  misc_feature: GYAE6OF01EFQ0L.46.67.G01.1.454.CMB.1.raw
  modified_base (234)..(234): a, c, t, g, unknown or other
  misc_feature (234)..(234): n is a, c, g, or t
  modified_base (247)..(247): a, c, t, g, unknown or other
  misc_feature (247)..(247): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctcatcagtagtgtttcttcgngggctgggtccgnacgctacccgagggaagggctggaatacgagttggaagtgtctctcgagtagtggaggtttcctattacgagttcccgtctctcgaagagtcgagtacaccatactctcgtggaccacgtccagcaatctacgtttcccagaactatgtacttcgtgtcgacccgcgtcgtgaccgacgggttacgtttatacgttggtgacgagtacgacggtctttaagttagtcgttagtttttggaggtttacgtttaactttccggacttacccggtagtaccgtacgggtaccggggtccttacccggtaccccggttcgggggacccgtaaaggggtaacttacccgtacgggttacccgtacccggtttacctttaccccgttaccgtccccgttaaacccccggg

SEQ ID NO: 138570 - DNA, 703 bp, Homo sapiens
  misc_feature: GYAE6OF01DWQUQ.46.67.G01.1.454.CMB.1.raw
  modified_base (203)..(203): a, c, t, g, unknown or other
  misc_feature (203)..(203): n is a, c, g, or t
  modified_base (235)..(235): a, c, t, g, unknown or other
  misc_feature (235)..(235): n is a, c, g, or t
tcagactagcagtacacgaccggtgctcgatttagagtatacatattgggtttgggggagtctcggtcaggacacagcatggacatgagggtccccgctcagcctccgtggggctcctgctactctggctccggaggtgccagatgtgacatcgagctcgacccagtcctccactccctccctgtctgccgaaccggtggganacagtcgtaccaccatcacgttcggccggganaaggtacggaacattagacctaacttaattttaagtgtatacaacatacggaccgagggaccgaccctagcctactaatctatcgctgctactcctagtttacgagtaacgggtcgggtacccagtcggtaggttcagggtggacgtaggtggacgttcggacgggactagtactttcacttcctacaccagttacgtaagtaactcgtacgacgtaacgttagaaagtttactttacggacttaactttacttactacgttaacaaactaagtaaactttaacgtaagttttaccggttaccggaaccggtaaacggtacccgtaaaccgttaaaccttaaaacgtaaacgttaaaccggtaacgttggttaccggacctacgtaccgtaacctagtttaccgttcttacccgttaactaccgtttacccccttcccggtaaccttacgtttaccgtgttaaacccg

SEQ ID NO: 138571 - DNA, 653 bp, Homo sapiens
  misc_feature: GYAE6OF01E521J.46.67.G01.1.454.CMB.1.raw
  modified_base (218)..(218): a, c, t, g, unknown or other
  misc_feature (218)..(218): n is a, c, g, or t
  modified_base (253)..(253): a, c, t, g, unknown or other
  misc_feature (253)..(253): n is a, c, g, or t
  modified_base (503)..(503): a, c, t, g, unknown or other
  misc_feature (503)..(503): n is a, c, g, or t
tcagactagcagtacacgaccggtgctcgatttagagtatacatattgggtttgggggacctcctgtgcaagaacatgaagcacctgtggtttgtcctcctgctggtggcagcctcccagatgggtcctgtccctggtgcaactgcaggagtcgggcccacgactggtgaggtccttcggacgaccctgtcccctcacctgccgctgtctcgtggtcncctcatcagtgtggtttctcgtgggctgggtccgnacgctcccgagggagggctaggaatacataggaagtcgtctctcgatggtggtacggttccttattactacgtccgtctctacaagagtcgacgtccacattactctcgcggactacgaccacgctaactcgtacgtttttcccaggtaagtacgtaggtcgtttacgtcggtccggaccccgtcccgtacgtacggtacggtaccgggttacgttttaacttacgtggtacggacgacggaggtacgtntttagttagttgttaagtttggtagttacgtttacttaccgacctaccgtagtacggtccgggacggggccctaccgggtcccgtaggggaaccgtaggtacgttacggtcggtacccgaccgttcctacccgttcgcccgtaaccccgg

SEQ ID NO: 138572 - DNA, 611 bp, Homo sapiens
  misc_feature: GYAE6OF01EPCJ1.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtgggagacagtgtcaccatcacttgccggcaagtcgaacattgacactattaatgtatcaacatagacagggacgccctaagctcctaatctatgctgcatccagtttgacgtaaagtcgggtacccagtcggtagttcagtggcaggtggatcgtgggactagtactttcactcgtcaccatacaagtaatctgactaacgtgaattatttagactaacgtttatactgtacaaactaagtaatttaactaagtttcggtttaccggaactaaacgggtactaacggtaaacttaaacgtaaaagtttaaaccgaacgttcggttacggtaccgttaacgacctaacccgtaagttaccgttacgttaccttaccgtaaccgtttcccttaccccggaccttaacttcgtaacggttaaaccg

SEQ ID NO: 138573 - DNA, 595 bp, Homo sapiens
  misc_feature: GYAE6OF01BMJCC.46.67.G01.1.454.CMB.1.raw
  modified_base (291)..(291): a, c, t, g, unknown or other
  misc_feature (291)..(291): n is a, c, g, or t
  modified_base (580)..(580): a, c, t, g, unknown or other
  misc_feature (580)..(580): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagttggtttctcgtgggctgggtccgcagcctccgagggaagggctaggaatacagttggaagttgtctctcagtagtggaggttcctattacagtccgtctctcaagngtcgagtcacatatctctggacacgtccagacaatccagtttttccccagaagattgtagttctgtcgacccgccgctcgacacgggtcttttagttactgtgcgagtacggacggctagttactgttacgtttttggagttaggtttctttacgacctacccgtagacgtcggacgggcctaccggccccggtggggcccgaagggtaactcgtcgtaccaccgttctccgtacgccaccgaccgacggtcccagttcccgtccgttccccgcgtcccacccctaccnccaacgtcgtacccg

SEQ ID NO: 138574 - DNA, 672 bp, Homo sapiens
  misc_feature: GYAE6OF01CTO8X.46.67.G01.1.454.CMB.1.raw
  modified_base (190)..(190): a, c, t, g, unknown or other
  misc_feature (190)..(190): n is a, c, g, or t
  modified_base (218)..(218): a, c, t, g, unknown or other
  misc_feature (218)..(218): n is a, c, g, or t
  modified_base (230)..(230): a, c, t, g, unknown or other
  misc_feature (230)..(230): n is a, c, g, or t
tcagactagcagtacacgaccggtgctcgatttagagtatacatattgggtttggggagtctcggtcaggacacagcatggacatgagggtccccgctcagctcctggggctcctgctactctggctcgaggtgccagatgtgacatcgagctgacccagtctccatcctcctgtctgcaaccgtggganacagtcgtcacatcacttcggccggganaagtcggaactnttcgacctacttattttaaatggtatacaactatagaccgaggggaccgaccctaagcctacctaatctatgactgctatccgtagtttagacaacggttcgggtacctagtcggtaggttcgaggtcggactaggtcggtattccggtagggactaggtactttaccacgttctacctactactacgtaagttaactctacgactaacggtagtaaactttagtttcgaaccttaatttaactttacgagttaactaacgtaagttaacttaacgttaagtttcggtttaccgaacgtaaacgggactaaccggtaaactaaacgttaaacgtaacgtacgttacggtacgtccttagacctaaccgttagtaccctttaggttcccctttaaacgcctttaccccgtaccccggtaaccttacgtccgttaacgttaacc

SEQ ID NO: 138575 - DNA, 621 bp, Homo sapiens
  misc_feature: GYAE6OF01CYK8Z.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtccgggtccacgactggtgaggcccttcggagaccctgtccctcacctgcgctgtctctggtcgcctccatcagtagtcggtttctcgtggggctgggtccgcagctcccgaaggggaagggctaggaatacgagttggaagtgtctctcagtagtggaggttcctattacgagtcccgttctctcaagagtcgagtcacctatatctctggacacgtccagcaatctacgttttcccagaagtatgtacgttctagtcgaccgcgctcgacgacgggtctttatacgtgtgcgagacgacggtactattagtgttagttttggagtttggtttacgttacgtactacccgtagtacgtcggacggggtcctcggacccgtgggaccgagggtaactacgtcggtacctaccgtcctccgttacgccctacccgaaccgtaacgggtcccctaacgttccggttcccttcccccgtcggtccctacccctccctacccagtaccgtacccg

SEQ ID NO: 138576 - DNA, 604 bp, Homo sapiens
  misc_feature: GYAE6OF01BT9AG.46.67.G01.1.454.CMB.1.raw
  modified_base (380)..(380): a, c, t, g, unknown or other
  misc_feature (380)..(380): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagacagggacgccctaagctacctaatctatgactgctatcctagtttgacgaaagtcgggtcccatcgagttcgagtggcagtgatcgtaggactagtattcactctacacctatcataatntgacaacgtagaagtatttagactaactttacttacgttgtacaactaagtaacttactaaagttgttttaccggaactaacgggtaactaccggtaacttaaactaaaacgttaaaccgtaacgttcggtacggtacctacggtacctaacccgtattacttcggtttaccttaccgtacctttccccttaccccggtaactaccctttgtacggtttaaacc

SEQ ID NO: 138577 - DNA, 771 bp, Homo sapiens
  misc_feature: GYAE6OF01C29KL.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatccctccctgtctgcaaccggtgggagacagtgtcaccatcacgttggccgggacaagtcggaacattgactaccttatttaaatggtatcaacatacgacgagggaccgaccctaagctacctaatctatgctgcactccgtaggtttcgacgtaaacgggttcgggtaccctagtccggtaggttccgaggtcggcgtaggtcgggtatcggtaggggaacctaaggtactttaccgactttccgtacctaacctaattacggtaacttaactccgtacggtacgtaaacggttaggtaaacgtttagtttacgaactttaaactttacgtttaacgttacgtaacaaacgttaagttaaacgtttaaaccgtaacgtttacgggttttaaccgggaaccggtaaaacggggttaaccctaaacggttaaaaccttaaacgttaaaaaccgttttaacggtaaaaccggttgggttaaccggtaacccgtacgtaacccggtaacccttaaagttcccgtttacggttaccctttaaccgttaacctttcccccgtttaaccccgaacccgttttaaccgttcgttaaaccggtttaacccg

SEQ ID NO: 138578 - DNA, 725 bp, Homo sapiens
  misc_feature: GYAE6OF01AI32A.46.67.G01.1.454.CMB.1.raw
  modified_base (172)..(172): a, c, t, g, unknown or other
  misc_feature (172)..(172): n is a, c, g, or t
  modified_base (344)..(344): a, c, t, g, unknown or other
  misc_feature (344)..(344): n is a, c, g, or t
tcagactagcagtacacgaccggtgctcgatttagagtatacatattgggtttgtcctcctgctggtggcagctcccagatgggtcctgtccctggtgcaactggcaggagtcgggcccacgactggtgaggccttcggagaccctgtccctcacctgcgctgtctctggtncctccatcagtagtggtttctctggggctgggtccgcagctccgagggagggctggaatacattggaacgtgtctctcatagtggaggttcctattacagtccgtctctacaagagtcgagtcaaccatactctctaggacacgtccagcaatctacgttttcccagaagtntgtagttctgtcgacccgtcgactgacgtaccgggtcttttattacgtggttcgaccgtaggacggaccgggtacttacgtttagtggttaacgtttttgggaggtttacggtttacgtttccgaaccgttaccccgttaaggtacgtacccgggtacgggggtcccttccggtaccccggttcggggaccctaagggggtaaccttacgtcgggttacccaacccggttcccgttaccgttaacgtcccccgttacccgtaaccccggtaaaccgggggtcccccctaacgggttccccggttacccccgtttacccccccgtgggtacccccgtaacccccgttaccccgttacccgaaaccggtaccggtacccccgg

SEQ ID NO: 138579 - DNA, 563 bp, Homo sapiens
  misc_feature: GYAE6OF01DP7DN.46.67.G01.1.454.CMB.1.raw
  modified_base (533)..(533): a, c, t, g, unknown or other
  misc_feature (533)..(533): n is a, c, g, or t
  modified_base (540)..(540): a, c, t, g, unknown or other
  misc_feature (540)..(540): n is a, c, g, or t
  modified_base (558)..(558): a, c, t, g, unknown or other
  misc_feature (558)..(558): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggacaagtcggaacattgacactatttaatgtatcaacatagacacggacgccctaagctactaatctatagctgctactcctagtttgacaaaggtcgggtacccagtcgaggttcagtggcgaggtggatcgtagggactagtactttcactctacaccgatacagtaatctgacaacgtagtaagttatttacgactaactttatactagtactaaataacgtaattaactaagttacgtttacggaaccgtaaagggacctaaccgtaacttaaactaaaagttaacgaacttgtacgactacgacactagtctnttacctnacgttcctaccgcctatntgtac

SEQ ID NO: 138580 - DNA, 633 bp, Homo sapiens
  misc_feature: GYAE6OF01D17FJ.46.67.G01.1.454.CMB.1.raw
  modified_base (211)..(211): a, c, t, g, unknown or other
  misc_feature (211)..(211): n is a, c, g, or t
  modified_base (290)..(290): a, c, t, g, unknown or other
  misc_feature (290)..(290): n is a, c, g, or t
  modified_base (294)..(294): a, c, t, g, unknown or other
  misc_feature (294)..(294): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggnagcctcccgaggggaacggggctaggaatacagttagggaagtgtctctcataggtggaggttcctattacagtccgtntctnaagagtcgagtcaccatatctctggacacgtccagcaaatctagttttcccagaacgatgtagttctggtcgaccgccgctgacgtacgggtctttatacgtgtgcgagacgacgtctattatgttagttttggagtttggttatttcgacctaccgtagacgtcggacggggtcctaccggtacccgtacgggacccgagggtaactaccgttacggtccgacccgttccgtacccgttcgtccctacccgaacccggtaaccggtccctacggttcccggtcccctttcccccgccggtacccctaccccgtcccttaacccgagcccgtaaccccg

SEQ ID NO: 138581 - DNA, 746 bp, Homo sapiens
  misc_feature: GYAE6OF01AQRTQ.46.67.G01.1.454.CMB.1.raw
  modified_base (228)..(228): a, c, t, g, unknown or other
  misc_feature (228)..(228): n is a, c, g, or t
tcagactagcagtacacgaccggtgctcgatttagagtatacatattgggtttggggagtctcggtcaggacacagcatggacatgagggtccccgctcagctcctggggctcctgctactctggctctgaggtgccagatgtgacatcgagctgacccagtctccatcctccctgtctgcaaccgtgggagacagtgtcaccatcacttggccggcaagtcggaacnttgactactatttaatggtatcaacatagaccagggaccgccctaagcctctaatctatgcttgctactcctagtttcgacgtaaaaggttcggggtacccctaagtccggtaagggtttaccagggttacgggaccgtaagggttacgggacgttccggtagggggtaacaaggttacttttacccaacctttccgtaccaaccctaactaccgtaaggttaaccttcgttacgtaaccgtaaaccggttagtaaacgttactttttacgaaccttaaacgtttaatttacctacgttaacgaaactaagtaactttaacgtaactttcgggttttaccggaaccggtaaacgggtaacctaaccgtaaacttaaaccgttaaaacgttaaaaccggtacgttacgggtaggtaccttacggtaaccctaaaccgttacgttacccgtttacggttacccttttaaccgtacgtttaccccctttaccccggtaccctacgtttacccgttaaccgg

SEQ ID NO: 138582 - DNA, 757 bp, Homo sapiens
  misc_feature: GYAE6OF01AT9IV.46.67.G01.1.454.CMB.1.raw
  modified_base (305)..(305): a, c, t, g, unknown or other
  misc_feature (305)..(305): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtccgggcccacgactggtgaggccttcggacgaccctgtccctcacctgcgctgtctcgtggtcgcctccatcagttagttggtttcttcgtggggcttcgggtccgcagccgtccgagggagggctaggaatactagttggaagtcgtctcctnataggtggtacggttctatacgtacgttccgtctctacaagtgtcgacgtcaccatactctcgtacggacaccgtcacgactaacttctacgttttccaagtaacgtagtagtacgtttctggttaccgacccgtccgtcgtacggaaccggtacggttacgttttaacgttacgtggtcggtaccggtaggtaacggtaccggtactttagtttaagttaggtttaggtttttagggtaaggttttacgggttttaccgtttaacgtaacccgttaacccgttaacggtaccggttacccgggggtaccgggggttaccccgttacccggggtccccccggttaacggggggaccccggttaaagggttaaacccgttacccgggttcggttaaccccgttaccccgtttacccgttaccccgtttaacggccccccgttaaaaccccggg

SEQ ID NO: 138583 - DNA, 676 bp, Homo sapiens
  misc_feature: GYAE6OF01EAX1W.46.67.G01.1.454.CMB.1.raw
  modified_base (151)..(151): a, c, t, g, unknown or other
  misc_feature (151)..(151): n is a, c, g, or t
  modified_base (240)..(240): a, c, t, g, unknown or other
  misc_feature (240)..(240): n is a, c, g, or t
  modified_base (381)..(381): a, c, t, g, unknown or other
  misc_feature (381)..(381): n is a, c, g, or t
  modified_base (404)..(404): a, c, t, g, unknown or other
  misc_feature (404)..(404): n is a, c, g, or t
tcagactagcagtacacgaccggtgctcgatttagagtatacatattgggtttgggggacctcctgtgcaagaacatgaagcacctgtggtttgtcctcctgctggtggcagcctcccagatcgggtcctgtccctggtgcaactgcaggngtcgggcccagactggtgaggccttcggagaccctgtccctcacctgcgtctgtctcgtggtcgcctcatcagtgtgtttctgtcgggntcgggtccgctagcctccgagggaacgggctaggaactactagttgggaagttcgtctactagagttaggtggtacggttcttacttacgacgtccgtctctacgaagtgtacgatacaccatactctgtggacactccanactaactctacgtttcctagaanctgtagtctagtccgaccgcgtactacggacgtacgggtacgttttaactcgtgtacggacgacggtaacggacggttattaagtttagtaggtttagttttagggtaacggttttcggttttaacgttcccggaaccgttaacccgtaggtaaccggttccggggaacccggggttccgttaccccgggaacccgggtcgggggtacggaaacgggtaaacttccgggtacgtaccctacccgttctttacccgtcgtcccgtaaccccgg

SEQ ID NO: 138584 - DNA, 549 bp, Homo sapiens
  misc_feature: GYAE6OF01DMBII.46.67.G01.1.454.CMB.1.raw
  modified_base (193)..(193): a, c, t, g, unknown or other
  misc_feature (193)..(193): n is a, c, g, or t
  modified_base (218)..(218): a, c, t, g, unknown or other
  misc_feature (218)..(218): n is a, c, g, or t
  modified_base (228)..(228): a, c, t, g, unknown or other
  misc_feature (228)..(228): n is a, c, g, or t
  modified_base (351)..(351): a, c, t, g, unknown or other
  misc_feature (351)..(351): n is a, c, g, or t
  modified_base (538)..(538): a, c, t, g, unknown or other
  misc_feature (538)..(538): n is a, c, g, or t
  modified_base (544)..(544): a, c, t, g, unknown or other
  misc_feature (544)..(544): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatccctccctgtctgcaaccggtgganacagtgtcaccatcacttgccgggnaagtcgaacnttgacactatttaaatgtatcaacatagaccgagggaccgccctaagcctacctaatctatgctgcatccagtttgactaaaggtcgggtacccagtcgagttcagtgcagtgatcgtggacngtattcactctcactatcaagtactctagactaacgtagtaagttatttgacttaaactttattactgtacaaactataactttacaagtttcgtttacggaacctaagggaacctaacaacttaacaaaattaacgaacgtgtgactagacctactatcttcgtaccttctactccttcccgactnttcgtntaacg

SEQ ID NO: 138585 - DNA, 933 bp, Homo sapiens
  misc_feature: GYAE6OF01D954J.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtccgggcccacgactggtgaggccttcgggagacccctgtccctcacctgcgctgtctctggtgccctccatcagtagttggtttcttcgtggggcttggggtccggcagctcccgaggggaaggggctggaatacagttggaagtgtctctcagtagtggaggttctattacacgtccgtctctacaagtagtacgagttaccaccatacttccgttacgtcggacctaccgtaccgacgactaacgttccaaacggtttttccccctaggtaaacgagttacggtagttttcgtacggttacgaccccggtccggtaccgtacggaaccggtaacccgggggttaccgttttttaaacgtttaccgttcgggtacgggtaccggtaacgggtaacggtaaccgggtaaccttaagttttaagtttaacggtttaaaggttttttaggggtaagggtttttacggggttttaacgttttacccggtaaaccccgttaaaccccgttaaggttaaccgggtaccggggtaacccgggggggttacccgttaccccggggtaaccccccgggttacgggggggaccccggtaaacggggggttaaaccgttaaccggttaccgggttacccgtaaccccggttacccgtttaccccgtttaacccgtacccccgttaaccccgaaaccccgggtaaacccggggtaccccccgttaacggttccccccgggtttacccccgtttccccccccggttaccgggtcccccccttaacccccgtttacccccgtaaccccgtaaaccggtaacccggtaacccccgg

SEQ ID NO: 138586 - DNA, 638 bp, Homo sapiens
  misc_feature: GYAE6OF01AC8GZ.46.67.G01.1.454.CMB.1.raw
  modified_base (217)..(217): a, c, t, g, unknown or other
  misc_feature (217)..(217): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggnaagtcggaacattgacacctatttaaattggtatcaacatagaccagggaccggccctaagctcctaatctatgctgcatccagtttgctaaagtcgggtcccagtcgaggttcagtggcagtggatcgtgggacagtatttcgacttctcacctatcagttaactcgtagactaacgtgtaaagtattttagaccttaaacgtttatttaaccttaggtaacctaaacgtaagtaaatttaactaaagtttcggttttacccggaaccgtaaacggggtaacctaaccggtaaccttaaacgtaaaacgtttaaaccgaaacgttcggtacggtacctaggaccctaaccctatttaccgttcgtttacccttactaaccgtttcccttacccccgacctacctttccgtagttaacccg

SEQ ID NO: 138587 - DNA, 644 bp, Homo sapiens
  misc_feature: GYAE6OF01DAJBM.46.67.G01.1.454.CMB.1.raw
  modified_base (195)..(195): a, c, t, g, unknown or other
  misc_feature (195)..(195): n is a, c, g, or t
  modified_base (216)..(216): a, c, t, g, unknown or other
  misc_feature (216)..(216): n is a, c, g, or t
  modified_base (240)..(240): a, c, t, g, unknown or other
  misc_feature (240)..(240): n is a, c, g, or t
  modified_base (253)..(253): a, c, t, g, unknown or other
  misc_feature (253)..(253): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtcctggtgcaactgcaggacgtcgggcccagactgggtgacggtccttcggacgaccctgtccctnacctgcgcttgtctcgtggtnacctcatcaggttgtgtttctcgngggctgggtccgnagctccgagggacgggctaggatacgtagttaggaagtcgtctctctagtagtggtaggttctatacgacgtccgtctcacaagagtcgagtcacgatactctcgagtacacgtacacgtcaacttctacgtttccctagaacgtatgtacgttgtcgtacgaccggaccgtcgttacgacgtacgggttactttacgttaacgtggtacgacgaggtaacgtacgtactttaagttacgtgtttagtttagggtacggtttacgtttaacgttccgtaaccgtacccgttaaggtacggtacggtaccggggtctacccggcccggtagggacggtacgggtaactccgttacggtccgtacctacgttccgttaaccgccgtaaccccg

SEQ ID NO: 138588 - DNA, 559 bp, Homo sapiens
  misc_feature: GYAE6OF01DBWBH.46.67.G01.1.454.CMB.1.raw
  modified_base (255)..(255): a, c, t, g, unknown or other
  misc_feature (255)..(255): n is a, c, g, or t
  modified_base (336)..(336): a, c, t, g, unknown or other
  misc_feature (336)..(336): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtccgggcccacgactgggtgaggccttcggagaccctgtccctcacctgcgctgtctctggtcgcctccatcaggttagtggtttctcgtggggctggggtccgnacgcctaccgagggagggctggaatacattggaagtgtctctcagtagtggtagttctattacacgtccgtctctacaagngtcgagtcaccatatctctagacacgtcagcaatctacgtttccagacgatgtacgttcgtgtcgacccgcgcgtgacgacgggttatttagtcgtgtcgacgagagacgtctattatgttagtttgtagttgttattcgacgtaccgtagacgtcggcgggctacccgaccggtgggacgtagggtactcgtcggtcctaccgtctaccgtgtcccgtaccg

SEQ ID NO: 138589 - DNA, 572 bp, Homo sapiens
  misc_feature: GYAE6OF01CHCLK.46.67.G01.1.454.CMB.1.raw
  modified_base (252)..(252): a, c, t, g, unknown or other
  misc_feature (252)..(252): n is a, c, g, or t
  modified_base (321)..(321): a, c, t, g, unknown or other
  misc_feature (321)..(321): n is a, c, g, or t
  modified_base (381)..(381): a, c, t, g, unknown or other
  misc_feature (381)..(381): n is a, c, g, or t
  modified_base (414)..(414): a, c, t, g, unknown or other
  misc_feature (414)..(414): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacactatttaaatgtatcaanatagacagggacgccctaagctctatctatgctgcatccagttgcaagtcggggtcccatcgaggtttnagtggcagtgactcgtgggactagtattcactctccaccatacagtaatctgacaacgtnaagtatttagactaacttattactagtctaaanagtaattacgtaattacgttttcggactaacgggactaacgaacttaaactaaagtttaaccgaaacgttggtagtaccgtacgacctaacccgttattaccgtgttacccgtttataccgttcccgttaccccgaccttacttcgttagttaacccg

SEQ ID NO: 138590 - DNA, 644 bp, Homo sapiens
  misc_feature: GYAE6OF01CN8HK.46.67.G01.1.454.CMB.1.raw
  modified_base (467)..(467): a, c, t, g, unknown or other
  misc_feature (467)..(467): n is a, c, g, or t
tcagactagcagtacacgaccggtgctcgatttagagtatacatattgggtttggggagtctcggtcaggacacagcatggacatgagggtccccgctcagctcctggggctcctgctactctggctcgaggtgccagatgtgacatcgagctcgacccagtcctccactccctccctgtctgccaaccggtgggagacagtcgtcaaccatcgacgttcggccgggactaaaggtcggaaactagttacgaacctaacctttaaattttaaaagttcggtaactacaaactaagtaacgaaccgacgggaccgaccctaagcctacctaatctatgctgactactctagtttagacgtaaggtcgggtcccaagtcggtaggttcgaggtggacgtagtggatcggaggactagtacttcactctacactagtactaagtactctagacgtaacgtagtaaagttntttagaaccttaaatttacgtactacgaactaaactaagtaaactttataacgtttcggttaaccgaacgtaacggaactaacgtaaactaaacgtaaaacgttaacgtacgtgacgtacttagaaccctccgtatccgttactcctttacacttcccctacgacctattcgagtac

SEQ ID NO: 138591 - DNA, 652 bp, Homo sapiens
  misc_feature: GYAE6OF01EN9XM.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctcatcagtagtggtttctcgtgggctgggtccgcagctccgaggggaagggctggaatacattggaagtgtctctcatagtggaggttcctattacagtccgtctctcaagagtcgagtcacatatctgtgacacgtccagcatctacgtttccagaacgatgtattcgtgtcgaccgccgcgtcgacgtacgggtctttaacgtcgtgtcgacgagacggtacggtacttagttagtgttagttttggagttagtttagttccgtactaccgtagtacgtccgggacggggtcctccggaccccggtggggacccgaagggtaacttacggtcggtaccgtacccgttccttacccgttaccgtcccgtacccgaaccggtaacccgggcccttaacggttccccggttccccgttccccccggtaccggtacccccttacccccttacccgtaacccgaaacggtcccgtaaccccg

SEQ ID NO: 138592 - DNA, 638 bp, Homo sapiens
  misc_feature: GYAE6OF01D3P6Y.46.67.G01.1.454.CMB.1.raw
  modified_base (192)..(192): a, c, t, g, unknown or other
  misc_feature (192)..(192): n is a, c, g, or t
  modified_base (217)..(217): a, c, t, g, unknown or other
  misc_feature (217)..(217): n is a, c, g, or t
  modified_base (227)..(227): a, c, t, g, unknown or other
  misc_feature (227)..(227): n is a, c, g, or t
  modified_base (250)..(250): a, c, t, g, unknown or other
  misc_feature (250)..(250): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccgggnaagtcgaacnttgacactatttaatgtatcaanatagaccagggaccgccctaagctcctaatctatgctgcatcctagtttgacgtaaacggttcggggtcccagtccggtaggttcaggtggcgagtggatcgtagggacagtattcactctcaccatcaagtatctacgactaacgtagtaagtagtttcgacttaacttattactacgtactaaacgtaagtaaactttaacgtaagtttacggttttaccggaaccgtaaacggggtacctaaaccggttaaaccttaaacgtaaaacgtttaaaccggtaaaccgttaggtacggtaccgttacggaccctaacccgtaacttccgttacggttacctttaccgtaaccgtttcccttaccccgtacctacttccgtagtaaccg

SEQ ID NO: 138593 - DNA, 568 bp, Homo sapiens
  misc_feature: GYAE6OF01B34BA.46.67.G01.1.454.CMB.1.raw
  modified_base (172)..(172): a, c, t, g, unknown or other
  misc_feature (172)..(172): n is a, c, g, or t
  modified_base (194)..(194): a, c, t, g, unknown or other
  misc_feature (194)..(194): n is a, c, g, or t
  modified_base (350)..(350): a, c, t, g, unknown or other
  misc_feature (350)..(350): n is a, c, g, or t
  modified_base (356)..(356): a, c, t, g, unknown or other
  misc_feature (356)..(356): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggcctttcggagaccctgtccctcacctgcgctgtctctggtncctcatcagtagtgtttctcgngggctgggtccgcagcctcccgaggggaacgggctaggaatacgagttaggaagttgtcctctcaagttagtggacggtttcctattaccagttcccgtctctacaagagtcgacgtcacctatatctctggacacgtcagcaatctagtttcccngaacgntgattctgtcgaccgcgctgacgacgggtctttataccgtgtcgacgagacgacggctaattatgttagttttggagttggtttacttcgacacctagctacggcgggctcgacccgtgggccagggatcgtgcaccgtctcgtacgcctaccaccgtacggccctacgtccggtcccttccccgcgtcccaccctcctacacgcgtacccg

SEQ ID NO: 138594 - DNA, 583 bp, Homo sapiens
  misc_feature: GYAE6OF01CSYY0.46.67.G01.1.454.CMB.1.raw
  modified_base (390)..(390): a, c, t, g, unknown or other
  misc_feature (390)..(390): n is a, c, g, or t
  modified_base (538)..(538): a, c, t, g, unknown or other
  misc_feature (538)..(538): n is a, c, g, or t
tcagactagcagtacacgaccggtgctcgatttagagtatacatatttgggtttggggagtctcggtcaggacacagcatggacatgagggtccccgctcagctcctggggctcctgctactctggctccgaggtgccagatgtgacatcgagctgacccagtctccatccctccctgtctgccaaccggtgggagacagtgtccaccatctacttggccgggcaaggtcggaacattgacaccttatttaaattggtatcaacatagaccagggaccgccctaagctacctaatctatgctgcatccagtttcgacaaggtcgggtacccagtcggtaggttcaggtggcaggtggatcgtagggactaggactttcacttcaccaccntacagttaatctagactaaggtagtaagttattttagtacctaactttattactagtactaacataacttactaagttgttttaccggacgtaacggtactaacgtactaactaaattaacgaacttcgtaggtactgaccgtacctnttactcgttacttctaccttcccttacccactacttcgtgttaac

SEQ ID NO: 138595 - DNA, 613 bp, Homo sapiens
  misc_feature: GYAE6OF01C8KL8.46.67.G01.1.454.CMB.1.raw
  modified_base (230)..(230): a, c, t, g, unknown or other
  misc_feature (230)..(230): n is a, c, g, or t
tcagactagcagtacacgaccggtgctcgatttagagtatacatattgggtttgggggagtctcggtcaggacacagcatggacatgagggtccccgctcagctcctggggctcctgctactctggctccgaggtgccagatgtgacatcgagctgacccagtctccatcctcctgtctgcaaccgtgggagacagtgtcaccatcacttggccgggacaagtcggaacnttgacactatttaatgtatcaacatagaccgagggaccgaccctaagctactaatctatgctgctatcctagtttgacgaaggtcgggtcccagtcgaggttcaggtgcgtaggtggatcgtagggactagtatttcactctcaactatactaagttaactctacgaactaacggtagtaaagtttattttacgaactttaaactttagtttaactacgtaaccaaagtaacgttaaatttaactaagttttcgggtttacccggaaccgtaaaagggacctaaccgtaaacttaaacgtaaaacgttaacgtacgtaggtcgactacgaccaacttattccgttagtccttacactttccctacccgacttactgtagtaac

SEQ ID NO: 138596 - DNA, 816 bp, Homo sapiens
  misc_feature: GYAE6OF01D1X60.46.67.G01.1.454.CMB.1.raw
  modified_base (177)..(177): a, c, t, g, unknown or other
  misc_feature (177)..(177): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactgggtgaggccttcgggacgaccctgtcccctcacctgcgctgtctcgtggtcncctccatcagtagttggtttctcgtgggctgggtccgcagccgtccgaggggagggctaggaatacagttaggagtcgtctctacagtaggtggtacggttcctattacacgttccgtctctacgaagtcgtacgagtaccacctattacgtctaccgtaggaaccctaccgtccaagtacctaaacttccgtttacgttttacccgaggtaacgtacgttggtacgtttcgtacggtaccgtcccggtccgtacgttacggaaccggtaccgggtttacgttttaacgtacgttagggtcggacggtaggtaacggtaaccggttacttaagtttagtttaggttttacggtttttagggaacggttttaggttttaaccgtttacccggtaaccgttaacccgttaaggtaccgggttacccggggtacgggggttacccgtaccccgggtaccccgggtacgggggtaacccgaacggggttaaccgttaccggttccgggacccttacccggttccttaccccgttaccgtccccgtaacccctaaccggggtaccggtcccccttaacgggtccccgtttccccgtaccccgccggtacccctacccgtacccctaacgaacgtcccgtacccg

SEQ ID NO: 138597 - DNA, 879 bp, Homo sapiens
  misc_feature: GYAE6OF01BCG58.46.67.G01.1.454.CMB.1.raw
  modified_base (189)..(189): a, c, t, g, unknown or other
  misc_feature (189)..(189): n is a, c, g, or t
tcagactagcagtacacgaccggtgctcgatttagagtatacatattgggtttggggagtctcggtcaggacacagcatggacatgagggtccccgctcagctcctggggctcctgctactctggctcgaggtgccagatgtgacatcgagctgacccagtctccatcctcctgtctgcaaccgtgganacagtgtcaccatcacttggccgggcaaggtcggaactattcgaactaccgttaattttaaacgttggttatacaacatagaccgaagggaccggccctaagcctacctaatctaatcgctacgctatcctagtttacgaccgtaaaggtcggggtacccagttacggtacggtttcgaggttcggacgtaggttacgggtagtacggttaggggaacctaggttaacgttttaccaaccgtttacccgttacccgaacccgttaacttaccgtaaacgggttaactttaccgtaacggtaacccgttaaaaccgggtttacgaaaagggttttaccgtttttaacgggtaaccgtttaaaacctttttaacgttttaacccgttacggttttaacccgtaaaactaacgggtttaaaacttttaaccgttaaacggttttcggttttttaacccgggaaacccgggtaaaacgggggttaacccttaaacccggttaaaccgtttaaaaacgttaaaaaccgtttaaaaacccggttaaccgtttaaacgggtacggttaaccgttaaccgggttaacccctaaaccgttagttacccggttttacggttaaccctttaccggttaaacgttttccccccgttaaccccgggtaccctttaacctttaaccggttaggttttaaacccc

SEQ ID NO: 138598 - DNA, 580 bp, Homo sapiens
  misc_feature: GYAE6OF01D1SSH.46.67.G01.1.454.CMB.1.raw
  modified_base (192)..(192): a, c, t, g, unknown or other
  misc_feature (192)..(192): n is a, c, g, or t
  modified_base (351)..(351): a, c, t, g, unknown or other
  misc_feature (351)..(351): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcacatcacttgccgggcaagtcggaacattgacacctatttaaattgtatcaacatagaccagggacggccctaagctcctaatctatgctgcatccagtttgcgaaagtgggtcccatcgaggttcagtggcagtggatcgtgggacagtntttcactctcacatacagtaactctgacaacgtagaagtatttcgactaacttattactgtacaactaagtaactttacaagttcggttttaccggaccgtaacggacctacgtaacctaaactaaagttaaaccggtaacgttaggttaggacctaggtaccaacctagttcttcgttacccgtttactaacgttccctttaccccgaccttacgtccgttgtaaccg

SEQ ID NO: 138599 - DNA, 637 bp, Homo sapiens
  misc_feature: GYAE6OF01DAZGM.46.67.G01.1.454.CMB.1.raw
  modified_base (193)..(193): a, c, t, g, unknown or other
  misc_feature (193)..(193): n is a, c, g, or t
  modified_base (219)..(219): a, c, t, g, unknown or other
  misc_feature (219)..(219): n is a, c, g, or t
  modified_base (353)..(353): a, c, t, g, unknown or other
  misc_feature (353)..(353): n is a, c, g, or t
tcagactagcagtacacgaccggtgctcgatttagagtatacatattgggtttggggagtctcggtcaggacacagcatggacatgagggtccccgctcagctcctggggctcctgctactctggctcggaggtgccagatgtgacatcgagctgacccagtctccatcctccctgtctgcaaccggtggganacagtgtcaccatcacttgcccgganaagtcggaacattgacaccttatttaaatggtatcaacatagaccgagggaccggaccctaagcctacctaatctatgctgcatccgtagtttgacaaaggtcgggtcccagtcgaggttcaggtggcgtaggnggatcgtagggacagtatttcactcgacacatcaagttatctgactaacgtgtaagttattttacgacttaaatttacgtttactacgtaactaaactaagtaaactttaactaagttcggttttacggaacccgtaacggtaacctaaaccggtaaccttaaactaaaaccgttaaaacgtaacgttacggttacggtaccgttagacccgtaaccttacttaccgttcgttacctttacgtacccttaccgtttaccccgacttaacttcgtacggttaacc

SEQ ID NO: 138600 - DNA, 852 bp, Homo sapiens
  misc_feature: GYAE6OF01AJ8Z8.46.67.G01.1.454.CMB.1.raw
  modified_base (220)..(220): a, c, t, g, unknown or other
  misc_feature (220)..(220): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtcctggtgcaactgcgaggagtccgggcccacgacgtggtgacggtccttcggacgaccctgtccctcaccgtgcgtctgtctcgtggtcncctcatcgagttgttgtttctcggtggggcttcgggtccgcacgccgtaccggaggggacgggctaggaactacgtagttagggaagttcgtcctcgtcgaagttacggtggtacggtttacctagtaccgtacggttccgttctctacgaaggtcgtacgtagtccactattctccgtacgtacggactaccgtacgagtactaacgttccgtttaccgttttaccgaaggtaacgttagttacggttacgtttccggtaggttacccggacccgtccgttacggtaccggtaaccgggttaccgggtttacttttaacgtccgttagggtaccggacgggtaagtacgggttaaccgttatttaaggttacgtttagggttttaacggtttttcgggtaacgggttttacgttttaaccgttacccggtaaaccgttaacccgggttagggtaaccccgggtcccgggggttacccggggttaccgttaccccccggggttaacccggggttaccgggggaacccgttaaacggggttacccttaacccgggttaccggttaccccccggtttaacccggtttcccttttaacccccggggtaacccgttccccccggttaaaccccggg

SEQ ID NO: 138601 - DNA, 603 bp, Homo sapiens
  misc_feature: GYAE6OF01B9NFN.46.67.G01.1.454.CMB.1.raw
  modified_base (227)..(227): a, c, t, g, unknown or other
  misc_feature (227)..(227): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccggcaagtcggaacnttcgacacctattaatgtatcaacatagaccagggacgccctaagctacctaatctatgctgcatcctagtttcgacaaggtcgggtacccagtcgtaggttcgagtggctaggtggatcgtggacgtagtacttcgctctcacatcattatctgacgacgtgtaagtctttgaacttaacgttattacgttacgtacaacgtaagtaaacttactaactttgggtttaccgacggtaaacggtactaacgtaacttaacgtaaaacgtttaacgaacgttacggtacgtacgtacgtaccgaacccttagttcccgtttcgttacctttaccgacctttccccgttacccgaacccttgttacctacgttaaccc

SEQ ID NO: 138602 - DNA, 686 bp, Homo sapiens
  misc_feature: GYAE6OF01CLFTT.46.67.G01.1.454.CMB.1.raw
  modified_base (193)..(193): a, c, t, g, unknown or other
  misc_feature (193)..(193): n is a, c, g, or t
  modified_base (217)..(217): a, c, t, g, unknown or other
  misc_feature (217)..(217): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatccctccctgtctgcaaccgtggganacagtgtcacatcacttggccggnaagtcggaacattgactaccttatttaattggtatcaacatagacgagggaccgaccctaagtctcctaatctatgctgctactcctagtttgactaaaggtcgggtaccctagtcgaggttcaggtgcgtaggtgtagtcgtaggactagtactttcaccgtctacctaaccgtataccgtaagttaacgtccgttacggaccgtaacggttagtaaacgtttacgttttacgaaccgtttaaactttactttaacgttacgtaacctaaacgttaacgttaaactttaacgttaaacgtttcgggttttaacccggaaccggtaacgggtaaacctaaccgttaaacgttaaactaaaacgttaacgaacgttcggtaccggtacttaccgacctaaccgtatttacccgttgttacccttacgtaacctttcccctaccccgtaccttactttccgtacgttaacg

SEQ ID NO: 138603 - DNA, 592 bp, Homo sapiens
  misc_feature: GYAE6OF01AQX78.46.67.G01.1.454.CMB.1.raw
  modified_base (317)..(317): a, c, t, g, unknown or other
  misc_feature (317)..(317): n is a, c, g, or t
  modified_base (325)..(325): a, c, t, g, unknown or other
  misc_feature (325)..(325): n is a, c, g, or t
  modified_base (368)..(368): a, c, t, g, unknown or other
  misc_feature (368)..(368): n is a, c, g, or t
  modified_base (373)..(373): a, c, t, g, unknown or other
  misc_feature (373)..(373): n is a, c, g, or t
  modified_base (381)..(381): a, c, t, g, unknown or other
  misc_feature (381)..(381): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctcatcagtagtgtttctctggggctgggtccgcagctcccgagggaaggggctggaatacattggaagtgtctctcatagtggacgttcctattacagtccgtntctcaagngtcgagtcaccatatctctgactcgtcagcaatctagtttccngaagntgagttcngtcgaccgcgctgacgtcgggtacttttatacgtgtcgacgtagacggtacggtcttaattacgtgtttagtttttaggagtttacggtttactttcggaacctacccgttaagtacggtccgggtaccgggggtcttacccggaccccggtgggggacccaaggggtaacctacggtcgtaccacggttcctaccgttagccctaacccg

SEQ ID NO: 138604 - DNA, 586 bp, Homo sapiens
  misc_feature: GYAE6OF01A7N58.46.67.G01.1.454.CMB.1.raw
  modified_base (247)..(247): a, c, t, g, unknown or other
  misc_feature (247)..(247): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtgtgtttctcgtggggctgggtccgnagctccgagggaagggctggaatacgagttggaagtgtctctcatagtggaggttcctattacagtccgtctctacaagacgtcgagtcacctatactctctgacacgtccagcaatctacgttttccctagaacgtatggtagttctgtacgaccgccgtctcgacgtacgggtacgttttattaccgtggtacgcgagtacggacggtacttagttagtgttagttttggagttggtttactttcgaacctacctgtacgtcggacggggtcctccggacccggtgggaccgtagggactacggtcggtcctaccgtcctccttcgtcccgtacccg

SEQ ID NO: 138605 - DNA, 532 bp, Homo sapiens
  misc_feature: GYAE6OF01ESNWO.46.67.G01.1.454.CMB.1.raw
  modified_base (212)..(212): a, c, t, g, unknown or other
  misc_feature (212)..(212): n is a, c, g, or t
  modified_base (249)..(249): a, c, t, g, unknown or other
  misc_feature (249)..(249): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtcccctcacctgcgctgtctctggtncctccatcagtagtggtttctctggggctgggtccgnagctcccagggaaggggctggaatacattggaagtgtctctcatagtggaggttcctattacagtccgtctctcaagagtcgagtcaccatatctctggacacgtccagcaatcagttttccctgaagatgagttctgtgaccgccgctgacacgggcgtttatactgtgcgagagacggctattatgtattttggagttggttatttcgactaccctagatcgacggggctcggaccccgtggggccagggatacgtggtcacgtctccgttagcctacccg

SEQ ID NO: 138606 - DNA, 616 bp, Homo sapiens
  misc_feature: GYAE6OF01DRM2U.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctcatcagtagtggtttcttcgtggggctgggtccggcagctcccgagggagggctggaatacattggagtgtctctcatagtggagttcctattacagtccgtctctcaagagtcgagtcaccatatctcgtggacacgtccagcaatctacgttttcccagaagatgagttctgtcgaccgcgcgtgacgcgggtcgtttattacgtgtgcgagacgacggtacttattatgttagttttggagttggtttatttcgactacccgtagtactcggacgggtcctccggtacccgtggggacccgtaagggtaacgttaccgtcggtaccgtacccgttcttcccgttacgccctaccgacccgtaaccgggcccctacggttcccggtacccgttcccccgttcgggacccctaccccgttccctaccgaacgccgtacccg

SEQ ID NO: 138607 - DNA, 600 bp, Homo sapiens
  misc_feature: GYAE6OF01A38OU.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagacccctgtccctcacctgcgctgtctctggtgcctccatcagtagtggtttctctggggctgggtccggcagctcccaggggaaggggctggaatacattggaagtgtctctcatagtggaggttcctattacagtccgtctctcaagagtcgagtcaccatatctctggacacgtccagcaatcagttttcccagaagatgagttctgtgacccgccgctgacgacgggtcgtttattactgtgcgagagacggtctattatgtagttttggagttggttatttcgacctacccgtagagtcggacggggtctccggaccccgtggggaccgaagggtaagtacgtcggtccgtaccgtccttccgtacgccctaccgacccgaacggggtcccctacgtccggtccctttccccccgcgggtccctacccccgttaccctacccgaacggcgtacccg

SEQ ID NO: 138608 - DNA, 707 bp, Homo sapiens
  misc_feature: GYAE6OF01CWLR2.46.67.G01.1.454.CMB.1.raw
  modified_base (172)..(172): a, c, t, g, unknown or other
  misc_feature (172)..(172): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtcncctccatcagtagttggtttctcgtgggctgggtccgcagcctccgaggggacgggtctaggaatacgagttggaagttgtctcgtcagtaggtggtacggttcctattacacgtccgtctctacaagagtcgagtcaccattatctcgtacggacctacgtccagactaacttcgtacgttttcccgagaacgtagttgtaagttctagtccgaccgccgctaggaccgtacgggttcttttaacgttgtggtacgcggaaggtacgtacggtactttaattaagttgtttagttttagggtacgttttacggtttaactttacggaacccttacccgtaaggtacggtaccgggaccggggtacctcccgggtacccggttcggggaccgtaagggtaaccgtcggtcggttacctaccgttcctaccgttaccgcccgttacccgaaccggacggtaccccgtacgttaccccggttcccttacccccggtcgtacccccgttacccttcccaccgaacgtccgtaaccccg

SEQ ID NO: 138609 - DNA, 573 bp, Homo sapiens
  misc_feature: GYAE6OF01BJ616.46.67.G01.1.454.CMB.1.raw
  modified_base (217)..(217): a, c, t, g, unknown or other
  misc_feature (217)..(217): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggnaagtcggaacattgacacctatttaaatggtatcaacatagaccagggaccggccctaagctcctaatctatgctgcatcctagtttgcaaagtggggtcccagtcgaggttcagtggcagtggatcgtgggacaggtatttcactctcaccatcagtatctgacaacgtgtaagtattttcgactaacttattactgtacaactagtaattactaattcgttttccggacctaagggtacctaacgtaacttaactaaacgttaaaccgaacgtggtaggtaccgtacgaccgtaaccctagttcttacggttaccttcactttcccttaccccgcctaacttccgtacgtaacc

SEQ ID NO: 138610 - DNA, 679 bp, Homo sapiens
  misc_feature: GYAE6OF01ENDUB.46.67.G01.1.454.CMB.1.raw
tcagactagcagtacacgaccggtgctcgatttagagtatacatattgggtttgggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccggcaagtcggaacattgacactattaaattggtatcaacatagaccgagggaccgccctaagctacctaatctatgctgctatcctagtttagacgtaaaggtcgggtcccaagtcggaggttcaggtggctaggtaggactcgtagggactaggtactttcacgtctacgaacctatcaagtaactcgtacgacgtaacggtgtaaagttacttttaagttaaactttattaactggttaaccaaacgttaagtaaactttaacgtaacgttttcgggttttaaccggaaccgtaaacggggtaacctaacgggtaaaccttaaacgttaaaaacgtttaaaccggtaaccttagggttaccggacgttaacggacctaaaccgtaacgtttccgtacggtttaccttacgtacctttaccccgttacccgacccttaacgttccttacgtaacgtttaacccg

SEQ ID NO: 138611 - DNA, 621 bp, Homo sapiens
  misc_feature: GYAE6OF01EQAYK.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtgggagacagtgtcaccatcacttgccgggcaagtcggaacattgactaccttatttaaagttggtatacaacatacgaccagggaccgaccctaagctacctaatctatgctgctatacctagtttacgacgtaaaggtcgggtacccagtcggtaggttcaggtggcaggtggtactcgtagggactaggtactttcacttctaccacctatactaagtaatcttagacgtaacgtagtaagttattttagacttaactttacttactgtactaacgtaataatttaactaagtttcggttttaccggaccgtaacggacgtaacgtaactaaactaaacgttaaacgtacgtaggtcggtctacgtaccgtaactattccgttcgttcttacgtaccttaccttaccccgtacctacttcgtacgtaaccg

SEQ ID NO: 138612 - DNA, 582 bp, Homo sapiens
  misc_feature: GYAE6OF01DGKTH.46.67.G01.1.454.CMB.1.raw
  modified_base (566)..(566): a, c, t, g, unknown or other
  misc_feature (566)..(566): n is a, c, g, or t
tcagactagcagtacacgaccggtgctcgatttagagtatacatattgggtttgtcctcctgctggtggcagctcccagatgggtcctgtccctggtgcaactgcaggagtccgggcccacgactggtgagggccttcgggagaccctgtcccctcacctgcgctgtctctggtgcctccatcagtagttggttttcttcgtggggctggggtccggcagcctcccgaggggaaggggctggaatacattgggaagtgtctctcatagtggaggttcctattacagtccgtctctcaagagtcgagtcaccatatctctggacacgtccagcaatctagttttcccctgaagatgagtttctgtcgaccgccgctgaacgcgggtcgtttattacttgtgcgagagacggctattatgttagttttggagttggtttatttcgactacccgtagacgttcggacggggtcctccggaccccgtggggaccgagggaactcgtgtctaccgtctccttacgccctccaccgacggcccagtccgtccttcccccgtcggcctacccncctaccagcgtacccg

SEQ ID NO: 138613 - DNA, 617 bp, Homo sapiens
  misc_feature: GYAE6OF01A3UYK.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggcagctcccgagggaggggctggaatacagttggaagtgtctctcatagtggaggttcctattacagtccgtctctcaagtagtcgagtcaccatactctcgtggacacgtccagcaatctacgttttccctagaacgtatgtagttctgtcgaccgccgctgacgacgggtcttttatactgtgacgagaggacggtctattatgttagttttggagttggtttatttcgactacccgtagtagtcggacggggcctccgcccgtggggccgagggtaactacgtcggtaccgtaccgtctccgtacgtccctaccaacccgtacgggacccctacggttccccggttccctttccccccgtacggtcccctacccccgttacccgtacccaacggtacgtaccccg

SEQ ID NO: 138614 - DNA, 642 bp, Homo sapiens
  misc_feature: GYAE6OF01EE5PK.46.67.G01.1.454.CMB.1.raw
  modified_base (211)..(211): a, c, t, g, unknown or other
  misc_feature (211)..(211): n is a, c, g, or t
  modified_base (251)..(251): a, c, t, g, unknown or other
  misc_feature (251)..(251): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtncctccatcagtagtgtttctcgtgggctgggtccgcagcnccgttagggagggctggaatacagttggaagtgtctctcatagtggaggttcctattacagtccgtctctcaagtgtcgagtcacctatatctcgtggactacgtcagactaactctacgttttcccagaagtatagacgtttctgtacgaccgtccgtacgtcgacgtacgggtcttttacgttacgtggtgacggagacggtcggtacttaagttagttcgttagtttttagggtagtttacgggttttaactttaccgaaccgtacccgttaggtaccgttccgggtaccgggggtccttacccgggtaccccggtgggggacccgtaaggggtaaccgtacgttcgggtaccgtacccggttacctaccgttcgcccgtaaccccgg

SEQ ID NO: 138615 - DNA, 649 bp, Homo sapiens
  misc_feature: GYAE6OF01AQJQ2.46.67.G01.1.454.CMB.1.raw
  modified_base (282)..(282): a, c, t, g, unknown or other
  misc_feature (282)..(282): n is a, c, g, or t
  modified_base (634)..(634): a, c, t, g, unknown or other
  misc_feature (634)..(634): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtgtggtttctcgtggggctgggtccgcagctcccgaggggagggctggaatacagttggaagtgtctctcatgtggaggttcctattacagtccgtctctnaagagtcgagtcaccatactctcgtaggacacgtccagacaatcgtacgttttcccagaactatgtacgttcgtgtcgaccgccgctacggacgtacgggtctttattacgtggtacgcggaaggtaggtacggtcttaagtttagttaggtttaacgtttttgggaaggttttggttaacttttccggaaccttacccgttaaggcgttaccgggacgggggtcctacccgggtaccccggtacggggccgaagggtaacttacggtaggtacccgtacgtccttcctacgtccctaccgaaccgtacggccctacgtccggtcccttccccggtgtaccctaccctaccnccgtaagcgtacccg

SEQ ID NO: 138616 - DNA, 560 bp, Homo sapiens
  misc_feature: GYAE6OF01EI32H.46.67.G01.1.454.CMB.1.raw
  modified_base (525)..(525): a, c, t, g, unknown or other
  misc_feature (525)..(525): n is a, c, g, or t
  modified_base (555)..(555): a, c, t, g, unknown or other
  misc_feature (555)..(555): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaaccggtgggagacagtgtcaccatcacttgccggcaagtcggaacattgactactattaatggtatcaacatagaccagggacgccctaagctctatctatgctgcatcctagtttagacgtaaaggtgggtcccagtcggtaaggttcagtggcaggttggatcgtagggactagtatttcactctacaccatctaagtaactctagactaacgtagtaagtattttacgacttaactttattacgtagtaccaagtaataattaactaattcggtttacgaccgaaggtacaacgtaactaactaaagttaacgacgtgtacgtcctgacctactattcgtnttactctaactccttacccgactcttacgngtaac

SEQ ID NO: 138617 - DNA, 751 bp, Homo sapiens
  misc_feature: GYAE6OF01ER388.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactgggtgaggccttcggacgaccctgtcccctcacctgccgtctgtctctggtcgccctccatcagttagttggttttccttcggtcggggtcgtcggggtccggcgacgccgtcccggaggggagggcgtaggaatacgagttaggaagtgtctctcgagttaggtcggtacggttaccttagttaccgtacgttcccgttcgtacctacgaagtcgtacgtacgtaccacctatacgtcctcgtacggacctaccgtccacgtacctaatccgttacgttttcccaggtaacgtagtacgttacgttctcggtaccgacccgcccgtacgtcggaaccgttacggggttacgttttactacgttgtacggacggtaggaccggtacgttacgttagttacgttaggtttacgttttagggtacggtttacgtttacgtttaccggtaacctacccgttaggtaccgttaccggggaccgggttcccgtacccgggtaccccgggttacgggaccggtaaacggtaccgtacggttccgggttaccctacccggttacccttacccggttacgtcccccgtaacccgg

SEQ ID NO: 138618 - DNA, 732 bp, Homo sapiens
  misc_feature: GYAE6OF01DG8AB.46.67.G01.1.454.CMB.1.raw
  modified_base (196)..(196): a, c, t, g, unknown or other
  misc_feature (196)..(196): n is a, c, g, or t
  modified_base (199)..(199): a, c, t, g, unknown or other
  misc_feature (199)..(199): n is a, c, g, or t
  modified_base (202)..(202): a, c, t, g, unknown or other
  misc_feature (202)..(202): n is a, c, g, or t
  modified_base (233)..(233): a, c, t, g, unknown or other
  misc_feature (233)..(233): n is a, c, g, or t
  modified_base (419)..(419): a, c, t, g, unknown or other
  misc_feature (419)..(419): n is a, c, g, or t
tcagactagcagtacacgaccggtgctcgatttagagtatacatattgggtttggggagtctcggtcaggacacagcatggacatggagggtccccgctcagctccgtggggctcctgctactctggctccggaggtgccagatgtgacatcgagctcgaccagtcctccatcctcctgtctgacaccggtggganacngtncaccatcacgtcggcggacgtagtacgactntacgactacttaattaagtgtactacaatacgaacgacggacgggaccctacctagtacctactaactcttagtcgctcgactacgttccgtaggttacgaacggtaagggtccggtactggtacgtaggttacgagttcggagtaggtacgtacgtacggtacgggtaactagttctttacccgnttacccacgtaacctaagttaacgtaacgttaacgttaccgtacggaaaccgttaaaggttaacgttaaacgttttacgttttaaacgttaacttaccgttaacgttaaccgtaaactaaagtaaacttttaactaaccgtttaagttttccgtaaccgggaaactacggaaacccgtaacgtaaaacgtaaaacttaaaccggttaaacgtcggttagtacggtaccgtacaacgttaacccgtatttaccttaccgttaacttaccggtaccctttacccgttacccacttacgtacttaagtacttacgg

SEQ ID NO: 138619 - DNA, 672 bp, Homo sapiens
  misc_feature: GYAE6OF01DKT0L.46.67.G01.1.454.CMB.1.raw
  modified_base (656)..(656): a, c, t, g, unknown or other
  misc_feature (656)..(656): n is a, c, g, or t
tcagactagcagtacacgaccggtgctcgatttagagtatacatattgggtttgtcctcctgctggtgacagctcccagatgggtcctgtccctggtgcaactgcaggagtcgggcccacgactggtgaggccttcgggacgaccctgtccctcacctgcgctgtctctggtcgcctccatcagtgttggtttctcgtgggctgggtccgcagcctccgaggggagggctaggaatacgtagttggagttgtctctctagtaggtggtacggtttcctattacgacgttccgtctcacgagacgtcgacgtcaacctatactctcgtaggacctacgtacagtactaactcgttacgttttccagaagtcgtgtacgttcgtcggtacgacccgcgtcgtaggtaccgtcgggtttactttattacgtggtcggacggagtaacggtacgtactttaagttacgtttggttttaagttttgggtaaggtttacgttttaacgtccgtaaccgtaacccgtagtacggtcccggggaagggtccacccggtacccggtgggaccgtagggtactacgtcggtaccctacgttcctcgtacgacccttaccgaaccgtacggtccctacgtcccgttccctcccgcgcccttaccccncaccgatccgtcccgg

SEQ ID NO: 138620 - DNA, 705 bp, Homo sapiens
  misc_feature: GYAE6OF01BG84Z.46.67.G01.1.454.CMB.1.raw
  modified_base (367)..(367): a, c, t, g, unknown or other
  misc_feature (367)..(367): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccgcagctccgaggggaagggctaggaatacagttgggaagtgtctctcaagtagtggtagttcctaattaccagttccgtctctacgaagagtcgagtcaaccatatctcgtggacacgtccagacaatctacgttttcccagaagtagtgtactttcgngtacgaccgccgtcgtcggaacgtaccgggttacttttaattacgttggtcgacggaaggacggtacggtacgttatttagttaggttagtttttagggaacggttttaggtttaacgtttaccggtaacctaacccgttaggtacggttccgggaaccgggggtccgtcccggtaccccgggtggggacccgtaaggggtaacgttaccgttcgggtaccgtacccgttccttaccgttacggccctacccgaaccggaaccgggtacccctaacggttccccggtcccgttcccccgtcgtaccctaccccgtaccctacccgaacgccgtacccg

SEQ ID NO: 138621 - DNA, 747 bp, Homo sapiens
  misc_feature: GYAE6OF01DTLSM.46.67.G01.1.454.CMB.1.raw
  modified_base (195)..(195): a, c, t, g, unknown or other
  misc_feature (195)..(195): n is a, c, g, or t
  modified_base (225)..(225): a, c, t, g, unknown or other
  misc_feature (225)..(225): n is a, c, g, or t
tcagactagcagtacacgaccggtgctcgatttagagtatacatattgggtttgggggagtctcggtcaggacacagcatggacatgagggtccccgctcagctcctggggctcctgctactctggctccggaggtgccagatgtgacatcgagctgacccagtctccatccctccctgtctgcaaccgtggganacagtcgtccaccatcacttcggccggganaagtccggaatattcgaacctaaccgttaattttaaagtggtaactacaaacagtaacgaccgaagggaccgaccctaaagcctacctaactctagtgtctgactactcgtagtttcgacgtaaacggtcgggtacccagtcgtaggttcgaggtcggacgtaggtaggtatcggtagggactaaggttactttaccgaccttcctaacgacctaacgttacgtaacgttaactccgtagtaaccgtaacggttaagtaaaggtttattttacgaactttaaacgtttattaaccgttagtaaaccaagtaacgtaaactttaacttaagtttcggttttaaccggaacgtaaacggtaccctaaacgtaaccttaaaacgtaaaacgttaaaccgtaacggttacggtacggtaacgttaccgaacctacccggtaagtttcccgttacgtttacccgttacccgtaaccgtttaccccgttaccccgtaacccgttaacgttcgttaacggttaaacccg

SEQ ID NO: 138622 - DNA, 855 bp, Homo sapiens
  misc_feature: GYAE6OF01CUERX.46.67.G01.1.454.CMB.1.raw
  modified_base (221)..(221): a, c, t, g, unknown or other
  misc_feature (221)..(221): n is a, c, g, or t
  modified_base (675)..(675): a, c, t, g, unknown or other
  misc_feature (675)..(675): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtcctggtgcaactgcaggagtccgggcccacgactgggtgaggtccttcggacgaccctgtcccctcacccgtgccgcttgtctcgtggtcncctccatcgtagttagttggttttccttcggtcgggggtcgttccggggtcccggcacggtcccgtaccggaaggggaacggggtccttagggtaaacgtaactaggtttagggaaggtttcgtacttccgtactaaggttacgggttacgggtacggttttaccttaacgtttaaccgacggtttccccggttaccttacctaacggtaaaacgggtacggttaccggtaacggtaccctaaaccgtaatttaaccttccggttaccgtaaccggtaaacgtacccgttaccgaaagtaccctaaacgtttcccgtttaacccggtttttccctaaaggaaacgttagttacggttacgtttaccggtacggtcccggtaccccgggtaccgtacgtaccggtaccggtaacgggttacgttttacgtactggtcgacggtagacggtacgtntttaagtttagttacgtttagggttttggtaaggttttcgtttaacgttaccgtaaccgtaccgttaaggacccggttacggggtacccgggtcccgtaccggtcccggggttagggaccggtaacgggtacctcggttcggtacccttacgttccctccgtaccgtccctaaaccccgg

SEQ ID NO: 138623 - DNA, 792 bp, Homo sapiens
  misc_feature: GYAE6OF01BZBE0.46.67.G01.1.454.CMB.1.raw
  modified_base (177)..(177): a, c, t, g, unknown or other
  misc_feature (177)..(177): n is a, c, g, or t
  modified_base (270)..(270): a, c, t, g, unknown or other
  misc_feature (270)..(270): n is a, c, g, or t
  modified_base (298)..(298): a, c, t, g, unknown or other
  misc_feature (298)..(298): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcgggacgaccctgtccctcacctgcgtctgtcctcgtggtcncctcatcagtgttgtttctcggtgggctcgggtccgcacgccgtccggaaggggacgggctaggaactacgtagttggaagttcgtctcgtanagttaggtcggtacgttcctattaccgngttcccgtctacgtaacgaaggtacgtcgaacgtccaaccgtattacttccgtacgacggaacctaccgtacacgtactaaacgttccgtttaaccgttttccaaggtaagtacgtcggttaacgttcgtacggtacccggaccgtcccggatacggaaccgttacgggtttaccttttagtaccgttgggtacgtacggaacggtcgggtaacgttacgttaacgtttagtttacgggttttagttttagggaaggttttacggttttaccttaccggaacccgttaaccgtagggtaccggtacccgggggaacggtccctaacccgggtaccccgggttagggaacccggtaaggtaacgttccggtaccgtaccgtcccgtacctttccgtaaccgtccccgaccgtaaccgggtaccgtccccttacggtcccgttacccccttcccggacgtaccccccttaccaccgtacgaacggtcctaccccgg

SEQ ID NO: 138624 - DNA, 772 bp, Homo sapiens
  misc_feature: GYAE6OF01COJA9.46.67.G01.1.454.CMB.1.raw
  modified_base (295)..(295): a, c, t, g, unknown or other
  misc_feature (295)..(295): n is a, c, g, or t
tcagactagcagtacacgaccggtgctcgatttagagtatacatattgggtttgtcctcctgctgggtggcagctcccagatgggtcctgtccctggtgcaactgcaggagtcgggcccagactggtgaggccttcggagaccctgtccctcacctcgcgctgtctctggtgcctccatcagtagtggtttctcgtgggctgggtccgcagctcccgagggaagggctggaattacagttggaagtgtctactcaagtaggtggtacggttctattacagttccgtctctcaagngtcgagtcaccgattactctcgtaggactacgtcagcaatctagttttccagaagtatgtacgttctgtcgaccgccgtactacgaaccgtacgggttacgttttaacttaccgtggtacgacggtaaggtaacggtacggttaccttaagtttacgttaggtttagtttttacgggtaagttttacgggttttaacgtttccggtaaacccttaacccgttaggtaacgttacccggggtaccggggggtacccgttcccgggtaaacccccgggttgggggaaccccgtaaaggggttaacttaaccgggttccggttaaccgtacccggttccttacccggttacgtacccccgttacccgaaaccgggtaacccgggttacccctaacggtttccccgggtttaccccctttacccccggacggttaccccctaacccccttccgttaacccgaaagggtcccgtaaccccgg

SEQ ID NO: 138625 - DNA, 651 bp, Homo sapiens
  misc_feature: GYAE6OF01EI5MC.46.67.G01.1.454.CMB.1.raw
  modified_base (193)..(193): a, c, t, g, unknown or other
  misc_feature (193)..(193): n is a, c, g, or t
  modified_base (217)..(217): a, c, t, g, unknown or other
  misc_feature (217)..(217): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtcctccatcctccctgtctgcaaccgtggganacagtgtcacatcacttgccgggnaagtcggaacattgactacttattaaattgtatcaacatagaccagggaccgccctaagctacctaatctatgctgcactccgtagttttgacgtaaaggttcgggtcccagtcgtaggttcaggtggcaggtggatcgtagggacagtacttcactctacaccatacagttaatctagactaacggtagtaagttattttacgacttaaacgtttacttaacgttacgtaactaaacgtaagtaaactttaacgtaagtttacgggttttaccggaaccgtaaacggggtacctaaacggtaaccttaaaactaaaacgtttaaaccgaaccttaggtacggtaccgtcgtaacccgtaacgttacttacgttcgttacctttaaccgtacctttaccccgttaccccaccttaacgttccgtaaggttaacc

SEQ ID NO: 138626 - DNA, 740 bp, Homo sapiens
  misc_feature: GYAE6OF01BLIRM.46.67.G01.1.454.CMB.1.raw
  modified_base (250)..(250): a, c, t, g, unknown or other
  misc_feature (250)..(250): n is a, c, g, or t
  modified_base (286)..(286): a, c, t, g, unknown or other
  misc_feature (286)..(286): n is a, c, g, or t
  modified_base (295)..(295): a, c, t, g, unknown or other
  misc_feature (295)..(295): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtcgcctccatcagttagtgtttctcgtgggctcgggtccgcagcctcccgagggacgggctggaatcagttggaagtgtcnctcagtaggtggtacggttcctagttacagtccgtntctacaagngtcgagtacaccatactctcgtaggacacgtccagtactaattccgtaacgtttttacccgagtaaacgtcgttagtaacgttccgttaggttaccggaacccgtccccggttaacgtaccggtaacccggtaaccggggtttccgtttttaaaacgttccggttggttacgggaaccggtaggtaacggtaccggttacttaagtttacgtttggtttaaggtttttgggaaggtttcgtttacgttaccgtaacctacccgttagtacggtaccgggtaccgggtaccgtaccccgggtaccggtacggggaccgtaagggtaactaccggttcgggtacctaccggtcctaccgttcgacccctaccgaaccgacggtaccctcgttacccgttccccgttcccgaccgtccctaccctaccctaccgaacgtcgtaccccg

SEQ ID NO: 138627 - DNA, 519 bp, Homo sapiens
  misc_feature: GYAE6OF01E3QBN.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcagtcggaacattgacacctatttaaattggtatcaacatagaccagggacggccctaagctcctaatctatgctgcatcagtttgcaaagtggggtcccatcgaggttcagtggcagtggatctgggacagatttcactctcaccatcagtaatctgcaacgtgaagtattttgactaactttattactgtacaacagtaattactaattcgtttcggacctaagggactacgactaactaaattaacgaactgtaggctgacacctatcttgtcttcactccttacccgcctattctgtac

SEQ ID NO: 138628 - DNA, 545 bp, Homo sapiens
  misc_feature: GYAE6OF01EVHJ2.46.67.G01.1.454.CMB.1.raw
  modified_base (193)..(193): a, c, t, g, unknown or other
  misc_feature (193)..(193): n is a, c, g, or t
  modified_base (212)..(212): a, c, t, g, unknown or other
  misc_feature (212)..(212): n is a, c, g, or t
  modified_base (326)..(326): a, c, t, g, unknown or other
  misc_feature (326)..(326): n is a, c, g, or t
  modified_base (372)..(372): a, c, t, g, unknown or other
  misc_feature (372)..(372): n is a, c, g, or t
  modified_base (401)..(401): a, c, t, g, unknown or other
  misc_feature (401)..(401): n is a, c, g, or t
  modified_base (434)..(434): a, c, t, g, unknown or other
  misc_feature (434)..(434): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtcccctnacctgcgctgtctctggtncctcatcagtagtgtttctcgtggggctgggtccgcagcctccgagggaggggctggaatacattggaagtgtctctcatagtggaggttcctattacagtccgtctctcaagngtcagtcaccatatctctggacacgtccagcatctacgttttcccngaacgatgattctgtcgaccgcgctgacncgggtctttatactgtgcgagagacggtctatntgtattttggagttggtttactttcgactaccgtagacgtcggaccggggctaccggccccgtggggcccgagggactacgtcggtccacgttctcccttagccctacccg

SEQ ID NO: 138629 - DNA, 606 bp, Homo sapiens
  misc_feature: GYAE6OF01B20UN.46.67.G01.1.454.CMB.1.raw
  modified_base (292)..(292): a, c, t, g, unknown or other
  misc_feature (292)..(292): n is a, c, g, or t
  modified_base (338)..(338): a, c, t, g, unknown or other
  misc_feature (338)..(338): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcgggagaccctgtccctcacctgcgctgtctctggtcgcctccatcagtagttggtttctcgtggggctgggtccgcagctcccgaggggaagggctggaatacgattggaagtgtctctcatagtggagttcctaattacagtccgtctctcaagngtcgagtcaccatactctctgacacgtcagctaatctagtttcccngaagtactgtagttctgtacgaccgccgcgtagaccgtacgggtcttttaattactgtacggacgagacgacggtctaattagtgtagttttggagttgttattcgactaccgtaagtacgtacggacggggctaccggacccggtggaccgtagggaacttcgtacgtacgaccgtcttccgttacgcccgtaccgaaccgtaacggaccctacgtcccggttccctccccgtcggtccctacccgtccctacgaacgtcgtacccg

SEQ ID NO: 138630 - DNA, 551 bp, Homo sapiens
  misc_feature: GYAE6OF01DN98O.46.67.G01.1.454.CMB.1.raw
  modified_base (366)..(366): a, c, t, g, unknown or other
  misc_feature (366)..(366): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctcgtggggctgggtccggcagctcccgaggggaaggggctaggaatacagttggaagtgtctctcatagtggaggttcctattacagtccgtctctcaagagtcgagtcaccatatctctggacacgtccagcaatcagttttccctgaagatgagttctgtgaccgcgctgacncgggcgtttatactgtgcgagagacggctattatgtattttggagttggttatttcgacaccctagagtcgacggggctcggaccccgtggggccagggatacgtggtcaccgtcctccttacgccctccaccgaacgggcccagtccggtccttccccgcgcccaccctccctccacgcgcccg

SEQ ID NO: 138631 - DNA, 780 bp, Homo sapiens
  misc_feature: GYAE6OF01DRQWB.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactgggtgaggccttcggacgaccctgtccctcacctgcgctgtctcgtggtcgcctcatcagtagttggttcttcgtggggctcgggtccgcacgccgtacccggaaggggaagggtctaggtaaatacgtagttgggaagttgtctctacgtagtaggtggtacggttcctaattacgacgttccgtctactacgaagtacgtcgacgttaccaactatacttcctcgtacggacctaccgtaccaagtacctaattaccgttacgtttttacccgaaggaagtacgttacggtacgtttcgttcggaccgtacccggccgtacgtacggaaccggttacgggttacttttaacgttccggtaggtcggaacggtaaggacggtaacgtactttaagttagttaggtttaacggttttagggtacgtttaggtttacgtttacggaaccttacccggtagtacgtccggggtaacggggtcctaccgggaccccggtaggggacccaagggtacttacggtcgtaacccgtaccggttccttacccgtaaccgtccccgaaccaacccgggtaaccggtccccttaacggtccccggttacccccgtcccccgacgtaccccctacccgtacccgaaccgtacgtacccggtacccg

SEQ ID NO: 138632 - DNA, 646 bp, Homo sapiens
  misc_feature: GYAE6OF01CHQPU.46.67.G01.1.454.CMB.1.raw
  modified_base (220)..(220): a, c, t, g, unknown or other
  misc_feature (220)..(220): n is a, c, g, or t
  modified_base (230)..(230): a, c, t, g, unknown or other
  misc_feature (230)..(230): n is a, c, g, or t
  modified_base (352)..(352): a, c, t, g, unknown or other
  misc_feature (352)..(352): n is a, c, g, or t
tcagactagcagtacacgaccggtgctcgatttagagtatacatattggggtttggggagtctcggtcaggacacagcatggacatgagggtccccgctcagctcctggggctcctgctactctggctcgaggtgccagatgtgacatcgagctgacccagtctccatcctccctgtctgcaaccggtgggagacagtgtacaccatcacttgccggganaagtcggaanattgacctactattttaaaattggtatacaacatagaccgagggacgaccctaagctacctaatctatgctgcatcctagtttgactaaagtggggtcccagtcgaaggttcagtggctagngatcgtggacagtatttcactctcaaccatactaagtatctctacgtaacgtagaaagttacgttttagacctaaacttaactttaacgttacgtaactaaacgaagttaaactttaactaaagttacggtttttaccggaaccggtaaacgggaaccaacgtaaccttaaacgtaaaactttaaaaccggtaaccttaggtacggtacgtacgaccgtaacctacgttacttacgttacctttaccgtacctttacccgttacccgtaccctacgtttccgtaagttaacccg

SEQ ID NO: 138633 - DNA, 565 bp, Homo sapiens
  misc_feature: GYAE6OF01B0RMY.46.67.G01.1.454.CMB.1.raw
  modified_base (210)..(210): a, c, t, g, unknown or other
  misc_feature (210)..(210): n is a, c, g, or t
  modified_base (251)..(251): a, c, t, g, unknown or other
  misc_feature (251)..(251): n is a, c, g, or t
  modified_base (278)..(278): a, c, t, g, unknown or other
  misc_feature (278)..(278): n is a, c, g, or t
  modified_base (286)..(286): a, c, t, g, unknown or other
  misc_feature (286)..(286): n is a, c, g, or t
  modified_base (486)..(486): a, c, t, g, unknown or other
  misc_feature (486)..(486): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccgnagctcccgagggagggctggaatacattggaagtgtctctnatagtggagttcctattacagtccgtntctcaagngtcgagtcacatatctctggacacgtccagcaatctacgttttccagaagatgagttctgtcgaccgccgtcgtcgaacgtacgggtcttttatactggtcgcgagagacggtctattagtgttagttttggagttgttattcgactaccgtagacgtcggacgggtctcgcccgtgggaccagggtactacgtcggtcnccgtctccgtagccctaccgaccgacggtcccacggttccgtacccttccccgcgtcctacccctccacaacgcgtccg

SEQ ID NO: 138634 - DNA, 778 bp, Homo sapiens
  misc_feature: GYAE6OF01B6IC4.46.67.G01.1.454.CMB.1.raw
  modified_base (212)..(212): a, c, t, g, unknown or other
  misc_feature (212)..(212): n is a, c, g, or t
  modified_base (332)..(332): a, c, t, g, unknown or other
  misc_feature (332)..(332): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactgggtgaggccttcggagaccctgtccctcacctgcgctgtctctggtncctcatcagtagtggtttctcgtgggtctgggtccggctagctccgaggggaagggcgtaggaatacagttggaagtgtctctcagtagtggagttctattacagtccgtctctacaagngtcgtagtcacctatatctcgtgacacgtacagctaagtctacgttttccagaacgtgtagtacgttctgtacgaccgccgtcgtcggaacgtacgggttacgttttacgttacgttcggtcgacggtaggaacgggtaaccggtacttaagttttaacggtttggtttaaggtttttttacggggtaagggttttacgggttttaacgtttttaccggaaacccgtttaaccccggttaaagggttaaccggttaccccgggggtaacccggggggttacccggttacccccggggtaaaccccccggggttccgggggggtaaccccggtaaaggggggttaaacccgtttaccgggtttacccggggttaccccgttaaccccgggttttcccccgttaaccccgggtttaaccccggacccccggttttaaacccccccggg

SEQ ID NO: 138635 - DNA, 576 bp, Homo sapiens
  misc_feature: GYAE6OF01D4MFJ.46.67.G01.1.454.CMB.1.raw
  modified_base (188)..(188): a, c, t, g, unknown or other
  misc_feature (188)..(188): n is a, c, g, or t
  modified_base (212)..(212): a, c, t, g, unknown or other
  misc_feature (212)..(212): n is a, c, g, or t
  modified_base (221)..(221): a, c, t, g, unknown or other
  misc_feature (221)..(221): n is a, c, g, or t
  modified_base (242)..(242): a, c, t, g, unknown or other
  misc_feature (242)..(242): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcacgtgganacagtgtcacatcacttgccgganagtcgaacnttgactactatttaatgtatnaacatagaccagggaccgccctaagcctactaatctatcgctgctatccgtaggtttcgactaaagggttcgggtaccctagtcgtaggttcagtggcagtgatcgtagggactagtcttccactctcaactatactagtaatctagacgtaacgtagtaagttactttagtactaactttattactagtacaactagtaattactaagttggtttacgacctaaagggactaacgtactaaacgtaaagttaaacgactagtcgactcgacctaccgttattacgttctacgtttcctaacgttcccttacccgactaactcgttaacgtacg

SEQ ID NO: 138636 - DNA, 689 bp, Homo sapiens
  misc_feature: GYAE6OF01DL5O5.46.67.G01.1.454.CMB.1.raw
  modified_base (199)..(199): a, c, t, g, unknown or other
  misc_feature (199)..(199): n is a, c, g, or t
tcagactagcagtacacgaccggtgctcgatttagagtatacatagttagggggtttggggagtctcggtcaggacacagcatggacatgagggtccccgctcagctcctggggctcctgctactctggctccgaggtgccagatgtgacatcgagctgacccagtcctccatccctcctgtctgccaaccggtggganacagtcgtaccacctatccacgttcggccgggtacaacggtcggaactagttcgactaaccttaagtttaaagttggtaactacaaactagtaacgaccgagggaccgaccctaagcctactaactctactgctgctactccgtagtttacgacgtaaggtcgggtcccagtcgagttcagtgcgagtcggatcgtagggactagtacttcgactctcacctatacgtagtaactcgtcgaacctacggtagtaagttagtttacgaacttaactttagtttacgtacgtaactaaacgtagttaaacttaacgttaaagtttcgggtttaaccggaaccggtaaacgggtaccgttaaccgtaaacgttaaacgttaaacggttaaccgtaacgtttcgggacggtaccgtacgacctacccgtattccgttacgttaccttaccgtaccgttacccgttaccccgaccttaccgttccgtgttaaccg

SEQ ID NO: 138637 - DNA, 789 bp, Homo sapiens
  misc_feature: GYAE6OF01ACEJV.46.67.G01.1.454.CMB.1.raw
  modified_base (219)..(219): a, c, t, g, unknown or other
  misc_feature (219)..(219): n is a, c, g, or t
tcagactagcagtacacgaccggtgctcgatttagagtatacatattgggtttggggagtctcggtcaggacacagcatggacatgaggtcccgctcagctcctggggctcctgctactctggctccgaggtgccagatgtgacatcgagctgacccagtctccactcctcctgtctgacaaccgtggagacagtgtccaccatcacgttcgccggganaagtcggaacattgacaccgttatttaaagttggtatcaactatagaccgagggaccggaccctaagtctacctaacgtactaacttcggcttcgactactacctagtttcgactaaggtcgggtcccagtccgtaggtcacggttcggcaggttgtactcgtaacgggtacaggttactttccgaaccgtttcgtacctaacccgtagttccgtaaagttacttacggtacgtaaccgttaacgggtactttaaaggttaacgttttcgaaccgtttaaacgtttaccgtttaaggttccgttaaacctaaacggtaagtttaaatttaaccccgtaaaggttttttaccgggtttttaaccgggaaaccccgtaaaggggttaacccgttaaacccgggtaaaccctttaaactaaaaccggttttaaaaccgacggtttaaccgggtacgttacccgttaacgaacccgttaaccgttactttaaacggttcctttaaacccggtttacttaacccggtttaccccgttaccccggttaaccttaaccttggttaacccgtttaacg

SEQ ID NO: 138638 - DNA, 709 bp, Homo sapiens
  misc_feature: GYAE6OF01C61YB.46.67.G01.1.454.CMB.1.raw
  modified_base (349)..(349): a, c, t, g, unknown or other
  misc_feature (349)..(349): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctcgtggtgcctcatcagtagtgtttctcgtgggctgggtccggcagcctccgaggggaacggggctaggaaatacgagttggaagtcgtactctacataggtggtaggttcctattacagtccgtctctcaagagtcgagtcactatatctctcggactacgtcagcaagtctagttccagaagntgtagttctgtcgaccgccgtatcggaacgtcgggttacttttaagtacgttggtacggacgaggtaacggtacggtacttaagtttagtgttttagtttttacgggtagtttaggtttaacgtttcgtaaccgtaacccgtagtacggttacccgggacgggggtccttacccgggacccggttccgggggaccgtaacggggtaactacggttcggtacccgtaccgttcccgttaccttacggccccttacccggaacccggaaccgggtacccctacggttccccgggttccccctttacccccggtcggtacccccttacccctacccgttaccctaaaccggccgtaaccccgg

SEQ ID NO: 138639 - DNA, 782 bp, Homo sapiens
  misc_feature: GYAE6OF01ADKJD.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatccctcctgtctgacgaaccggtgggagacagtgtccaccatcacgttcggaccggacaaggtcggaacagttacgactaaccttaatttaaagttggtaattacaactaagttaacgaaccgtaacggggaccggtcccctaaaggccttacctaatactaactggtctacgcctactcccgtagttttacggacgtaaaacggttccgggggtacccagttccggtaaggtttaccgaaggtcggaccgtaaggtcggtaacgttcgtacggggaactaaggttactttaccgaccttacctaccaacctacgttacgtaagttacgttacgtacggtaccgtaacgtaaggttaagttacgttttacggaacttaaacctttaacgttacttagtaaccctaaacgtaagtttaaacctttaacgtaacgttttacggtttacccgggaaaccggtaacggaaccgttaaccgttaaacgtaacgttaaaaacgttaaaccgtaacgttacggttacgggaccttaacggaaccctaccgtaacgtttccgtacgtttaccgttactaaccgtttcccccgtacccgttaacctacttcgttacgtaaaccg

SEQ ID NO: 138640 - DNA, 757 bp, Homo sapiens
  misc_feature: GYAE6OF01E3FNI.46.67.G01.1.454.CMB.1.raw
  modified_base (328)..(328): a, c, t, g, unknown or other
  misc_feature (328)..(328): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtgtggtttctcgtggggctgggtccgcagcctccgagggagggctggaatacgattggaagtgtctctcataggtggaggttcctattacagttccgtctctcaagngtcgagtcaccatactctcgtgacacgtcagctaactctacgttttccctagaacgtatgtagtttctacggtcgaccccgtccggtctacggtaacccggtaaccgggggttcgttttaaacgtttaccgttggttcgggaccgtaagggtaacggtaaccggggtactttaagtttaagttggttaacggtttttttagggtaggtttagggttttaacgttttacccggaaccgttaccccggttaaggtaaccggtttaccggggacccgggggggttccgtttaaccccggggtaaccccccgggttcggggggtacccccggtaaacgggggtaacgtttaaaccggttaccggggttaccccgttaaccccgggtttacccgtttaccccgggtttaaccgtcccccgttaaaccccccggg

SEQ ID NO: 138641 - DNA, 567 bp, Homo sapiens
  misc_feature: GYAE6OF01BFXKD.46.67.G01.1.454.CMB.1.raw
  modified_base (291)..(291): a, c, t, g, unknown or other
  misc_feature (291)..(291): n is a, c, g, or t
  modified_base (460)..(460): a, c, t, g, unknown or other
  misc_feature (460)..(460): n is a, c, g, or t
  modified_base (478)..(478): a, c, t, g, unknown or other
  misc_feature (478)..(478): n is a, c, g, or t
  modified_base (541)..(541): a, c, t, g, unknown or other
  misc_feature (541)..(541): n is a, c, g, or t
tcagactagcagtacacgaccggtgctcgatttagagtatacatattgggtttgtcctcctgctggtggcagctcccagatgggtcctgtccctggtgcaactgcaggagtccgggcccacgactggtgaggccttcggagaccctgtccctcacctgcgctgtctctggtgcctcatcagtagtggtttctcgtgggctgggtccgcagcctccgagggaagggctggaatacagttggaagtgtctctcagtagtggtaggttcctattacgagtccgtctctcgaagngtcgatcaccatactctctggacacgtccagactaactctagttttcccaggtaagataggtacgtttctagtcgacccgtccgcttcgacgacgggtcttttatacgtggtcgacgaggacgcggtactagttatgtagttttggagttgttacttcgaacacctagngtcggacgggctcgccgnggaccaggtactgtcgcacgtctctacgcctaccgacgacgcccacgtccggtccctccccgngccctaccctcctccaagcgtacccg

SEQ ID NO: 138642 - DNA, 790 bp, Homo sapiens
  misc_feature: GYAE6OF01BL8EU.46.67.G01.1.454.CMB.1.raw
  modified_base (217)..(217): a, c, t, g, unknown or other
  misc_feature (217)..(217): n is a, c, g, or t
  modified_base (255)..(255): a, c, t, g, unknown or other
  misc_feature (255)..(255): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtccgggcccacgactgggtgacggccttcggacgaccctgtccctcacctgcgctgtctcgtggtcncctcatcagttagttgtttctcgtggggctgggtccgnacgcctaccggagggacgggctaggaatacgagttaggaagttcgtctctactagtaggtggtacggttacctatttacgacgttcctctctacgaagtacgtcgacgtaccaacgtattactccgttacgtacggaacctaccgttaccgaagtacctaacttaccgttacgtttttacccgaaggtaaacgttagttacggttagtttccgtagggttacccggacccgccggtacgtacgggtaaccggtaccgggtttacttttacgtacgttcggtacggtaacgtagggaacggtacggttctaaagttttacgttaggtttacgttttttaggggtaggtttaacggtttttaccgttaaccggaccgttaacccggttaggtaccggttacccgggggaccgggggtttaccccgtaccccggggtacccgggttacgggggtaccgtaaacgggttaaccgttccggttacggtaccccgttacccggttaccttacccggttacccggtaccccgtaaccccggg

SEQ ID NO: 138643 - DNA, 816 bp, Homo sapiens
  misc_feature: GYAE6OF01A9UP0.46.67.G01.1.454.CMB.1.raw
tcagactagcagtacacgaccggtgctcgatttagagtatacatattgggtttgtcctcctgctggtggcagctcccagatgggtcctgtccctggtgcaactgcgaggacgtccgggcccacgactggtgaggcccttcggacgaccctcgtccctcacctgcgctcgtctctggtcgcctcatcagtgttgtttctcgtgggctcgggtccgacacgccgtaccggaaggggacgggctaggaactacgtagttagggaagttcgtctctacgaagttaggtggtacggtttccttaacgttacgtacggttcccgtcttacgtaacgaaagtacggttacgaacgttaccaaccgtattacttcctacggtacgaacctaccgtaccaagactaaacgttcctttaacggtttttaccaaggtaaatacggttaggttaacgtttcgtcggtaccggtaccccgtccggtacgtacggaaccggttacggggttttacttttaacgtttacgtgggtacgacggtaaggtacgggtaaccggttactttaagtttagttacggttttaaggttttcgggtagttttacggtttactttacccggaccttaaccgttaggaccgggttccgggaccggggttccctacccgggacccgggtacggggaccgtaaacgggtacgttaccgtcggttacccgtaccgttccctcgttaccgccccttacccgaaccggtaccgtccctaccggttccccgttccccttaccccggcgttacccctaccccgtacctaaccggacgtcccgtaccgg

SEQ ID NO: 138644 - DNA, 676 bp, Homo sapiens
  misc_feature: GYAE6OF01BGA8K.46.67.G01.1.454.CMB.1.raw
  modified_base (192)..(192): a, c, t, g, unknown or other
  misc_feature (192)..(192): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttggccggcaagtcggaacattgacaccttatttaaattggtatacaacatacgaccgagggaccgaccctaagctacctaatctatgctgcactcctagtttgacgtaaaggtcgggtaccagtcgtaggttcaggtggactagtggatcgagggactagtacttcgactctacactatacaagttaatcgtagacctaacgtagtaaagttacgttttacgaaccttaactttaactttaaccgttacgttaacctaaacgtaaggttaaactttaaccgttaagtttacggttttaccggaaccgtaaacggggtacctaaaccggtaaacttaaaccgtaaaacgttaaaccgtaacgttaggtacgtaccgtacggtaccctaacgttacgttaccgttcgttacccgtttactacccgtttaccccgttaccccgtaacccttacgttccgtaaggttaacc

SEQ ID NO: 138645 - DNA, 575 bp, Homo sapiens
  misc_feature: GYAE6OF01D1QKQ.46.67.G01.1.454.CMB.1.raw
  modified_base (551)..(551): a, c, t, g, unknown or other
  misc_feature (551)..(551): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaaccgtggagacagtgtcaccatcacttgccgggacaagtcggaactattgactaccttaatttaaattggtaatcaaacatagaccagggtaccgaccctaagcctacctaatctatcgctgactatcctagtttgacgaaaggtgggtacccagtcgagttcaggtggcagtgatcgtgggacagtacttcactctacacctatactagttaatcgttgacaacgtagtaagtatttagtactaactttattactgtacaacaataattaactaagtttcgttttaacggacctaaagggtaactaaccgtaactaaacgtaaaagttaaacgtaactggtacgctagactaccgtatcttatcttacncgttcctacccgatactctgtaac

SEQ ID NO: 138646 - DNA, 732 bp, Homo sapiens
  misc_feature: GYAE6OF01B34W7.46.67.G01.1.454.CMB.1.raw
  modified_base (586)..(586): a, c, t, g, unknown or other
  misc_feature (586)..(586): n is a, c, g, or t
  modified_base (651)..(651): a, c, t, g, unknown or other
  misc_feature (651)..(651): n is a, c, g, or t
tcagactagcagtacacgaccggtgctcgatttagagtatacatattgggtttgtcctcctgctgggtggcagctcccagatgggtcctgtccctggtgcaactgcagggagtccgggcccacgactgggtgagggccttcgggacgaccctggtcccctacaccgtgccgctgtcctcgtggtcgcctaccatccgtaaggttggttcggttttctcggtgggggtcttcgggggtccgactacggcccgtacccgggaagggggaacggggtctaagggaaactacgtaggttagggaagttcgtcctactacgaagttaggtagggttacggttacccttaagttaacgacgttcccgtctactacgaaggtcgtcgaagtccaactatactctacgacgaccacgtcagactaacttccgttacgtttaccgaaggaagtatacggttacgttcgtacggtaccggacccgtccggacgtacggaaccgttacggggtttactttaactacggtggtacgacggagtacggtacgtattagttagtgtttagtttcggagtttaggtactcgactacgtagnggtcgggacggtcctaccggccggagggaccgtaaggtactcgtcggtccaccgttctccgtacncccgtaccgaaccgtcggaccctcggtcccgttcccctacccggcgtaccccgtaccctaccgtaaccgagtcccgtaccg

SEQ ID NO: 138647 - DNA, 614 bp, Homo sapiens
  misc_feature: GYAE6OF01BLH86.46.67.G01.1.454.CMB.1.raw
tcagactagcagtacacgaccggtgctcgatttagagtatacatattgggtttggggagtctcggtcaggacacagcatggacatgagggtccccgctcagctcctgggggctcctgctactctggctccgaggtgccagatgtgacatcgagctgacccagtctccatcctccctgtctgcaaccggtgggagacagtgtcaccatcacttggccgggcaagtcggaacattgacacctatttaaatggtatcaacatagaccagggacgccctaagctcctaatctatgctgctatcctagtttgacgaaaggtcggggtcccagtcggtaggttcaggtggcaggtggatcgtgggacagtatttcactctacacctatacagtaatctagacaacggtgtaagttagtttagacttaacttagttactagtacaacagtaaattactaagttcgttttaccggaaccgtaagggacctaaacggtaaccttaaacgtaaaacttaaaccggtaacttacggtacggtacctacgaccgtaacctaacttcgttaccgtttacttaccctacgttccccgttaccccgtaccttacttccgttagtaaccg

SEQ ID NO: 138648 - DNA, 676 bp, Homo sapiens
  misc_feature: GYAE6OF01BCKT8.46.67.G01.1.454.CMB.1.raw
  modified_base (172)..(172): a, c, t, g, unknown or other
  misc_feature (172)..(172): n is a, c, g, or t
  modified_base (211)..(211): a, c, t, g, unknown or other
  misc_feature (211)..(211): n is a, c, g, or t
  modified_base (291)..(291): a, c, t, g, unknown or other
  misc_feature (291)..(291): n is a, c, g, or t
  modified_base (340)..(340): a, c, t, g, unknown or other
  misc_feature (340)..(340): n is a, c, g, or t
  modified_base (636)..(636): a, c, t, g, unknown or other
  misc_feature (636)..(636): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtcncctcatcagttagttggtttcttcgtgggctgggtccgnagctccgagggagggctggaatacagttggagtgtctctacagtagtggaggttcctattacagttccgtctctacaagntcgagtcactatactctctggacacgcccagcaactctacgttttcccngaagtatagtacgttacgtgtacgaccgtccgtcgtcgacgtacgggtacgtttttacgttacgtggttacgacggtaagtaggtaccggactttaagtttacgttagtttaggtttttacggaaggttttggtttactttaccgacgttaccctagacgttacgggccgggtcctacccggtacccggtgggacgtaagggtaacttccggttacggtcctacccgttcttacccgtagtcccccttacgaacccgtacgggtaccctacggttcccggttccccttcccccggnggttccccacccccttacacccgtaacggaccctccccgg

SEQ ID NO: 138649 - DNA, 595 bp, Homo sapiens
  misc_feature: GYAE6OF01CR5YM.46.67.G01.1.454.CMB.1.raw
  modified_base (193)..(193): a, c, t, g, unknown or other
  misc_feature (193)..(193): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtggganacagtgtcaccatcacttgccgggcaagtcgaacattgacactatttaaattgtatcaacatagaccgagggaccgaccctaagctacctaatctatgctgcatccagtttgactaaggtcgggtcccagtcgaggttcagtggcagtggatcgtgggacagtatttcactctacaccatcgaagttaactctagacgtaacgttgaaattacttttagaacttaactttatacgtagtaacaaacgtagtaaactttactaagtttcggtttaccggaaccgtaaggtaacctacgtaaaccttaaacgtaaaacttaaacggtaacttggtacggaccttacgacctaaccgtattctacgttccttacctacttcccttaccccgattactcgtgtaac

SEQ ID NO: 138650 - DNA, 850 bp, Homo sapiens
  misc_feature: GYAE6OF01BCIC9.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactgggtgaggccttcggacgaccctgtcccctcacctgcgtctcgtctcgtggtcgcctcatcgtagtagtcggtttcttcgtgggggtctcggggtccgcgacgccgtaccggaggggaacgggctaggaatacgtagttaggaagtcgtctcgtctaagttggtgggtacggtttccttaagttaccgacgttcccgttactcctacgaaggtacggtccggaagttaccaaccgtattacgttccgttacggtacgggtaaccctacccggttaccgaacggtacctaaacgttcccgtttaaccgttttttccccgaaggtaaacgtaggttacggttaacgtttcccgtaggttacccgggacccgtccggtaccgttacggaaccggttaaccggggtttaccgttttaacgtttacgttcggtacgtaccgggtaaggttaaccgggacgttaacttacgtttaagttggttttaacggtttttaggggtaaggttttcgggttttaacgtttacccggaacccgttaccgttaagtaccgggtaccggggtacccgggggttaacccgtacccggtaccccggggttaggggaccgtaaacgggggtaacctttaccgggtaccgggttacccgttaccccggtttaccgttacccgtttacgccccgttaaaccccggg

SEQ ID NO: 138651 - DNA, 623 bp, Homo sapiens
  misc_feature: GYAE6OF01EYVXV.46.67.G01.1.454.CMB.1.raw
  modified_base (172)..(172): a, c, t, g, unknown or other
  misc_feature (172)..(172): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtcncctccatcagtagtggtttctcgtgggctgggtccgcagcctacccgaggggaaggggctaggaatacgagttggaagtcgtctctcagttaggtggagtttcctattacgagttccgtctctcaagtgtcgagtcacctattatctcgtaggaccacgtccagcaattcgtacgttttcccagaactagtagtagtttctggtcgacccggtccgcgtagaccgtacgggtcttttatacgtgtagcgagtacggacgtcttattagtgtttagttttggagttagtttattccgactaccgtagacgtcgggacgggcctcggcccgtgggaccgagggtaactcggttcgtaccaccgttcctccgttacgccctaccgaccgacggtcccaggttcccgtaccccttccccgcgtacccctaccctaccctaccgaagcgtaccccg

SEQ ID NO: 138652 - DNA, 716 bp, Homo sapiens
  misc_feature: GYAE6OF01DDLX3.46.67.G01.1.454.CMB.1.raw
  modified_base (197)..(197): a, c, t, g, unknown or other
  misc_feature (197)..(197): n is a, c, g, or t
tcagactagcagtacacgaccggtgctcgatttagagtatacatattgggtttggggagtctcggtcaggacacagcatggacatgagggtccccgctcagctcctggggctcctgctactctggctccggaggtgccagatgtgacatcgagctgacccagtcctccatccctccctgtctcgcaaccggtggganacagtgtcaccatcacgttcggccgggacaaggtccggaactagttacgaacctaaccttaaattttaaaagttcggtaactacaaactaagtaacgaaccggaacggggacccggtacccctaaagcctacctaactctaatgctgcctactcctagtttagaacgtaaggtccgggtaccctagtcggtaggttacaggttggacgtggtaggtagtcggtagggtactagttctttaccgactcctacaacctatacgtaatactcgtacgaacgtaacggtagtaaagtttactttacgtaaccttaaatttaacgttactacgtaactaaactaagtaaactttaactaaggtttaccggtttaccggaacgaaccggtaaccgtcctaaaaaaaaactcgttaaaaagttaaccgaacgttggtacgaccgttacgaaccgtaacctattacgttccgtttaccgttaccttacccttcccgttaccccacgttaccttagtacgttaacccg

SEQ ID NO: 138653 - DNA, 588 bp, Homo sapiens
  misc_feature: GYAE6OF01C96LB.46.67.G01.1.454.CMB.1.raw
  modified_base (219)..(219): a, c, t, g, unknown or other
  misc_feature (219)..(219): n is a, c, g, or t
  modified_base (271)..(271): a, c, t, g, unknown or other
  misc_feature (271)..(271): n is a, c, g, or t
  modified_base (288)..(288): a, c, t, g, unknown or other
  misc_feature (288)..(288): n is a, c, g, or t
tcagactagcagtacacgaccggtgctcgatttagagtatacatattggggtttggggagtctcggtcaggacacagcatggacatgagggtccccgctcagcctcctggggctcctgctactctggctccgaggtgccagatgtgacatcgagctgacccagtctccatcctccctgtctgcaaccgtgggagacagtgtcacagtcacttgcggganaagtcgaacatgacactattaaatgtatcaacatagacaggaccgcctaagntcccccctatctatgcngcatcctagtttgacgtaagtcgggtccagtccgaggttcaacggtggtacgagtggatcgtggaacgagtattctacgtctacgaccaatcagtaactcgtagacaacgtagaagtactttagacctaattagttacctaggtacctaaactaagtaaattactaagtacgtttcggttaaccgaacgtaacggtacgtaaacgttaactaaacgtaaacgtaacgacgtagtcgtagtacgtaacgtacttactcgtcttacgttacttacgttccctaccgacttcgtacgttaacg

SEQ ID NO: 138654 - DNA, 643 bp, Homo sapiens
  misc_feature: GYAE6OF01CPXVZ.46.67.G01.1.454.CMB.1.raw
  modified_base (193)..(193): a, c, t, g, unknown or other
  misc_feature (193)..(193): n is a, c, g, or t
  modified_base (217)..(217): a, c, t, g, unknown or other
  misc_feature (217)..(217): n is a, c, g, or t
  modified_base (228)..(228): a, c, t, g, unknown or other
  misc_feature (228)..(228): n is a, c, g, or t
  modified_base (253)..(253): a, c, t, g, unknown or other
  misc_feature (253)..(253): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaaccgtggagacngtcgtcacatcacgttggccgggnagtcggaactnttgacactatttaagtgtatacaanagtacgaccgagggaccgccctaagctacctaatctaagtgctgcacttcgtagtttcgacgtaaacggttcggggtaccctagtcgggtagtttcgaggttcggcgtaaggtggtactcgtagggactaaggtactttcacgtctacgacctatactagtaactcgtagacctaaggtagtaagttatttgaaccttaactttagttactacggtaactaacgtaagttaattaacgttaatttcggtttaccggaccgaaacgggtactaacggtaacttaaacgtaaaacgtttacgaacgtaggttaccggctagtacccgtaaactctttacgtggtttacccttacggtaccttaccgttaccccgattactcgttaaggtacc

SEQ ID NO: 138655 - DNA, 810 bp, Homo sapiens
  misc_feature: GYAE6OF01DRSBV.46.67.G01.1.454.CMB.1.raw
  modified_base (291)..(291): a, c, t, g, unknown or other
  misc_feature (291)..(291): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggcagctcccgaggggaagggctggaatacattggaagtgtctctcagtagtggaggttcctattacagtccgtctctcaagngtcgagtcaccatatctctggacacgtcagctaatctacgttttcccagaagatgagttctgtcgaccgccgtcgtgaaccgtacgggtcgttttaataccgttggtacgacggaagtaacggtacgggtacttaagtttagttacggtttaagttttttagggtaaggtttacggtttttaacgttttacccggtaaccgttaaccccgttaaaggtacggtttacccgggggtaaccggggggttccccgttaccccgggtaacccccccgggttcgggggggtaccccgtaaacggggggtaaacgtttaacccgggtttacgggttaaccccgtaccccggttaccgtttaccccgtttaaccggacccccgttaccccgtaaaccccggtaaaccggggtaccccccttaacgggtttcccccgggttacccccgttttacccccccggtaccgggtacccccttaaccccccgtttccccgtaaaccccgtaaacggtccgtaaaccccccgg

SEQ ID NO: 138656 - DNA, 514 bp, Homo sapiens
  misc_feature: GYAE6OF01CCU2X.46.67.G01.1.454.CMB.1.raw
  modified_base (217)..(217): a, c, t, g, unknown or other
  misc_feature (217)..(217): n is a, c, g, or t
  modified_base (508)..(508): a, c, t, g, unknown or other
  misc_feature (508)..(508): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggnaagtcgaacattgacactattaaatgtatcaacatagacaggacgccctaagctctaatctatgctgcatccagtttgctaaagtgggtcccagtcgaggttcagtgcagtgatctggacagatttcactctcaccatcagtaatctgcaacgtgaaagtattttacgactaacttattactagtacaaactaagaattaacaaatgttttacgactaagggacagaactaacaaattaaacaactagtaggctagctaccatctcgtcttacattccttacccgactatntgtaac

SEQ ID NO: 138657 - DNA, 632 bp, Homo sapiens
  misc_feature: GYAE6OF01ERE0U.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctcatcagtagtgtttctgtgggctgggtccgcagctccgaggggagggctggaatacattggaagtgctctcagtgtggaggttcctattacagtccgtctctcaagagtcgagtcacctatatctctggaccacgtccagactaatctacgttttcccagaacgatgtacgtttcgtgtacgaccgtccgtcgtcgacgtaccgggtctttactacgtgtgcggaagacggtacgtactattagttagttagttttggaggtttaggtttacttcgtaacctaccgtagcgttacgggtacggggtcctaccggtacccggtcggggacccgtaggggtaacctacggtcggtccgtaccgttccttaccgttacgtccctaacccaccggtaaccgggcccctagtccggttccccttacccctcggcccctacccctcctaccaacgccgtacccg

SEQ ID NO: 138658 - DNA, 604 bp, Homo sapiens
  misc_feature: GYAE6OF01BLRAE.46.67.G01.1.454.CMB.1.raw
  modified_base (192)..(192): a, c, t, g, unknown or other
  misc_feature (192)..(192): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccgggcaagtcggacattgacacctatttaatgtatcaacatagaccagggaccggccctaagctcctaatctatgctgcattccagtttcgacgtaacggtggggtccccagtcggaggtttcagtggcgtaggtggatcgtgggacagtatttccacttctcacctatctaagttactcgtagactaacggtagtaacgttattttgacttaacgtttattactgtaacaactaacgtaatttactaagtttcggtttaccggaccgtaaagggacctaacggttaactaaacgtaaactttaacgaaccttggtacggtcttacggaccctacgttactcttcgtactttccctaatttccccttacccaccgttattccgttagtaacc

SEQ ID NO: 138659 - DNA, 640 bp, Homo sapiens
  misc_feature: GYAE6OF01EKVEQ.46.67.G01.1.454.CMB.1.raw
  modified_base (135)..(135): a, c, t, g, unknown or other
  misc_feature (135)..(135): n is a, c, g, or t
  modified_base (190)..(190): a, c, t, g, unknown or other
  misc_feature (190)..(190): n is a, c, g, or t
  modified_base (399)..(399): a, c, t, g, unknown or other
  misc_feature (399)..(399): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtnccagatgtgacatcgagctgacccagtctccatcctcctgtctgcaacgtggganacagtgtccacatctacgttcggccggcaagtcggaactagttcgactaccttatttaaagttggtatacaacatacgaccgaggaccgccctaagcctacctaatctatgctcgactactcctagtttcgacgtaacggtcggtcctagtcgtagttcaggtgcaggtagctcgaggactagtacttcactcacaccatactaattancctagactaaggtacgtaatttactttacgaccttaaactttacgttacgtagtaacaaacgtaagttaactttaacgtaagttcggtttaccggaacggtaacggaactaacgttaaacctaaacgtaaaacgttaaccggtaatacggtcgttactaaccggtcaaccgttgttacgttcgtttaccttaccgttaaccgtttccccgttaccccgtacctactttacggtattaaccg

SEQ ID NO: 138660 - DNA, 639 bp, Homo sapiens
  misc_feature: GYAE6OF01ADDVK.46.67.G01.1.454.CMB.1.raw
  modified_base (194)..(194): a, c, t, g, unknown or other
  misc_feature (194)..(194): n is a, c, g, or t
  modified_base (200)..(200): a, c, t, g, unknown or other
  misc_feature (200)..(200): n is a, c, g, or t
  modified_base (388)..(388): a, c, t, g, unknown or other
  misc_feature (388)..(388): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccactcctccctgtctgcgaaccgtggganacagtntcaccatcacttggccggcaagtcggaactattgacctaccttaattaattgtatcaactatagaccgaggaccgaccctaagcctacctaatcctatgctgcactctagttgacgaaggtcggggtccctagtccggtaggtttaccaggtcggcgtaggtggactcggtagggactagtacttacncctctaccacctactcaacgttagtctacgtacgaacgtagtaagttactttgtaacttactttaacttacgtacgtacctaacgtaactaaacgtttacttaacgtttacgtttaccgaacccgtaagggtacctaaccgtaacgtaaacttaacgttaaaccagttaggaccgtcgtacaccgtacctagttacgtcttaccgttacacccgtttaccgttacccctacgttacgttcctagttaaccg

SEQ ID NO: 138661 - DNA, 818 bp, Homo sapiens
  misc_feature: GYAE6OF01DUUPC.46.67.G01.1.454.CMB.1.raw
  modified_base (172)..(172): a, c, t, g, unknown or other
  misc_feature (172)..(172): n is a, c, g, or t
  modified_base (339)..(339): a, c, t, g, unknown or other
  misc_feature (339)..(339): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtcncctccatcagttagttggtttcttcgtggggtctggggtccggcagcctcccgaggggaaggggctaggaatacgagttgggaagtcgtctctcgagtaggtgggtaggtttcctaattacacgttcccgtctctacaagagtcgagtccaccatatctctcggacncgtcagacatctagtttccctagaacatgagtttcgtgtacggccgcgtctggtaaccgaccggggttacgttttactttacgttggtacgggacggtaaggacgggtaccggtacgtttaagtttacgttaggttttaaggttttttagggtaaggttttacgggttttagttttacccggtaaccgtaacccccgttagggtaccgttacccggggtaaccgggggtccgttaccccggtaacccccggggttcgggggacccggtaagggggtaaaccttacggttccggttacccgtaccccggtttccgttacccttacccgggtccccctaaccccggtaaacccggtaacccggggtacccccttaaccgggtttcccccggttaccccccgttttcccccccggtacccggtacccccccttacccccttaccccccgtacccgtaaaccggtccccggttaacccccggg

SEQ ID NO: 138662 - DNA, 825 bp, Homo sapiens
  misc_feature: GYAE6OF01CVQZT.46.67.G01.1.454.CMB.1.raw
  modified_base (217)..(217): a, c, t, g, unknown or other
  misc_feature (217)..(217): n is a, c, g, or t
  modified_base (259)..(259): a, c, t, g, unknown or other
  misc_feature (259)..(259): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtccgggcccacgactggtgaggccttcggacgaccctgtcccctcacctgccgctgtctcgtggtcncctcatcgagttgttggtttctcgtggggctggggtcccggnacgcctccggaaggggaacgggctaggaatacgagttggaagttgtctctcagtaggtggtacggttcctatttacgacgttcccgtctctacgaagtagtacgacgtaccactattacgttcttcgtacggaacctaccggtccaagtacctaagtttcccgtttaccggttttttaccccgaaggtaaacggttacgttaacgggtttacggttttaccgttacggggttacccggaacccccgggtcccggtaccggttaaccgggtaacccggggttaacccggggttttaccgttttttaacgtttcggtttagggttacgggaccgggtaacgggtaaccggtacgggttaacttttaagttttaggtttagggttttaaggttttttaggggtacggttttacggtttttaacggtttaccgaacccgtttaacccgttagggtaaccggttccggggtaaccgggggtcccttacccggggtaccccgggtggggaaccgtaaggggtaaccttacggtcggtcccgtaccgtcctttaccgtcgtcccgtaacccgg

SEQ ID NO: 138663 - DNA, 724 bp, Homo sapiens
  misc_feature: GYAE6OF01EV66S.46.67.G01.1.454.CMB.1.raw
  modified_base (305)..(305): a, c, t, g, unknown or other
  misc_feature (305)..(305): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctcgtggggctgggtccggcagctccgaggggagggctggaatacattggaagtgtctctcatagtggaggttcctattacagtccgtctctcaagagtcgagtcaccatattcntcgcgactaccgtacagactactacgttaccgtttccagtaacgtagtagtacgttcgtcgtaccgacccggccgtcgtacgtaccggtacgggtttcgtttaacgttacgttggtacggtacggtaacggtaacgggtaccggttacgtttaagtttagtaggttttaggttttagggtacggtttacggttttacgttaccgtaacccgtaacccgtaacggtacgttaccggggaccggggtccgtaccccggtacccgggtccgggaccggtaacgggtaacgttaccgtcggtaccgtacccgttccttacccgttaccgtaccccgtaccgtaacccggtaccggtaccctccggtcccgttacccccgttccccggtccggacccctaccccgttcccaccgtaacggtccg

SEQ ID NO: 138664 - DNA, 592 bp, Homo sapiens
  misc_feature: GYAE6OF01BD3OW.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtgggagacagtgtcaccatcacttggccgggcaagtcggaacattgacacctatttaaattggtatcaacatagaccagggaccgccctaagctacctaatctatgctgcatcctagtttgacaaaggtcgggtcccagtcgaggttcagtggcgtagtggatcgtagggacagtatttcactctacaccatacagtatctgactaacgtagtaagttatttagacttaaactttattactgtacaaactagtaacttactaatttcgtttaccggaaccgtaacgggtactaacgtaactaaactaaacgttaaacgaacgttggtacggtactacggacctacctattcttcgttacctttaccgtactttacccttaccccgaccttacttccgtcgttaac

SEQ ID NO: 138665 - DNA, 580 bp, Homo sapiens
  misc_feature: GYAE6OF01BG33Q.46.67.G01.1.454.CMB.1.raw
  modified_base (351)..(351): a, c, t, g, unknown or other
  misc_feature (351)..(351): n is a, c, g, or t
  modified_base (373)..(373): a, c, t, g, unknown or other
  misc_feature (373)..(373): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacaccttatttaaattggtatcaacatagaccagggacgccctaagctctaatctatgctgcatcctagtttgacaaaggtcggggtcccagtcgtaggttcaggtggcaggtgattcgngggacagtattcacgtctcacntacagtaatctgactaacgtgaatatttagactaacttattactgtactaaactagtaacttactaattcgtttacggaccgaagggtacctaacggaacttaaacgtaaacgttaaaccgtaacgttggtacggtactacgaccgtaactacttacgttgttccgttactaccttccgttaccccgacctacttccgtgtaaaccg

SEQ ID NO: 138666 - DNA, 743 bp, Homo sapiens
  misc_feature: GYAE6OF01B0LUR.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtcccctcacctgcgctgtctctggtgcctccatcagtagtgtttcttctggggctgggtccggcagcctcccgaggggaaggggctggaatacattgggaagtgtctctcataggtggaggtttcctattacagtccgtcctctacaagcgtcgagtccacctatactctcgtggactacgtccagcaatctacgttttccctagaagtattgtacgtttcgtgtacggacccggtcccgtcgtacgaccggtaccggggttcttttaacgtttacgtggttacggcggtaaggtacggaccgggttacttaagttttaacgttggtttaacgttttttggggtaaggttttacgggttttaacgttttacccggaaccgttaaccccggtttaagggtaccggttacccgggggtaacccggggggtaccccgtttaccccggggtacccccggggttggggggtaccccggtaaagggggtaaacctttaaccgggttccgggttacccgtaccccggtttccgttaccccggtttacgcccccgttaaccccgg

SEQ ID NO: 138667 - DNA, 563 bp, Homo sapiens
  misc_feature: GYAE6OF01BBRCY.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacgccctaagctcctaatctatgctgcatccagtttgcaaaggtcgggtcccagtcgagttcagtggcagtggatcgtgggacagtatttcactctcacatcagtaatctgacaacgtgaatatttgactaactttattactgtacaactaagtaacttacaagtttcgtttaccggaccgtaagggtaacctacgtaacttaactaaacttaacgtaactagtacggtactacgacctacctatacgttcgttaccttactaccgttacctaccccgtactacttccgtagtaacg

SEQ ID NO: 138668 - DNA, 654 bp, Homo sapiens
  misc_feature: GYAE6OF01BOKS0.46.67.G01.1.454.CMB.1.raw
  modified_base (232)..(232): a, c, t, g, unknown or other
  misc_feature (232)..(232): n is a, c, g, or t
  modified_base (435)..(435): a, c, t, g, unknown or other
  misc_feature (435)..(435): n is a, c, g, or t
tcagactagcagtacacgaccggtgctcgatttagagtatacatattgggtttgggggagtctcggtcaggacacagcatggacatgagggtccccgctcagctcctcggggctcctgctactctggctccgaggtgccagatgtgacatcgagctgacccagtctccatcctccctgtctgcaaccgtgggagacagtgtcaccatcacttggccgggcaaggtcggaacnttgactaccttatttaaatggtatcaacatacgaccgagggaccgccctaagctcctaatctatgctgcatcctagtttgacgtaaaggtcggggtacccagtccggaggtttcgaggtcgggactaggtggacttcggtaggggactagtactttccacgttctacacctatacagttactctacgacgaacgtagtaagtntttacgacttaactttagttactacgtactaacgaagttaactttaactaagtttcggtttaccggaaccggtaaacgggtaaccctaacgtaacttaaactaaaacgttaaaccggtaacgttcggtaggtaccgtacgtaccgaccttagttaccgttcgttaccttaccttaccgtttacccgttaccccgtacccttaacttccgttagtaaccg

SEQ ID NO: 138669 - DNA, 885 bp, Homo sapiens
  misc_feature: GYAE6OF01CWIFK.46.67.G01.1.454.CMB.1.raw
  modified_base (172)..(172): a, c, t, g, unknown or other
  misc_feature (172)..(172): n is a, c, g, or t
  modified_base (209)..(209): a, c, t, g, unknown or other
  misc_feature (209)..(209): n is a, c, g, or t
  modified_base (265)..(265): a, c, t, g, unknown or other
  misc_feature (265)..(265): n is a, c, g, or t
tcagactagcagtacacgaccggtgctcgatttagagtatacatattgggtttgtcctcctactggtggcagctcccagatgggtcctgtccctggtgcaactgcaggagtcgggcccacgactggtgaggccttcggagaccctgtccctcacctgcgctgtctctggtcncctccatcagtagtgtttctcgtggggctgggtccgnagcctccggaggggaaggggtctaggaactacgtagttaggaagtcgttctcctanagttaggtgggtacgtttaccttaagttaccacggttcccgtacttacctacgtaagtacgttccgtaacgtaccaacctaattacttccgtacggtacggaacccaccggttaccaagtacctaaactttccgtttaaccgttttacccgaggtaaacgtagttacgttacgtttccgtcggtacgaccccgccggtactacggtaacggtacggggtttacttttaagtaccgtggtacggacggaacgtaacgggtacggttactttaagtttaggttggttttaaggttttaggtaggttttaggttttaaccttaccgaaccgttaacccgtaggtacggtacccgggggtaccggggtaccgtaccccgggttacccgggtaggggtaacccgtaacgggttaacgtaccggttaccggttacccgttaacccggttccgttacccttaacggtaccccctaccccggtaaaccgggtaccccgggtaccccttacggtttccccccgggtttccccctttaccccccggggtaccgttaccccccgttaacccccccgttaccccgttaacccggtaaaacccggtcccggtaccccggttaaacccccgggg

SEQ ID NO: 138670 - DNA, 761 bp, Homo sapiens
  misc_feature: GYAE6OF01AC89C.46.67.G01.1.454.CMB.1.raw
  modified_base (178)..(178): a, c, t, g, unknown or other
  misc_feature (178)..(178): n is a, c, g, or t
  modified_base (283)..(283): a, c, t, g, unknown or other
  misc_feature (283)..(283): n is a, c, g, or t
  modified_base (350)..(350): a, c, t, g, unknown or other
  misc_feature (350)..(350): n is a, c, g, or t
tcagactagcagtacacgaccggtgctcgatttagagtatacatattgggtttgtcctcctgctggtggcagctcccagatgggtcctgtccctggtgcaactgcgaggacgtcgggcccacgacgtggtgaggtccttcggacgccctcgtccctcacctgcgctgtctcgtggtcncctccatcgtagttggttggtttctcggtcggggtcgtcgggtccggacacgcccgtacccgaaggggaacgggcttaggatacgtagtggaacgttcgtctcgntagtacggtggtacgttcctaagttacacgtccgtctctacgaagtcgtacgattccaacctatacncgtacgtacggactaccgtcaagtactacgtaccttacgtttaccgagtaagtatcggtacgttcgtaggaccggtacccgtcgtacgttcggaaccggttaccggtttaccttttaagtaccgtggtacgaccggtaggtacgtacgttagtttagttgttagtttagtttagggtagtttacgttaacgtaccaccgtacgtacggaccggtccgggtaccggtaccgtacccggtaccggcgggaccgtaagggtacccttccgtacgttacccgcccgttttccaccgtacccgacccaccccgtaaacgggtcccgtacccttaccggttcccccccgttacccgacccccggttacccggtacccccttacccgttaaccgaacccggtgaacccggttcccccg

SEQ ID NO: 138671 - DNA, 564 bp, Homo sapiens
  misc_feature: GYAE6OF01EOWD9.46.67.G01.1.454.CMB.1.raw
  modified_base (335)..(335): a, c, t, g, unknown or other
  misc_feature (335)..(335): n is a, c, g, or t
  modified_base (535)..(535): a, c, t, g, unknown or other
  misc_feature (535)..(535): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctctgggctgggtccgcagctcccgagggagggctggaatacattggaagtgtctctcatagtggaggttcctattacagtccgtctctcaagagtcgagtcaccatatctcgtggacacgtcagcaatcagttttccagaacgntgagttctgtcgaccgcgctgacgacgggtcgtttatacgtgtgacgagagtacggtcttattagtgtagttttggagttgtttattcgactaccgtagacgtcggacggggctcggacccgtgggaccagggtattacgtcggtacaccgtctccgtacgccctaccgaccgacggtcccagtcccgtccttcccccgnggtcccaccctcctaccgacgcgtacccg

SEQ ID NO: 138672 - DNA, 675 bp, Homo sapiens
  misc_feature: GYAE6OF01DOME8.46.67.G01.1.454.CMB.1.raw
  modified_base (191)..(191): a, c, t, g, unknown or other
  misc_feature (191)..(191): n is a, c, g, or t
  modified_base (194)..(194): a, c, t, g, unknown or other
  misc_feature (194)..(194): n is a, c, g, or t
  modified_base (215)..(215): a, c, t, g, unknown or other
  misc_feature (215)..(215): n is a, c, g, or t
  modified_base (227)..(227): a, c, t, g, unknown or other
  misc_feature (227)..(227): n is a, c, g, or t
  modified_base (465)..(465): a, c, t, g, unknown or other
  misc_feature (465)..(465): n is a, c, g, or t
tcagactagcagtacacgaccggtgctcgatttagagtatacatattgggtttgggggagtctcggtcaggacacagcatggacatgagggtccccgctcagctcctggggctcctgctactctggctccgaggtgccagatgtgacatcgagctgacccagtctccatcctcctgtctgcaacgtggganacngtgcacatcacttggccgganaagtcggaactnttcgactaaccttatttaaagttggtatacaacataagaccgacggggaccgaccctaagcctacctaatctatgctgcatccgtagtttcgacgtaaaggttcgggtacccagtcggtacggttcgagtcggacgtaggtggtaatcggtagggaactacgttactttaccaccgttcctaccgaacttacgttacgaacgttaacttcgtaacgaccgtaacggtacgttaagttnttttacgacttaaacgtttattacgttactaactaaacgtaataaacgtttactaaagttttcggtttaacccggacgtaaacgggtaactaacgtaacttaaacgtaaaagttaacgacgttacggttacggactacggtacccaacgttacgtttacgtcgttaccttacaccgtttcccgttacccgacttaccgtgtcgttaaccg

SEQ ID NO: 138673 - DNA, 638 bp, Homo sapiens
  misc_feature: GYAE6OF01DTP5F.46.67.G01.1.454.CMB.1.raw
  modified_base (192)..(192): a, c, t, g, unknown or other
  misc_feature (192)..(192): n is a, c, g, or t
  modified_base (458)..(458): a, c, t, g, unknown or other
  misc_feature (458)..(458): n is a, c, g, or t
  modified_base (475)..(475): a, c, t, g, unknown or other
  misc_feature (475)..(475): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaaccggtggganacagtgtcaccatctacgttcggccgggacaacggtacggaactagttacgaacctacctttaatttaaagttggtaactacaaactagtaacgacccggaaggggtacccgtaccctaagccttaacctaatcctatcgtctgactatccgtagttcgacgtaaggtcggtaccagtcggtagtcaggtcggcaggtgatcgagggactagttacttcgacttctacaactatactaagttactctagaactaggtataagtttntttacgacttaactttnttactcgtaacaacgtaagttaacttactagtttcggttacgacgaaggacctacgtaacttaacaaaacgttacgacgttggtacgccgttagacctaaccgttagttccgttacgttaccttactacgttccccgttaccccatttactcgtaacgtaacg

SEQ ID NO: 138674 - DNA, 967 bp, Homo sapiens
  misc_feature: GYAE6OF01C4Q5Q.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtcgcctccatcagtagttcggtttctcgtggggctgggtccggcagcctaccgaggggagggctaggaatacagttaggaagtcgtctctagagtaggtggtacggttacctagttacgacgtccgttctactaccgtaaggacggtcgtacgtacctaacctattaactcctaccggttacggaacccgtaccgttaccgaaacggtacctaaaactttcccgttaccggttttttaccccgagggtaaaacgtagttacggttacggttttaccgtacgggtaccggacccccggtaccggtaccggtacggaacccggggttaccgggtttacgtttttaacgttaccggtggttacgggacggtaacgggtaacggtaccgggttactttaagtttacggtttacggttttaacggttttttaggggaagggtttttacgggttttaaccgtttaacccgggtaacccgttaaccccggttaaagggtaccgggtttaccgggggaaccccgggggttaccgttaccccccggggtaaccccggggttaacggggggaaccccggtaaaggggttaaccccgttacgggttacccggttaccccggttaccccggttacccgtttaacccggttacccggtaccccccttaaaccgggtaacccccgggaaacccggggttaccctaacccccgggtttccccgggtttacccccttacccccccgggttacccggtcccccgtaaacccccgttacccccgtaacgaaacccggggtcccgtaaccccccggg

SEQ ID NO: 138675 - DNA, 615 bp, Homo sapiens
  misc_feature: GYAE6OF01B9MBC.46.67.G01.1.454.CMB.1.raw
  modified_base (217)..(217): a, c, t, g, unknown or other
  misc_feature (217)..(217): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggnaagtcggaacattcgacacctatttaaattggtatcaacatagaccagggaccgccctaagctcctaatctatgctgcatccagtttgcaaaggtgggtcccagtcgagttcagtggcagtggatcgtgggacagtatttcactctcaccatactagtaactctagctaacgtgtaaagtattttcggacttaaacgtttattaacgttacgttacaaactaggtaaactttaacgtaaacttttcggtttacggaccgtaaagggtacctaaacgtaacccttaaactaaaacgttaaacgaacgttaggtacggaccttacgaccgtaaccgtacttacgtttcggttacccttactacttccccttaccccggtactacgttcctacggttaacc

SEQ ID NO: 138676 - DNA, 727 bp, Homo sapiens
  misc_feature: GYAE6OF01CT1QC.46.67.G01.1.454.CMB.1.raw
  modified_base (172)..(172): a, c, t, g, unknown or other
  misc_feature (172)..(172): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctcgtggtncctccatcagtagtggtttcttcgtgggctgggtccgcagcctcccgaggggaagggctaggaaatacgtagttgggaagttgtcctatacagtagtggtacggtttacctattacagtccgtctctacaaagagttcgagtccaaccatactctctaggacacgtccagcaatctacgttttccagaagtatgtacgttctggtacggaccgtccgctacggaacgtacgggttacgttttaacttacgtggtacgtacgaacggtacggtacggtacgtttaagttagttaggttttagtttttagggtaggtttacggtttaactttaccggtaaccgtaacccgtaggtacgtaccggggtaccggggtacctacccgggtaaccccgggtggggtaacccgtaagggtaaacctacggttcggtaccctaccggttccgttaccttaccggtcccctaaccgaaccggaacccgggtccctacggttccccggttaccccttcccccgtacggtccccttaaccccgtacaacccgtaacgccgtacccg

SEQ ID NO: 138677 - DNA, 738 bp, Homo sapiens
  misc_feature: GYAE6OF01BC08W.46.67.G01.1.454.CMB.1.raw
  modified_base (174)..(174): a, c, t, g, unknown or other
  misc_feature (174)..(174): n is a, c, g, or t
tcagactagcagtacacgaccggtgctcgatttagagtatacatattgggtttgtccctcctgctggtggcagctcccagatgggtcctgtccctggtgcaactgcaggagtccgggcccacgactggtgaggccttcggagaccctgtccctcacctgcgctgtctctggtcncctccatcaagtgtcgtttctcgtgggctcgggtcgacagcctaccggaggggaagggtcctagggaaatacgtagttggaagtgtctctcagtaggtggtacggttacctagttacgagtccgtctctcaagtcgtcgacgtcactatatcgtcgtacggacaccgtccgaactactaaacttcgttacgtttttccccaagtaaacgtgtacggtaacgtttcgttacggtccgaacccgtccggtaccgtacggtaaccggtacggggttactttttaacgttaccgttggttacgaccgggtaaggtacggttacccggtatttaacgtttaggttaggtttacgttttagggtaggtttagtttaccgttacgtaaccctaccgttaacggacggttacgggtacccgggggtcttacccgggacccggttcgggaccggtaaggtacgtaccgtcggtacctccggttacctccgtacgcccctaacgaccgtaccggtccctacggttccccgttcctaccccggcgtaccctacccgacctaccaggaactcccgg

SEQ ID NO: 138678 - DNA, 645 bp, Homo sapiens
  misc_feature: GYAE6OF01BXBTM.46.67.G01.1.454.CMB.1.raw
  modified_base (192)..(192): a, c, t, g, unknown or other
  misc_feature (192)..(192): n is a, c, g, or t
  modified_base (215)..(215): a, c, t, g, unknown or other
  misc_feature (215)..(215): n is a, c, g, or t
  modified_base (224)..(224): a, c, t, g, unknown or other
  misc_feature (224)..(224): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcacatcacttgccggnaagtcgaantgacacttattaaatggtatcaacatacgaccgagggaccgaccctaagcctacctaatcctaatcgctgcattccagtttgactaaaggtcgggtcccatcggagttcagtggcaggtggatcgtagggactagtactttcacttcctacaacctatctaagtaacttcgtacgtcgtaaaaaaacgtgtaaacgttagttttagaacgttaactttaactttacgttacgttactaaaccgtaagttaaacttaacgtaacgtttacgttttaccgggaaccgtaaacgggtaaccgtaacgtaaacttaaaccgtaaaacgtttaaaccgtaacgttacggttacgtacgtacgtacgtaacctactacttcgttacttactaccttcccgttaccccgtacctacttcgtacgtaac

SEQ ID NO: 138679 - DNA, 695 bp, Homo sapiens
  misc_feature: GYAE6OF01BVXS8.46.67.G01.1.454.CMB.1.raw
  modified_base (285)..(285): a, c, t, g, unknown or other
  misc_feature (285)..(285): n is a, c, g, or t
  modified_base (303)..(303): a, c, t, g, unknown or other
  misc_feature (303)..(303): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctctggggctgggtccgcagctcccgagggagggctggaatacattggaagtgtctctcatagtggaggttcctattacagtccgtctctcaagngtcgagtccaccatatcnctggacacgtccagcaactcttagttttcccagaacgtagttgacgtttcgtaggtcgacccggccgtcgtacgacgtacgggtcttttattaccgttgtcgacggtaagacggtacggtacttagtttagttgttacgttttttgggaagtttggttttacgtttacgtacctacccgttagacgttacgggtacgggggtacctcccggtaccccggtcggggacccggtaaggggtaacttaaccggttcgggttacccgtacccggttccgttacccgtttacgccccgttaccgaaccccgaacgggtcccctaacggttcccgggtttcccttccccccgttcggtaccctacccccgttacccgtaccccgaagaccgtaccccg

SEQ ID NO: 138680 - DNA, 641 bp, Homo sapiens
  misc_feature: GYAE6OF01EPX5E.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctcgtggggctgggtccgcagcctcccgagggagggctggaatacattggaagtgtactctcataggtggacggttcctattacaggttccgtctctcaagagtcgagtccacctatactctctggaccacgtccagacaatctacgttttccctagaagtatggtagttctaggtcgacccgccgtctagaccgtacgggtacgttttacttacgtgttcgacgagacgtacggtacttagttagtagttagtttttagggaggtttaggtttactttcgaacctacccgtaaggtacgtccgggtaaccggggtcccttacccggtaccccggtcgggggacccgtaggggtaacttaccggtcggtacctacccggttccttacccgttacgccccgttaacccccgg

SEQ ID NO: 138681 - DNA, 774 bp, Homo sapiens
  misc_feature: GYAE6OF01DLX2N.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgacggccttcggagaccctgtccctcacctgcgctgtctcgtggtcgcctcatctagttagttggttttcttcggtcgggggtcgtcggggtcccggacacgtccgtacccggagggggaacggggtctagggaaatacgagttagggaagttgtccttcgtacaagttacggtaggtacggttaccttattacgtacgttcccgtctcgtacgaagtacgtacgtaacgtacaacctattactctccgtggaacctaccggtaccacggtaactaaacttcgtttaaccgttttcccgtaaggaaagttgttcggttaacgtttcgtacggtaccggaaccccgccggtacgtacggtaaccggttacgggtttacgttttaagtacgtggtcgacggtaaggacggtacggttattattagttacgttagttttacgggagtttaggttacttacggaacctaccggtagtcggtaccggggtaccggggtaccctaccccgggtacccgggtacggggacccggtaaacggggtaaccgttaccggttacggttaccccgtacccggtttacccttacccggtaaccgtccccgtaaaccccgg

SEQ ID NO: 138682 - DNA, 692 bp, Homo sapiens
  misc_feature: GYAE6OF01DMRM9.46.67.G01.1.454.CMB.1.raw
  modified_base (219)..(219): a, c, t, g, unknown or other
  misc_feature (219)..(219): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtcctccatccctcctgtctgcaaccggtgggagacagtgtcaccatcacttcgccggnaagtcggaacattgacacttatttaatgtatacaacatagaccgagggaccggaccctaagcctacctaatctatcgctgcactccgtagtttacgacgtaaacggttcgggtaccccagttccggacggtttaccgaggtcggtacgtaggtaggtacgttcggtacggggaactaagttacgtttacaccttccgtaccacctacttacgtaagttaactccgtagaccgtaagttagtaaagtttattttacgactttaaactttacgttactacgtaacctaaacgtaagttaaactttaacgttaagtttacggttttaccgggaaccgttaagggtaaccctaaaccgtaaacttaaacgttaaaacgttaacggaaccttagggtacgtaccttacggacctaaccgttattccgttcgttaccttacttaccgttcccttacccgacttaccgtcgtagttaccg

SEQ ID NO: 138683 - DNA, 613 bp, Homo sapiens
  misc_feature: GYAE6OF01DBAO1.46.67.G01.1.454.CMB.1.raw
  modified_base (383)..(383): a, c, t, g, unknown or other
  misc_feature (383)..(383): n is a, c, g, or t
  modified_base (403)..(403): a, c, t, g, unknown or other
  misc_feature (403)..(403): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaaccgtgggagacagtgcacatcacttgccggcaagtcgaacattgacacttatttaatggtatcaacatagaccagggaccggccctaagctactaatctatgctgcatccagtttgactaaaggtcggggtcccagtcgaggttcagtgcagtcggatcgtggacagtagtttacactctccaacctatacagtaattcgngaacgtaacgtagtaaagtnttttagactaactttaattactagtactaaacaagtaaattaacgtaagtttcggttttaccggaaccgtaaagggtaacctaaccggtaaaccttaaacttaaaacgttaaacggtaacgttacggtaggaccttaggacctaacccgtaattccgttactacgtttacctaactttccctttaccccgccttaacgtcttggtaaacc

SEQ ID NO: 138684 - DNA, 609 bp, Homo sapiens
  misc_feature: GYAE6OF01CHPBE.46.67.G01.1.454.CMB.1.raw
  modified_base (192)..(192): a, c, t, g, unknown or other
  misc_feature (192)..(192): n is a, c, g, or t
  modified_base (216)..(216): a, c, t, g, unknown or other
  misc_feature (216)..(216): n is a, c, g, or t
  modified_base (226)..(226): a, c, t, g, unknown or other
  misc_feature (226)..(226): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccggnaagtcgaacnttgacactatttaaatgtatcaacatagaccagggaccgaccctaagctacctaatctatgctgcactccagtttgactaaggtcgggtacccagtcgaggttcagtggcagtggatcgtaggacagtactttcactctacacatacaagtaactcgtgacgtaacgtagtaagtacttttagaacttaaactttacttaacttacggtaacaaacgtaagtaaatttaactaaagtttcggtttaccggaaccgaaagggtacctaacgtaactaaactaaacttaacgaacgttggtacgctacggacctaaccgtattaccgttacgttaccttaccgtacgttaccccgttaccccgaccttaactccgtgttaaaccg

SEQ ID NO: 138685 - DNA, 693 bp, Homo sapiens
  misc_feature: GYAE6OF01D599N.46.67.G01.1.454.CMB.1.raw
  modified_base (301)..(301): a, c, t, g, unknown or other
  misc_feature (301)..(301): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtcccctcacctgcgctgtctctggtgcctccatcagtagttggtttcttcgtggggctgggtccggcagcctcccgaggggaaggggctaggaatacagttgggaagtcgtctctcagtagtggaggttcctattacagtcccgtctctacaagngtcgagtcaccatatctctggacacgtccagcaatctatttcccagagatgagttctgtcgaccgccgcgtcgacgtacgggtcttttagtactggtacgcgagacggaccggtcttaattagttgtttagtttttagggtagtttggtttactttcggaccctacccgtagaccgttcggggaccggggtctacccggtaccccggtcgggggaccgaacggggtaacttaccggttcggtacccgtacccgttccttacccgttacggccccctaccgaaaccccggtaccgggtacccccgtacgttccccgggttaccccctttccccccggtacgggtccccctaccccccgttacccctaaccccggaaggtacccgtacccccgg

SEQ ID NO: 138686 - DNA, 661 bp, Homo sapiens
  misc_feature: GYAE6OF01C0MCS.46.67.G01.1.454.CMB.1.raw
  modified_base (201)..(201): a, c, t, g, unknown or other
  misc_feature (201)..(201): n is a, c, g, or t
  modified_base (229)..(229): a, c, t, g, unknown or other
  misc_feature (229)..(229): n is a, c, g, or t
  modified_base (468)..(468): a, c, t, g, unknown or other
  misc_feature (468)..(468): n is a, c, g, or t
  modified_base (596)..(596): a, c, t, g, unknown or other
  misc_feature (596)..(596): n is a, c, g, or t
  modified_base (605)..(605): a, c, t, g, unknown or other
  misc_feature (605)..(605): n is a, c, g, or t
tcagactagcagtacacgaccggtgctcgatttagagtatacatattgggtttggggagtctcggtcaggacacagcatggacatgagggtccccgctcagctcctggggctcctgctactctggctccggaggtgccagatgtgacatcgagctcgacccagtctccattccctccctgtctggccaacggtgggacacngtcgtcacctatcacgttggccgggtanaagtcggaactattcgaacctacctttaattttaaagttggtaactaccaaactagtacgaccgaaggggcccgaccctaagcctacctaatctatgctgcactccgtagtttgacgtaaagggtggtacccagtcggtaggttcaggttcggcgtagtggactcgtacgggactaggtactttccactcctacgacctataccgaagttactcgtacgaaccgtagttacgaagtttntttacgaacttaacgtttattactagtacaaaacgtcgttaaattaacgtttacgttacggtttaccggaaccgtaaggggaacccttaacggtaaacctaaacggtaaaattaaccgggattacggnaccggttanaccgtacctagttcgttcgttctaacctccgtttccacccgtatcgttcgtcgtac

SEQ ID NO: 138687 - DNA, 584 bp, Homo sapiens
  misc_feature: GYAE6OF01B63H2.46.67.G01.1.454.CMB.1.raw
  modified_base (192)..(192): a, c, t, g, unknown or other
  misc_feature (192)..(192): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacgttgccgggcaagtcggaacattgactacctattttaatggtatcaacatagaccagggacgccctaagctcctaatctatgctgcatccagtttgcaaaggtggggtcccatcgaggttcagtggcagtggatcgtgggacaggtactttcgactctacacctatccaagtaatctgactaagtacgtaagtattttgacttaactttatttactgttacaacaagtaattaactaatttgttttaccggacctaagggactaacgtaactaactaaattaaacgaacttcggtacggctacggaccaaccgtattaccgttcgttaccttaccgtaacttcccgtttccccgaccctacgttcctcggttaacc

SEQ ID NO: 138688 - DNA, 611 bp, Homo sapiens
  misc_feature: GYAE6OF01A93DD.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctcgtggtcgcctccatcagtgtgtttctcgtgggctgggtccgcagcctcccgagggagggctggaatacagttggagtgtctctcatagtggtaggttcctattactacgtccgtctctacaagtacgtcgacgtccaccatactcgtctacggactaccgtaccagactaactcttacgttttccctagaagtagtgtacgtttcgtgtcgacccgtccgctacgacgtacgggttcgtttacgttacgtggtcgacgagtacgcggtacttagttagttgtttagttttgggtagtttaggtttacttacgacctacccgtaggcgtacgggaccgggtcctacccggcccggtgggaccgtacgggtactcgttcgtcctaccgtcctccgtcgccctacccg

SEQ ID NO: 138689 - DNA, 605 bp, Homo sapiens
  misc_feature: GYAE6OF01BCGDE.46.67.G01.1.454.CMB.1.raw
  modified_base (377)..(377): a, c, t, g, unknown or other
  misc_feature (377)..(377): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacttatttaattggtatcaacatagaccagggaccgccctaagctacctaatctatgctgcatcctagtttgactaaaaggtcggggtacccagtcggtagtttcaggtggcaggtgactcgtgggactagtactttcacttcncacctatctaagtactctgactaacgtagtaaagttattttagacttaactttattaacttgtacaacgtaagtaatttaactagtttcggttaccggaccgtaacggtacacgtaacttaaacgtaaattaaccggaacttaggtacggtaccttagtacctaaccgtattaccgtcgttccttaccttaccttcccgttaccccgtactacttccgtacgtaaccg

SEQ ID NO: 138690 - DNA, 724 bp, Homo sapiens
  misc_feature: GYAE6OF01A1LMC.46.67.G01.1.454.CMB.1.raw
  modified_base (194)..(194): a, c, t, g, unknown or other
  misc_feature (194)..(194): n is a, c, g, or t
  modified_base (218)..(218): a, c, t, g, unknown or other
  misc_feature (218)..(218): n is a, c, g, or t
  modified_base (230)..(230): a, c, t, g, unknown or other
  misc_feature (230)..(230): n is a, c, g, or t
  modified_base (659)..(659): a, c, t, g, unknown or other
  misc_feature (659)..(659): n is a, c, g, or t
tcagactagcagtacacgaccggtgctcgatttagagtatacatattgggtttgggtagtctcggtcaggacacagcatggacatgagggtccccgctcagctcctggggctcctgctactctggcctcggaggtgccagatgtgacatcgagctgacccagtcctccatcctccctgtctgccaccggtggancagtgtcaccatcacttgccgganaagtcggaactnttgacctacttatttaaagtggtatacaatatagaccgtaagggaccgaccctaagacctcctaatactactcgctcgctactccgtagttttacgacgtaaacggttccgggtaccctagtccgtaaggtttcgaacgtggacgaggttcgggaatcggttagggacgtaagtacgtttccaccgttcgttaccgaacctagttaccgtaagttaaccgttccgtaggtaaccgttaacggttagtaacggtttagttttaccggaacctttaaactttacgtttaccgtacgttaaactaaaccgtaagttaaacttttaacgaagtttttcgggtttaaccggaaccgttaaggaaccgtaacctaaacgttaacctaaaaggtttaacgaacttgggttacgttaccgacgtaacctaacccgtntttaccccggtatttacctttaccgtacctttaccgaccctacccttaacttcgttaacgtaacc

SEQ ID NO: 138691 - DNA, 860 bp, Homo sapiens
  misc_feature: GYAE6OF01D9KHK.46.67.G01.1.454.CMB.1.raw
  modified_base (182)..(182): a, c, t, g, unknown or other
  misc_feature (182)..(182): n is a, c, g, or t
tcagactagcagtacacgaccggtgctcgatttagagtatacatattgggtttgtcctcctgctggtggcagctcccagatgggtcctgtccctggtgcaactgcaggagtccgggcccacgactgggtgagggtccttcgggacgacccctgtcccctcacctgcgtctgtctcgtggtcncctcatctagtggttcgtttctcggtggggcttcggggtccgacacggtcccgtacccggaggggggtaacgggtctaggaacttacgtagttaggggaacgttgttcctctagtaagttaggtggtacggttacctaagttacgacgttccgtctctacgaagtcgtacgagtaccacctattactcgtacgtacggtaccacggttaccagtacctaacgttccgttaccgttttacccgaagtaacgtagttcggttacgttacgtcggtaccgtacccggccgtaccgtacggtaacccggtaccgggtttacgttttacgtacggttcggtacggtaccggtaaggtacggtaaccggtatttaacggtttagttaggtttaagggttttagggtaggtttacggttttaacgttacccggtaacccgttaaccggtaaggtccggtaaccggggtccggggttacctaccccggggtaacccggtacggggtaacccggtaagggtaaccgttaccggtcggttacccgtacccggttacctaccgtttacccggaccccttacggaaacccccgggtaccggtaccccgttaccggttccccggttacccccgttccccggtacggtacccccttaccccgtacccgtaaccggccgacccgtaaccccgg

SEQ ID NO: 138692 - DNA, 855 bp, Homo sapiens
  misc_feature: GYAE6OF01E5KVH.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagacccctgtccctcacctgcgctgtctctggtcgcctccatcagtagttggtttcttcgtggggctgggtccggcagcctcccgaggggaggggctggaatacagttggaagtgtctctcagttagtggaggttcctattacagtccgtctctcaagagtcggatcaccatatctcgtggacacgtccagtaccaatcgtacgttttcccaggaagtatgtacgttctcggtaccgacccgcgtcgtacggtaccgtacggggttcgtttttaataccgttggtaggaccggaaggaccggtaacggtaccttaagtttaacgttggtttaagtttttaggggtaggttttaagggtttacgttttaccgaacccgttaaccccgtaacgggtacgttacccggggtaccggggggtacctaccccggggtacccccgggttacgggggacccgtaaacggggggttaaaccttaaccgggtttacgggttaccccgtaaccccgggtttcccttaaccccggtttaaccccgtaccccccggttaacccccggtaaacccccgggtaaacccggggttcccccccctaaaccgggtttccccccggggttttccccccgtttaccccccccccggttacccggggtacccccccttaccccccccggtttaccccgttaacccccgaaaaccggggtaccccgtaaccccccggg

SEQ ID NO: 138693 - DNA, 864 bp, Homo sapiens
  misc_feature: GYAE6OF01AXH1C.46.67.G01.1.454.CMB.1.raw
  modified_base (175)..(175): a, c, t, g, unknown or other
  misc_feature (175)..(175): n is a, c, g, or t
tcagactagcagtacacgaccggtgctcgatttagagtatacatattgggtttgtcctcctgctggtggcagctcccagatgggtcctgtccctggtgcaactgcaggagtccgggcccacgactggtgaggccttcgggacgaccctgtccctcacctgcgctgtctcgtggtncctccatcagtagttggtttcttcgtggggctgggtccgcagcctccgaggggaagggctaggaatacagttggaagttcgtctctcagtacggtggtaacggtttccttaattacgacgttcccgttcttctacgaaaggtagtaccgagtaccacctaattacttctcgtacggacctaccgtaccacgactaattacttacgttttcctaggaactagtagttacgttcgtgtaccgacccgtccgtacgtacggaccgtaccgggttacgttttaacgtacttcgggtacgacggaaggtaccgtacggttacttaagtttaagttacgtttaagggtttttagggtacgtttttagggtttaacttttcggaacccttaacccggttaggtaaccggttaccgggggtaccggggtccccggtaccccgggttaacccccggggttacggggggtaaccccggtaaagggggttaaacccgtttcccgggttaccgggttaacccccgttaaccggtttccccgtttaacccgggttaaccccgtaccccggttaacccccgaaacccgggtacccgggtaccccgttaacccggttcccccgggtttaccccccgttccccccggtaccggtaccccccttaccccggttaccccaacccggtaaacggcccgtacccccggg

SEQ ID NO: 138694 - DNA, 744 bp, Homo sapiens
  misc_feature: GYAE6OF01BLC1L.46.67.G01.1.454.CMB.1.raw
  modified_base (213)..(213): a, c, t, g, unknown or other
  misc_feature (213)..(213): n is a, c, g, or t
  modified_base (259)..(259): a, c, t, g, unknown or other
  misc_feature (259)..(259): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggtccttcggagaccctgtccctcacctgcgctgtctctggtcncctccatcgagttgttcggtttcttcgtggggtcctggggtcccgnacgcctaccggaggggaacgggctaggaatactagttggaagtgtctctctagttaggtggtacggttcctattacgtacgttccgttctctacagtagtcgtagtaccacgtatactcgttcgtacggaaccgtacgtaccgagtactaaacttccgttaccgttttcccgaagtaacgtattggtacggtttacctggtaccgtacccggtccgtacgttacggaaccggttacgggttacttttacgttacgtggtagtaccggtacggtaacgtcggttacttaagtttcggttacgtttaggttttagggtagttttacggtttacgttaccgtaaccgttacccggttaggaaccgggttcggggtacccggggtaccgttaccccgggtacccggggtagggaacccggttagggaaaccttcggtaccggttacccgtacccgttacgtttacccgtaccggtacccgtaaccccgg

SEQ ID NO: 138695 - DNA, 633 bp, Homo sapiens
  misc_feature: GYAE6OF01BW0PN.46.67.G01.1.454.CMB.1.raw
  modified_base (220)..(220): a, c, t, g, unknown or other
  misc_feature (220)..(220): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtgggagacagtgtcaccatcacttggccggganaagtcggaacattgacacttaatttaaatggtatacaacatagaccagggaccgacctaagctacctaatctatgctgcatccagttgactaaaggtcgggtacccagtcgaggttcaggtggctagtggatcgtagggacagtacttcactctacacatctaagtatctagacaacgtgaagttatttagacttaacttaattacttacgtactaaacgtaagttaaacttacttaaagttcggttttaccggaaccggtaaacgggtaacctaaaccggtaaactaaacgtaaaacgttaaaccggaaacgttagtacggtaccgtacgacccgtaacctacgttaccttacggttacctttacttaccgttacccctttacccccgaccttacttccgttaggttaaccg

SEQ ID NO: 138696 - DNA, 758 bp, Homo sapiens
  misc_feature: GYAE6OF01ACYAG.46.67.G01.1.454.CMB.1.raw
  modified_base (250)..(250): a, c, t, g, unknown or other
  misc_feature (250)..(250): n is a, c, g, or t
tcagactagcagtacacgaccggtgctcgatttagagtatacatattgggtttgtcctcctgctggtggcagctcccagatgggtcctgtccctggtgcaactgcaggagtcggcccagactggtgaggccttcggagaccctgtccctcactgcgctgtctctggtgcctccatcagtgtggtttctcgtggggctgggtccgcagcctccgaaggggagggctaggaatactagttggaatgtctctnagtaggtggtacggttcctaattacgacgttccgtccttctacaaggagtcgacgtccaacctattactcgttcctacggacctacgtcccagtacaacttctacgttttcccagaacgtatcggttagttcgtgtcgacccgtcgcgtagaccgtacgggttaccttttaatcgtggtcggtcgaggtacggacggtcttaagtttagttagtttagttttagggtagtttacggtttacgttaccgtaacctacccgtaagtacggtccgggtaccggggtcccgtaccgggtaccccggtaggggtacccggtaagggttaaccctacgggttacggttaccccgtacccggttaccgttacccgttaccgtacccccgtaccggaaaccccggtaacggtacccccgttaacccggtttcccggttcccccccgtttacccccgtacccggtccccctacccccgttaccccggtaccctaaaccgggtcccgttaacccccgg

SEQ ID NO: 138697 - DNA, 560 bp, Homo sapiens
  misc_feature: GYAE6OF01E1DF6.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggaccgccctaagctcctaatctatgctgcatccagtttgcaaagtgggtcccagtcgaggttcagtgcagtgatcgtgggacagtattcactctcaccatcagtaatctagcaacgtgaagtattttgactaacttattactagtacaaacgtagtaatttactaattcggttttacggacctaaagggactaacgtaactaaacgaaacttaaacgaactggtaggtaccgtgacctaccgtaataccgttgttaccttacacttcccttaccccgacctacttccgtgtaacc

SEQ ID NO: 138698 - DNA, 753 bp, Homo sapiens
  misc_feature: GYAE6OF01DFHE4.46.67.G01.1.454.CMB.1.raw
  modified_base (222)..(222): a, c, t, g, unknown or other
  misc_feature (222)..(222): n is a, c, g, or t
tcagactagcagtacacgaccggtgctcgatttagagtatacatattgggtttggggagtctcggtcaggacacagcatggacatgagggtccccgctcagctcctggggctcctgctactctggctcgaggtgccagatgtgacatcgagctgacccagtctccatccctccctgtctgacaaccggtgggagacagtgtccaccatcacttggccggganaaggtcggaactattcgactaaccttaatttaaagttggtactacaaactagtaacgaaccgacgggaccgtaccctaagcctacctaatctatcggtctgactactccgtagtttcgacgtaaacggttcgggtaccctagtaccgtaggttcgagtggacgtaggtaggagtcggtaggaacgtagtactttaccgacttcctaccgtaacctactacgtaagttaactcgtacgaaccgtaacggtagtaaacgtttagtttacgtaacttaacgttttaacttacgttagtaacctaaacgtaacgttaaacttaacgttaacggttttcggtttaaccggaaccggtaaacgggtaaccgtaaaccggttaaaccttaaaacgttaaaacgttaaaccggtaacggttaccggttacgggtacctttaacggaaccttaacccgtaatttaccgttacggtttacccttaccttaaccgtttaccccgtttacccccgaccttaacgttcccgttaagttaaaccg

SEQ ID NO: 138699 - DNA, 609 bp, Homo sapiens
  misc_feature: GYAE6OF01ELQYA.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcgaacattgacactaatttaaattggtatacaacatagaccaggaccgaccctaagctacctaatctatgctgacatccagtttgacgtaaaggtcgggtcccagtcggtaggttcaggtgcgaggtggtatcgtgggactagtactttcactctacacctatactagtatcctacgaacgtacgtagtaagttatttacgaacttaactttacttacgtacgttaactaaacgtaagtaacttaactaagtttacggttttaccggaacgtaaagggtacctaacgtaaacttaaacgtaaagttaaaccgaacgttaggtacgacgtacgacctacctattacttcgttacttactaccgttcctaccctactacttcgtgttaac

SEQ ID NO: 138700 - DNA, 618 bp, Homo sapiens
  misc_feature: GYAE6OF01EBQMC.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggcagctcccgaggggaaggggctggaatacagttgggaagtgtctctcatagtggaggttcctattacagtccgtctctcaagagtcgagtcaccatatctctggacacgtccagactaatctacgttttacccagaagatagtagttctgtcgaccgccgctgacgtacgggtctttattacgtgtgcgagacgacgtctattattgttagttttaggagttaggttatttacgactacccgtaggtcgtcggacgggggtcctccggaccccggtggggaccgaaggggtacttacgtcggtccgaccgtcctacgttacgccctaccgacccggaacggaccctacgttccccggttcccttcccccgcggtaccccacccgtacccgtaccgaacgcgtaccccg

SEQ ID NO: 138701 - DNA, 630 bp, Homo sapiens
  misc_feature: GYAE6OF01DGXHQ.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtccgggcccacgactggtgaggccttcggagaccctgtccctcacctgccgctgtctcgtggtcgcctccatcagttagtggtttctcgtggggtctcggggtccgcagcctccgagggaaggggctggaatacagttggaagtgtctctcatagtggtagttctattacagtccgtctctacgaagagtcgagtacacctatatctctggacacgtacagactaatctagttttcccagaacgatgatttcgtgtcgaccgcgtctacgacgtacggtctttacttacgtgtagcgagtacgtacggtacttagttacgtgttagttttaggacgttggttactttacgaacctaccgtaagtacgtacgggaccggggtcctaccggtacccggtacgggggaccggtaacggggaaacttaccgggtacggtacccgttaccggtacctttacccgttaccggtcccgtaaccccgg

SEQ ID NO: 138702 - DNA, 596 bp, Homo sapiens
  misc_feature: GYAE6OF01ECTQF.46.67.G01.1.454.CMB.1.raw
  modified_base (230)..(230): a, c, t, g, unknown or other
  misc_feature (230)..(230): n is a, c, g, or t
  modified_base (255)..(255): a, c, t, g, unknown or other
  misc_feature (255)..(255): n is a, c, g, or t
  modified_base (287)..(287): a, c, t, g, unknown or other
  misc_feature (287)..(287): n is a, c, g, or t
  modified_base (399)..(399): a, c, t, g, unknown or other
  misc_feature (399)..(399): n is a, c, g, or t
  modified_base (445)..(445): a, c, t, g, unknown or other
  misc_feature (445)..(445): n is a, c, g, or t
tcagactagcagtacacgaccggtgctcgatttagagtatacatattgggtttggggagtctcggtcaggacacagcatggacatgagggtccccgctcagctcctggggctcctgctactctggctccggaggtgccagatgtgacatcgagctgacccagtcctccatccctccctgtctgcaaccgtgggagacagtgtcacatcacttgccgggcaagtcggaacnttcgactactatttaatgtatcaanatagacagggacgccctaagctctaatctatnctgcatccagtttcgacgaaaggttcggggtccctagtcggtaaggttcgaacggtggacgtaggtgggatcgtgggacagtatttcacgtctcaccatctaagtaatctanactaacgtagtaagttatttagacttaacttacttactgtactaanaagtaattacgtaattcggttttacgaaccgtaacggactaaccgtaactaactaaaattaaccgtaacgttagtaggtacctagtacctaaccgtattacttcgttaccgttctaacgttccctaccccgtacctactccgtgttaaacg

SEQ ID NO: 138703 - DNA, 706 bp, Homo sapiens
  misc_feature: GYAE6OF01AM59K.46.67.G01.1.454.CMB.1.raw
  modified_base (174)..(174): a, c, t, g, unknown or other
  misc_feature (174)..(174): n is a, c, g, or t
  modified_base (367)..(367): a, c, t, g, unknown or other
  misc_feature (367)..(367): n is a, c, g, or t
tcagactagcagtacacgaccggtgctcgatttagagtatacatattgggtttgtcctcctgctggtggcagctcccagatgggtcctgtccctggtgcaactgcagggagtcgggcccacgactggtgaggccttcgggagaccctgtccctcacctgccgctgtctctggtncctcatcagtagtggtttctcgtggggctggggtccgcagctcccgaggggacggggctagggaatacagttgggaagtgtctctcattaggtggtaggttcctattacagtccgtctctcaagcgtcgtagtcacctatactctcgtggacctacgtccagacaatctacgttttccagactatgtagttcngtacgaccgccgtctacgacgtacgggtcgttttaacgtacgtggtacgcgtaaggtacggacggtacttagtttagttacgttaggtttttagggaggtttacggtttactttaccggaaccctaccgtagtacggtcgggtaccgggggtcctaccgggcccggttaggggaccgtaagggtaacctacggttcggtacctacccggttcttaccggtaccgccccgttaccgacccggaacgggtccccctaagggttcccccggttaccccgtttccccccggacggtaccccccttacccccgttcccgtaccctaaacgggccctaccccggg

SEQ ID NO: 138704 - DNA, 650 bp, Homo sapiens
  misc_feature: GYAE6OF01AKU2M.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtccgggcccacgactggtgaggccttcggagaccctgtccctcacctgcgctgtctctggtcgcctccatcagtagtggtttctcgtggggctgggtccgcagctccgagggagggctggaatacattggaagtgtctctcatagtggaggttcctattacagtccgtctctcaagagtcgagtcaccgtatactctcgtggactccgtaccagctaactctacgttttccccagtaacgtagtagtacgtttcgtagttccgaccgtccgtcgttacggaaccgtacggggttcgtttttaacgtacgttcggtacggacgtaggtacggtacggttcttaacgtttagtggtttaagtttttggaagtttgggtttacctttacgaccgtacccgtaggtacgtccgggtaccggggtctacccgggtaccccggtggggacccgtagggtacttaaccgtcggtaccacccgttcctaccgttcggccctaccccgg

SEQ ID NO: 138705 - DNA, 793 bp, Homo sapiens
  misc_feature: GYAE6OF01CKZ7V.46.67.G01.1.454.CMB.1.raw
  modified_base (341)..(341): a, c, t, g, unknown or other
  misc_feature (341)..(341): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctcgtggggctgggtccgcagcctcccgaggggaagggctaggaatacagttggaagtgtctctcatagtggagttcctatacagtccgtctctcaagcgtcgagtcaaccatatctctggactacgtcagcaatctagtttccagaagtntgaacgttctaggtcgaccgtccgctggaaccgtacggggttactttttaagttaccgtggttacggaccgtaaggtaacggtaacccggtacgtttaagtttagttaggtttaagtttttttaggggtaaggttttagggttttaacgttttaccggtaacccgttaacccgttaagggtaccgttacccggggaacgggggttaccccgtacccgggttaaacccccgggtcgggggtaccccggtaaagggggtaaccgtttaaccggtccgggttaacccgtacccggttccgtttaacccgttacccgggtaccccttaacccggaaccccgtaaaccgggggccccccttaaacggttcccccgggtttacccctttacccccccggttacgggtaccccctacccccgttacccgttaccccgtaaacggtacccggtacccccg

SEQ ID NO: 138706 - DNA, 648 bp, Homo sapiens
  misc_feature: GYAE6OF01A3G3Y.46.67.G01.1.454.CMB.1.raw
  modified_base (218)..(218): a, c, t, g, unknown or other
  misc_feature (218)..(218): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtccgggcccacgactggtgacggccttcgggacgaccctgtcccctcacctgcgctgtctcgtggtcncctccatcaggttagttggttttcttcgtggggtctcgggtccggcagcctacccggaggggaacggggctaggaatacagttaggaagtgtctctactagtaggtggtacgttcctagttacgtacgttccgtctctacgaaggacgtcgacgtaccaacctatactctacgtaggaccaccgtacagactaatccgttacgttttcccagaagtatagtacgttctcgtcgaccgcgtcgtgacggtacggttactttactacgtgtcgacgaggacggacgtacttagttagttgtttagttttaggagtttaggtttacttaccgaacctaccgtaggtacgtacgggaccgggtcctcccggacccggtggggaccgtaagggtactacgtcggtcctaccgttcctccgttccgcccgtacccg

SEQ ID NO: 138707 - DNA, 828 bp, Homo sapiens
  misc_feature: GYAE6OF01BSKOI.46.67.G01.1.454.CMB.1.raw
tcagactagcagtacacgaccggtgctcgatttagagtatacatattgggtttgtcctcctgctggtggcagctcccagatcgggtcctgtccctggtgcaactgcaggagtccgggcccacgactggtgaggccttcggagaccctgtccctcacctgcgctgtctctggtcgcctcatcagtagtggtttctcgtgggctgggtccgcagcctccgaggggacgggctaggaatacgtagttagggaagttcgtctcgtacaagttacggttagggtacggtttacccttaagttaaccgtacggttcccgttctaccgtacgaaaggtacggttaccgaacgtacccaacctattacttccgtacgtacgggtaacctaccgtaccgacgtacctaacttccgttaaccgttttacccagtaacgtagttcggtacgttcgtcggtaccgacccgtccgcgtacggaccggtacggggttacttttaacgtccgtggtacggacggaagacggtacggttacttagtttagttacgttaaggttttcgggtaggtttacggttttacttacccggtaaccttaacccggttaggtaccgggttcccggggtaacgggggtccccgttaccccgggtaaccccgggtcgggggtaacccgtaaggggtaaccttaccgggttaccggtacccgtacccgttccgttacccgtacccgtcccgtaaccccgaaccggtacccggtcccgttaccggttccccggttaccccttacccccggtcggtacccccttacccgtaccccaacggtaccgcccgtaccccgg

SEQ ID NO: 138708 - DNA, 509 bp, Homo sapiens
  misc_feature: GYAE6OF01CALQL.46.67.G01.1.454.CMB.1.raw
  modified_base (192)..(192): a, c, t, g, unknown or other
  misc_feature (192)..(192): n is a, c, g, or t
  modified_base (487)..(487): a, c, t, g, unknown or other
  misc_feature (487)..(487): n is a, c, g, or t
  modified_base (499)..(499): a, c, t, g, unknown or other
  misc_feature (499)..(499): n is a, c, g, or t
  modified_base (504)..(504): a, c, t, g, unknown or other
  misc_feature (504)..(504): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccgggcaagtcggaacattgacacctatttaaatgtatcaacatagaccaggacgccctaagctcctaatctatgctgcatccagtttgctaaagtgggtcccatcgaggttcagtggcagtggatctgggacagatttcactctcaccatcagtaatctagctaacgtgtaagtattttgactaacttattactgtactaacagtaattacaattgtttaccgactaacgggactacgaactaactaaattaacgaatgtaggctagcacatctntctcatctcccncactntgtac

SEQ ID NO: 138709 - DNA, 763 bp, Homo sapiens
  misc_feature: GYAE6OF01COFCJ.46.67.G01.1.454.CMB.1.raw
  modified_base (281)..(281): a, c, t, g, unknown or other
  misc_feature (281)..(281): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactgggtgaggccttcggacgaccctgtccctcacctgcgtctgtctcgtggtcgcctaccatcgagtagttggtttcttcggtggggtctcgggtccggcagccgtacccggaaggggaacggggcttagggaaatacgtagttagggaagtgtctctntaagtaggtggtacggtttcctagttaacacggttccgttctcgtacgaaaggtacgtcgacgtaccaacctattactctcgtacgacctacgtccaacgacaacttctacgttttcccgaagaagtacttggtaagtttcgtaggttcgaacccgccgtctacggaaccgggtaccgggtttcgtttttaaacgttcgttcggacggtacggacggaacggtacggtacttaagtttaagttagtttagttttagggtagtttaggtttacgtttacgtaaccgtaccgtagtacggtccgggtacggggtccgtccggtaccccggtacggggtaccgaacgggtacgtaccgttcggtaccgtacccgtccttaccgttaccgcccgtaccgaacccggtaccggtacccgtaaccgttcccggttaccccttccccgtcgtacccctaccctacccgacctaacggtccgtaccccgg

SEQ ID NO: 138710 - DNA, 571 bp, Homo sapiens
  misc_feature: GYAE6OF01BTZVU.46.67.G01.1.454.CMB.1.raw
  modified_base (333)..(333): a, c, t, g, unknown or other
  misc_feature (333)..(333): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctctggggctgggtccggcagctcccagggaaggggctggaatacattggaagtgtctctcatagtggaggttcctattacagtccgtctctcaagagtcgagtcaccatatctctggacacgtccagcaatcagttttcccngaagatgagttctgtcgaccgccgctgacgtaccgggtcgttttattacgtgtggcgagaggacggctattagtgtagtttttggagttggttatttcgactacccgtagagtcggacggggtctcggacccgtggggccgagggtacgtacgtcggtctaccgtctccgtacgccctccaccgacggcccacgtccggtccttcccccgcgtcccacccctcctccacgcgtacccg

SEQ ID NO: 138711 - DNA, 966 bp, Homo sapiens
  misc_feature: GYAE6OF01D3FOC.46.67.G01.1.454.CMB.1.raw
  modified_base (954)..(954): a, c, t, g, unknown or other
  misc_feature (954)..(954): n is a, c, g, or t
tcagactagcagtacacgaccggtgctcgatttagagtatacatattgggtttggggagtctcggtcaggacacagcatggacatgagggtccccgctcagctccgtggggctcctgctactctggctccggaggtgccagatgtgacatcgagctcgacccagtcctccacttcctccctgtctgacgaaccggtgggacgacgtagtcgtacacctatctacgttcggaccggtacaaaggtaccggaaactattacgaaccttaaccgttttaaattttaaacgtttaggttaaactacctaaaacgtaacgttaaccggaaacccggaacgggggtaaccccggtaaccccgttaaacggtcccgtttaaacccctttaagtttacccgttaagttccggtacgttacggtaccctaaccggtttacccgttaaggtttttaccggaaaccggttaaaacggggttccccgggggtttaaccccttaacgggtttaccggggttaaccggtttaccgggtaacggttacggggaccggttaaggggttaccgggttacggttccgggttaaggggaaccttaacgtttaccgtttaccgtaaccttccttaacccgaaccgttacgttacgtaacgttacgtaccgttacgtaccgtaaaggtacgttaagtttaccgtttacgtaacttaaacctttacgttaactaaccggttaaacctaaagtaacgtttaaactttaacgttaaccggttttacgggtttaaaccggaaaccggaacggttaaaccgtaaccgttaaaacgttaaaaccgtaaaaacggttaaaccggtacgtttacggtaacccgtccgttaacgtaacccgttaacgttaccgttttaccctttacggttacccttttaacgacccgttttcccccgtaaacccgtaactaccggtttttaacncgttaaaacccg

SEQ ID NO: 138712 - DNA, 571 bp, Homo sapiens
  misc_feature: GYAE6OF01D4INZ.46.67.G01.1.454.CMB.1.raw
  modified_base (380)..(380): a, c, t, g, unknown or other
  misc_feature (380)..(380): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccggcaagtcggaacattgacacctatttaaatggtatcaacatagacagggacgccctaagctctaatctatgctgcatccagttgcaagtgggtcccatcgagttcagtggcagtgatcgtgggacagtattcactctcaccatcagtatctgactaacgtgaagtntttagactaacttattactgtactaacagtaatttaactaattggttttaccggacctaaagggacctaacggtaaccttaaacgtaaaactttaaacgaaacttggtacgaccgttaggacctacccgtaatccgttgttaccttactaaccttcccttacccccggtaccttaactccgttagtaaccg

SEQ ID NO: 138713 - DNA, 865 bp, Homo sapiens
  misc_feature: GYAE6OF01DYLON.46.67.G01.1.454.CMB.1.raw
tcagactagcagtacacgaccggtgctcgatttagagtatacatattgggtttgggggagtctcggtcagggacacagcatggacatggagggtccccgctcagctccgtggggctcctgctactctggctccggaggtgccagatgtgacagtcgagtctcgacccagtcctccattccctcctgtcctcgaccgaaccgggtgggacgactaggtcgtaccaacctatcctacgttcgggacccgggtaacaacgggtcgaaacctagttacgtaacctaaaccgtttaattttaaaggttggtaactaaccaaacagttaacgaaccgggtacgggaacccggtaccctaagtccttaaccttaatcgttagtcgaccgtacgactaacttcgttaggtttacgaacggttaacgggtccgggtacctaggtacgggtacggttaacagggttggacgtaggtacggttacgtcggtaacgggactaacgttacttccgaactccttaaccgactaacgtactaaggttaacctcggttaagaacgtaacgggttaagttaacttacggtttaactaaacctttaacggtttaacttaccgttaaacgtaaccaaaagttaaacgtttaaaccgtttaattaaccgggttttaacgggttaaaccggaacccgggttaaaaagggtaaccccttaaacggtaaaaacccttaaaaacggttaaacccttaaaagggtaacccgggtccgttaacggccggttaaactacccgggttaacttaagggttcccctttaggttaccctttaccgttcccctaacccgttcccggtaaattaccgttcccgtaaaggtttaacccg

SEQ ID NO: 138714 - DNA, 555 bp, Homo sapiens
  misc_feature: GYAE6OF01D387U.46.67.G01.1.454.CMB.1.raw
  modified_base (192)..(192): a, c, t, g, unknown or other
  misc_feature (192)..(192): n is a, c, g, or t
  modified_base (217)..(217): a, c, t, g, unknown or other
  misc_feature (217)..(217): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccgggnaagtcggaacattgacacctatttaaatgtatcaacatagaccagggaccgccctaagcctctaatctatgctgcatcctagtttgacaacggtgggtcccagtcgtaggttcaggtggtagtggatcgtgggacagtatttcactctcacatcaagtatctgactaacgtgtaagtatttgactaacttattactagtacaacagtaattactaattgtttacggacgtaagggactacgtaactaaactaaacttaaaccgtactaggtacgtctacgactaccgtagttccttagttcttactaccttacccgttccccactacttctgtatacg

SEQ ID NO: 138715 - DNA, 742 bp, Homo sapiens
  misc_feature: GYAE6OF01DOLO9.46.67.G01.1.454.CMB.1.raw
  modified_base (216)..(216): a, c, t, g, unknown or other
  misc_feature (216)..(216): n is a, c, g, or t
  modified_base (249)..(249): a, c, t, g, unknown or other
  misc_feature (249)..(249): n is a, c, g, or t
  modified_base (274)..(274): a, c, t, g, unknown or other
  misc_feature (274)..(274): n is a, c, g, or t
  modified_base (429)..(429): a, c, t, g, unknown or other
  misc_feature (429)..(429): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtcctggtgcaactgcaggagtcgggcccacgactgggtgacggcctttcggacgaccctgtccctcacctgccgctgtctctggtcncctccatcagtgtgtttctcgtgggctggccgnagcgtccgaggagggctaggactanagttaggagtgtctctacgtagtacgtggtaggttccttattacctaggtcccgttctctaccaagtgtacgtacgtaccacctattactcgttactacggtaaccaccgttaccgacgaactaattccgttaacgttttccctaagaaacgttntggttaacgtttctcggtacgtccccggcccgtcgtacgtaacggtaccgggttacgtttttaacgttaccgttggttacgtacgggaacgtacgggtaacccgttagtttaagtttaggttaggttttaaggttttttgggtacgggtttaggttttaacgtttaccggtaaccgttaaccccgttaagggtaccgttcggggaccgggggttacccgtacccggtaaccccgggttgggggaccccgtaaagggtaaccgtaacggttcggtacccgtaccgttccgtacccttacgccccgttaaacccg

SEQ ID NO: 138716 - DNA, 723 bp, Homo sapiens
  misc_feature: GYAE6OF01E4WZE.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggagacagtgtcaccatcacttgccgggcaagtcggaacattcgacaccttatttaaattggtatcaacatagaccagggacgccctaagctacctaatctatgctgcactcctagtttcgactaaaacggtcggggtacccagtacggtacggttcgaaggtggaccgtaggtgggaattccggtaggggactaaggtaacttttcgaccttcctacctaccattaccaaggttaaactccgtacgtaccgtaaacggttagtaaaggttaactttttacggaacctttaaaccgttttaagttaaacctttaggttaacctaaacgtaacgttaaactttaacttaacgtttacggttttaccggaaccggtaaacgggtaaccgtaaacgtaaaccgttaaacgtaaaacgtttaaaaccggtaacttacggtacggtaccgttacgaaccgtaacccgtagttaccttcggtttaccttaccgtaaccgttacccctttacccccgtaaccttacgttccgtacgttaaccg

SEQ ID NO: 138717 - DNA, 984 bp, Homo sapiens
  misc_feature: GYAE6OF01ED5E2.46.67.G01.1.454.CMB.1.raw
  modified_base (215)..(215): a, c, t, g, unknown or other
  misc_feature (215)..(215): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtccgggcccacgacgtggtgaggccttcggacgaccctgtccctcacctgcgctgtctctggtcncctccatcagtgttgtttctcgtgggctgggtccgcacgtccgtcccgaggggacgggctacggaatacgtagttaggaacgtgtcctctcgtagttaggtgggtacggtttcccttaagttaccgtacggtttcccgtcttaccgtacgtaaaggtcggttacggtaacgtacctaaccctaagttacctccgttccgtacgggtaaccctacccgtaccgaacggtacctaaacgtttcccgtttaaacccggtttttaccccgaggtaaaacggttacgtttcggttaacgttttcccgttaggttacccggaacccccggtccccgtaccggtttaaccgggaaacccgggtttacccggggttaccgtttttttaaacgttacccggtttacgggtacccggtaacggggtaacgggtaacccgggttaaaccggggttttaccgttttaaaggttttaagttttacggggtttttaaccgggttttttaggggtaaacgggttttttccggggttttttaaccgtttacccggtaaaccccggtttacccggttaaacgggtaaccgggtttaccccgggggaccggggggttacccccgtttaccccccggggtaaccccgggggttaccggggggtaaccccgggttaaaggggttaaccgttttaacccggaccccggggttttaaccccggtacccccggttttacccggtttacccccggttttaaacccgtccccccgggttaaaaaccccccgggg

SEQ ID NO: 138718 - DNA, 555 bp, Homo sapiens
  misc_feature: GYAE6OF01BCNBX.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctctggggctgggtccggcagctcccagggaaggggctggaatacattggaagtgtctctcatagtggaggttcctattacagtccgtctctcaagagtcgagtcaccatatctctggacacgtccagcaatcagttttccctgaacgatgagttctgtgaccgccgctgacacgggtcgttttattactgtgcgagagacggctattatgtattttggagttggttatttcgactaccctagactcggacggggctcggacccctggggccagggtaatacgtgcaccgtctcctagcctccaccgacggcccagtccggtccttcccccgtcggccctacccctccctcccaaggcgtacccg

SEQ ID NO: 138719 - DNA, 536 bp, Homo sapiens
  misc_feature: GYAE6OF01C4PZ5.46.67.G01.1.454.CMB.1.raw
  modified_base (215)..(215): a, c, t, g, unknown or other
  misc_feature (215)..(215): n is a, c, g, or t
  modified_base (222)..(222): a, c, t, g, unknown or other
  misc_feature (222)..(222): n is a, c, g, or t
  modified_base (388)..(388): a, c, t, g, unknown or other
  misc_feature (388)..(388): n is a, c, g, or t
  modified_base (414)..(414): a, c, t, g, unknown or other
  misc_feature (414)..(414): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaaccgtgggagacagtgtcaccatcacttgccggnagtcganatgacactattaatgtatcaacatagaccagggacgaccctaagctacctatctatgctgcatcctagtttgacaaggtcgggtaccatcgagttcagtgcagtggatcgtagggactagtatttcactctaccacatcctagtaatctagactaacgtgaagttntttagactaatttattactgtacaanagtaattactaattcgtttacgacgtaagggacctaagtactaaactaaattaacgaactgtagctacgaccactattccttgttccttacgtacttcccttacccgtctacttctgtaacg

SEQ ID NO: 138720 - DNA, 777 bp, Homo sapiens
  misc_feature: GYAE6OF01AL26M.46.67.G01.1.454.CMB.1.raw
  modified_base (209)..(209): a, c, t, g, unknown or other
  misc_feature (209)..(209): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtcgcctccatcagtagtggtttctcgtgggctgggtccgnagcctacccgaggggaacgggctagggaatacgtagttggaagtcgtcctcgtacagttaggtggtacggtttaccttaagttaccgtacgtcccgttcttcctaccgaaaggcggttacgaacgtccaacctatactctacgttacggacctaccggtaccagacctaacttccgtacgttttacccgagtaaacgtacgttacgttaacgttcgtggtaccgacccgccgtacgtacggaaccggtaccgggttacttttaacgttacgtggttacggacggaaggtacggtacgggtactttaagtttagttacggtttaaggttttgggaagtttcggtttacttaccggaacctaccgttaggacgtaccgggtacggggtaccctaccgggacccggtacggggaccgtaagggtaccgttacggtcgtaccgtacccgttccgtaccgttaccgccccgtaacccgtaaccggacccggttcccacggttcccccggttaccccttcccccggcggtcccccttaccccgttaccccgtaccgaacggtccgtaaccccgg

SEQ ID NO: 138721 - DNA, 782 bp, Homo sapiens
  misc_feature: GYAE6OF01CXJ90.46.67.G01.1.454.CMB.1.raw
  modified_base (191)..(191): a, c, t, g, unknown or other
  misc_feature (191)..(191): n is a, c, g, or t
tcagactagcagtacacgaccggtgctcgatttagagtatacatattgggtttggggagtctcggtcaggacacagcatggacatgagggtccccgctcagctcctggggctcctgctactctggctcgaggtgccagatgtgacatcgagctgacccagtctccatcctcctgtctgccaacggtggganactagtcgtcaaccatcgtacttggaccgggacaaggtccggaactagtttcgaacctaacctttaagttttaaaagttggtaacttacgaaactagtaacggaaccgaggggaccgtaccctaagctacctaatctaatgctagtctctagttgactaaggtcggtaccagtcggtagttacgaggttggactaggtacgtctacggtaggactaaggttcttactacgttacctacaaaccgtaattacccgtaaggttaactccgtacgtaacggtaacgttacggtaaagtttagttttacaacgtttaaacttttaacggttaccttaacggttaaccgtaaactaaacggttaaactttaaacgttaacgggtttaccggttttaaccgggaaaccggtaaaacgggttaccctaaaaccgttaaaacgttaaaacccgttaaaaagtttaaaccggtaacgtttaaggtaccggtttaacgaccgttaaacccgtaacgttacgttaccgttaaccggttttaccttaaccgttaccgttaccccgttacccgtaccttaagtttacgcgttaacgtttaccgg

SEQ ID NO: 138722 - DNA, 742 bp, Homo sapiens
  misc_feature: GYAE6OF01DI9CM.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatccctccctgtctgacaaccggtgggagacagtcgtacaccatacacgttggcccgggacaaggtcggaacattgaacctaaccttaattttaaattggtatacaacatacgaccgagggaccgccctaagcctacctaatctatcgctgctactccgtagtttcgaacgtaaggtcgggtacccagttcgtaggttcgagtggcgaggttggactcgtagggactagtactttcacttcctactaacctatacgtaagttaactccgtagtaaccgtaaggttagtaaagtttacgttttacgaacctttaaacttttactttaaccgttagtaacctaaacttaacggtttaaatttaaccgtttaaggttttacccgggttttaaccggaacccggtaaaacggggtaacccttaaaccggtaaacctttaaaaaccgttaaaaacgtttaacccggaacgtttcggggtaaccgtccgttaacggaacccttaaacccgttatttaccgtttcgttaacctttaccgtacctttccccgttaccccgacctttagttccgtattaacccgg

SEQ ID NO: 138723 - DNA, 532 bp, Homo sapiens
  misc_feature: GYAE6OF01BRGK1.46.67.G01.1.454.CMB.1.raw
  modified_base (433)..(433): a, c, t, g, unknown or other
  misc_feature (433)..(433): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggccctaagctcctaatctatgctgcatcctagtttgcaaaggtgggtcccatcgaggttcagtggcagtggatcgtgggacagtactttcacttctcacctatcaagtaatctgacaacgtgtaagtattttgactaaacttattactgtacaacagtaattanaattgtttacggctaacgggtacacgtaactaactaaattaacgaacttgtgctagacactatctgtccttacacttcccttcccgacctactctgtac

SEQ ID NO: 138724 - DNA, 600 bp, Homo sapiens
  misc_feature: GYAE6OF01A5EOX.46.67.G01.1.454.CMB.1.raw
  modified_base (342)..(342): a, c, t, g, unknown or other
  misc_feature (342)..(342): n is a, c, g, or t
  modified_base (348)..(348): a, c, t, g, unknown or other
  misc_feature (348)..(348): n is a, c, g, or t
  modified_base (372)..(372): a, c, t, g, unknown or other
  misc_feature (372)..(372): n is a, c, g, or t
  modified_base (437)..(437): a, c, t, g, unknown or other
  misc_feature (437)..(437): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcgggagaccctgtccctcacctgcgctgtctctggtgcctccatcagtagtggtttcttcgtggggctgggtccggcagctcccgagggaaggggctggaatacagttggagtgtctctcatagtggaggttcctattacagtccgtctctcaagagtcgagtcaccatatctctggacacgtccagcaatctagtttcccagaagntgattngtcgaccgccgctgacgacgggtntttatacgtgcgagagagacggcttattagttgtattttggagttggttattcgactaccgtagngtcggacggggtctccggcccgtggggaccgagggtaactacgttcgggtacctacccgtccgttccttacgcccgtacccaacccggaccgggtcccctacggttcccggtcccgttcccccgtcggacccctaccccgtaccctccgaaacgcgtaccccg

SEQ ID NO: 138725 - DNA, 506 bp, Homo sapiens
  misc_feature: GYAE6OF01C6BK8.46.67.G01.1.454.CMB.1.raw
  modified_base (385)..(385): a, c, t, g, unknown or other
  misc_feature (385)..(385): n is a, c, g, or t
  modified_base (480)..(480): a, c, t, g, unknown or other
  misc_feature (480)..(480): n is a, c, g, or t
  modified_base (497)..(497): a, c, t, g, unknown or other
  misc_feature (497)..(497): n is a, c, g, or t
  modified_base (500)..(500): a, c, t, g, unknown or other
  misc_feature (500)..(500): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggccctaagctcctaatcatgctgcatccagtttgcaaagtgggtcccatcgagttcagtggcagtggatctgggacagtattcactctcacatcagtaatctgacaacgtgaagtntttgactaattattactgtacaactagaattacaatgttttccgacgaaggacaacgactaacaaataaacgaactagtggtctagccacatctntcttcactctcccgacnctntcgtac

SEQ ID NO: 138726 - DNA, 580 bp, Homo sapiens
  misc_feature: GYAE6OF01CE6M4.46.67.G01.1.454.CMB.1.raw
  modified_base (302)..(302): a, c, t, g, unknown or other
  misc_feature (302)..(302): n is a, c, g, or t
  modified_base (414)..(414): a, c, t, g, unknown or other
  misc_feature (414)..(414): n is a, c, g, or t
  modified_base (565)..(565): a, c, t, g, unknown or other
  misc_feature (565)..(565): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatgtatcaacatagaccagggacggccctaagctcctaatctatgctgcatccagtttnctaaagtgggtcccagttcgaggttcagtggcagtgatcgtgggacaggtatttcacttctacacatctaagtaatcctgactaacgtgtaaagttatttcgactaactttntaacctgtacaaacagtaaattactaacgttgttttaccggaccgtaaagggaccaacgtaacgttaaactaaaacgttaaacgaacgtagtgggaccctaggaacctaccgtaacttcttacgttaccttcctaacttcccttaccccgntacgtcttaggtaac

SEQ ID NO: 138727 - DNA, 846 bp, Homo sapiens
  misc_feature: GYAE6OF01C4ESZ.46.67.G01.1.454.CMB.1.raw
tcagactagcagtacacgaccggtgctcgatttagagtatacatattggggtttggggagtctcggtcaggacacagcatggacatgagggtccccgctcagctcctggggctcctgctactctggctccgaggtgccagatgtgacatcgagctgacccagtctccatccctccctgtctgcaaccggtgggagacgagtgtccaaccatccacgttcggccgggacaaggtaccggaaactagttacgaacctaacctttaagttttaaaacgttggttaacttacaaaacctaagttaacggaacccggaacgggggaacccggtaccccttaaaggtccccttaacccgtaaattccttaagttcggaccttacgtacctaacttacccgttaaggttttacggaaccggttaaaacgggttccggggttaaccccctaagggttaccgggtaacgggttttaccgaggggttaccgggaccggtaagggttacgggtaacgttccgggtaggggtaaactaaggttacctttaccgtaaccttcccgtaactaaacctaagttaccttaaagtaaccgttcggtaacgtaaccgttaacggttaagttaaaccggtttatttaaccgtaactttaaactttacgttacggttaactaacgtaataacttaactttaagtacgtttacgggttaacgaaacgtacggtaaacctaacgtaaactaaacgttaaaacgtaaccgtaagttcgggtacgtaccgtacaaccgtaccgttaattcggttaccttaccttacgtacccttccggttaacccctattacgtcgttaacggttaaccg

SEQ ID NO: 138728 - DNA, 1016 bp, Homo sapiens
  misc_feature: GYAE6OF01C5M1P.46.67.G01.1.454.CMB.1.raw
  modified_base (1002)..(1002): a, c, t, g, unknown or other
  misc_feature (1002)..(1002): n is a, c, g, or t
tcagactagcagtacacgaccggtgctcgatttagagtatacatattggggtttggggagtctcggtcaggacacagcatggacatggagggtccccgctcagctccgtggggctcctgctactctggctccggaggtgccagatgtgacatcgagctcgacccagtctccactcctcccttgtctcgaccaaccggtgggacacgaggtcgtccaacctatcacgtttcgggcccgggactaacggtaccgggaactacgtttacggacctaaccgtttaaatttttaaaagttcgggttaacttacctaaacgtaacgttaaccggaacccggtaaccgggggaacccggtaacccccgttaaacggtacccttaacccgtttaaacttaccttaacgttacgtccgtacggtacctaactttacccgttaaggttttaccggaacgtaaaacgggtttccgggggtaccctaggttaccgggtacgggtttaccggtaagggtacggggtaccgtaaggggttacggggtaacgttccgggttacggggaaaccttaacgggttacccttttaacccgtacccgtttaccctacccgtaaaccccgttaaacgttaaccgttaaacgggtttaaacgttccgttaaacgggtaaaccccgttaaagggtttaaacgggttaaacggttttaacgttttttaaacccgggtaaaccttttaaaaccggttttaccttttaaacggtttaaccgttaaaccgtaaaacgtttaaaacggtttaaaactttaaacggttttaaaacgttttccgggtttttaacccgggaaaccgggttaaccggggtaaaccgtaaacccgtaaaccgtttaaacgtaaaacctttaaacgggtaaaccggttcggtaacggtacccgttacggaacccttacccgtaacgtttaccgtacgttttacccttaacgttacccttcccgggtttacccctacttacccggtnttccggttaaaccg

SEQ ID NO: 138729 - DNA, 612 bp, Homo sapiens
  misc_feature: GYAE6OF01EJMNU.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctccgagggaggggctggaatacattggaagtgtctctcatagtggaggttctattacagtccgtctctcaagagtcgagtcacatatctctggcacgtccagctaatctacgttttcctgaacgatgtagttctgtcgaccgccgctcgacgacgggtacgtttattacgtgtgacgaggacgtacggtactattagtgttagtttttgggtagttggtttatttacgtacctacccgtagacgttcgggacggggtcctaccggcccgtggggaccgaggggtactacgtacggtccacccggtcttcccgttacgccctaccgacccgaacggtcccacgtcccggttcccttcccccgtccggtcccacccctacccttacccgaagtccgacccg

SEQ ID NO: 138730 - DNA, 808 bp, Homo sapiens
  misc_feature: GYAE6OF01DJOX4.46.67.G01.1.454.CMB.1.raw
  modified_base (220)..(220): a, c, t, g, unknown or other
  misc_feature (220)..(220): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtccgggcccacgactgggtgaggcccttcggacgacccctgtcccctcacctgccgctgtctcgtggtcncctcatcgtagttagttcggtttctcggtggggtcctcggggtcccggacagtccgtacccggaggggaacggggtctaggaatacgagttaggaagttgtacctctacagttaggtagggtacggtttaccctattaccggtacggttcccgtcttacctacgaaacgtaggtaccggtacgtacctaaccctattacgtcctcggtacgggaacctaccgtccaagtacctaagtaccgttacgttttacccaaggtaaattcgtacggttacgtttccgtggtaccggaccccgtccggtacgttacggtaaccgtaccggggttactttaacgttacgtggtacggacgtaaggaaccgggtacgtaacgtttatttaaggttcgtttaaggtttttgggtaggtttacggtttaacgtttccgtaaacccgtacccggttaaggtaccggtaccggggtaccggggtaccttaccccggggtaccccgggtaggggggaacccggtaacgggttaaccgttccggttacggttaccccggtaacccggtttcccttaacccgttacgccccctaacccccggg

SEQ ID NO: 138731 - DNA, 633 bp, Homo sapiens
  misc_feature: GYAE6OF01AG8QR.46.67.G01.1.454.CMB.1.raw
  modified_base (192)..(192): a, c, t, g, unknown or other
  misc_feature (192)..(192): n is a, c, g, or t
  modified_base (218)..(218): a, c, t, g, unknown or other
  misc_feature (218)..(218): n is a, c, g, or t
  modified_base (259)..(259): a, c, t, g, unknown or other
  misc_feature (259)..(259): n is a, c, g, or t
  modified_base (418)..(418): a, c, t, g, unknown or other
  misc_feature (418)..(418): n is a, c, g, or t
  modified_base (435)..(435): a, c, t, g, unknown or other
  misc_feature (435)..(435): n is a, c, g, or t
  modified_base (453)..(453): a, c, t, g, unknown or other
  misc_feature (453)..(453): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcacatcacttcggccgggnaagtcggaactgttcgactaccttatttaaagtgtatacanatagaccgaggaccggccctaagctacctaatctatcgtctgacatcctagtttcgacgtaaacggtcggggtaccccagttccggtaggttccaggtcggcgtagtggtatcggtaggggaacagtactttccacgtctaccactatccgtaatactnacgatacgtgtaaagtntttagacttaattacttntagtactacgtataattactagttcgtttcggaacttaacgggacctaaccgtacttaaacgtaaacgttaacgtaacgttacggtacgtaccgtacgaaccgtaaccttactttcgttacgttacccgttcctaaacggtttcccgtaccccttaccgtacttaccgtcggttaaaccg

SEQ ID NO: 138732 - DNA, 635 bp, Homo sapiens
  misc_feature: GYAE6OF01CKZ3G.46.67.G01.1.454.CMB.1.raw
  modified_base (174)..(174): a, c, t, g, unknown or other
  misc_feature (174)..(174): n is a, c, g, or t
  modified_base (213)..(213): a, c, t, g, unknown or other
  misc_feature (213)..(213): n is a, c, g, or t
  modified_base (255)..(255): a, c, t, g, unknown or other
  misc_feature (255)..(255): n is a, c, g, or t
  modified_base (382)..(382): a, c, t, g, unknown or other
  misc_feature (382)..(382): n is a, c, g, or t
  modified_base (408)..(408): a, c, t, g, unknown or other
  misc_feature (408)..(408): n is a, c, g, or t
  modified_base (426)..(426): a, c, t, g, unknown or other
  misc_feature (426)..(426): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactgggtgaggccttcgggacgccctgtccctcacctgcgctgtctctggtcncctccatcagttagtggtttctcgtggggctgggtcgangctccgaggggagggctaggaatcagttaggaagtgtctctnagtagtgggagttacctattacagttcgtctatcaagcgtacgagttccaactatactcctacgtggacaacgttccaagactaaatcgttacgttttaccagaagattcggagttctagtcgaccncgctggaacgtcgggtatttatacgnggtcgacgtagagtacgnttagtatgtagttttggattgttattcgactaccagtacgtcggacgggtccacgacccgtagggaccggtaacgggactacgttccgtaccgtaccgtaccgttacgttaaccgtccgtaacccgaaccggtaaaccgggcctaaccggtccgggttacccccttccccgacggtacccaccccttacgaccctaaaggcgtaccccg

SEQ ID NO: 138733 - DNA, 575 bp, Homo sapiens
  misc_feature: GYAE6OF01BME2H.46.67.G01.1.454.CMB.1.raw
  modified_base (400)..(400): a, c, t, g, unknown or other
  misc_feature (400)..(400): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctcgtggggctgggtccgcagcctcccgaggggaaggggctaggaatacagttggaagttgtctctcatagtggaggttcctattacagtccgtctctcaagagtcgagtcaccatatctctggacacgtcagcaatcagttttcccagaagactgagttctgtcgaccgcgctgacgacgggtcgtttatacgtgtgcgagagacggtntattatgtattttggagttggttattcgactccctagagtcggacggggctccggacccgtggggaccgagggaactacgtcggtccgaccgttcgtccgttacgccctaccgaccgacggccctacgtcccggtcccttccccgtacgccctacccctcccaccagtcgacccg

SEQ ID NO: 138734 - DNA, 742 bp, Homo sapiens
  misc_feature: GYAE6OF01B1ZO4.46.67.G01.1.454.CMB.1.raw
  modified_base (139)..(139): a, c, t, g, unknown or other
  misc_feature (139)..(139): n is a, c, g, or t
  modified_base (169)..(169): a, c, t, g, unknown or other
  misc_feature (169)..(169): n is a, c, g, or t
  modified_base (244)..(244): a, c, t, g, unknown or other
  misc_feature (244)..(244): n is a, c, g, or t
  modified_base (323)..(323): a, c, t, g, unknown or other
  misc_feature (323)..(323): n is a, c, g, or t
tcagactagcagtacacgaccggtgctcgatttagagtatacatattggggtttggggagtctcggtcagggacacagcgactcggacatgacgggtcccgctcagctcctgggctcctgctactctggctccgaggtnccagatgtgacatcgagctcgacccagtcnccatcctccgtgtctgacaaccggtggacacagtcgtaccacagtcacgttcgccgggataacggtacgaaactnttacgaactacttaatttaaagtggtaactacaacagtaccgaccgaggaccgacctagctctaatcatcgatcgactntaccgtagttcgactaacgggttcgggtaccctaggttcggtaggtttacgagggttacggacgtaagggtagtacgttcggtagggaacctagttactttcgaacttccgtacactacgtacgtaagtactcgtacgtactaacggtagtaacgttactttacggaacttaacgtttactaccgttagtaacgtaaacgtaacgttaacttaacgttacgtttacggtttaaccgggaaccgttaagggaaaccttaccgtaaccgtttaaaattaaaccgggttaaaccaccgggtttacggtacggtaccttaaaccggtaacgttaacccttacggttttaaccgttcggtttaaacccttacctaccccgttttacccgtaccccgttacgtattttcccgaaggtttaaaccc

SEQ ID NO: 138735 - DNA, 560 bp, Homo sapiens
  misc_feature: GYAE6OF01BRVIA.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccggcaagtcggaacattgacacctatttaaatgtatcaacatagaccaggacggccctaagctcctaatctatgctgcatcctagtttgacaaaggtcgggtcccagtcgaggttcagtggcagtggatcgtgggactagtatttcactctcacctatcagtaatctgactaacgtgaagtattttgactaacttagttactatacaaactaagtaacttaactaattgtttacgaccgtaaggactacgtaactaactaaagttaaacaacgtagtcggtatcgtaccactaattcttcgttaccgttactacttccccttacccggtacctacttcgtcgttaacg

SEQ ID NO: 138736 - DNA, 574 bp, Homo sapiens
  misc_feature: GYAE6OF01CUIVQ.46.67.G01.1.454.CMB.1.raw
  modified_base (211)..(211): a, c, t, g, unknown or other
  misc_feature (211)..(211): n is a, c, g, or t
  modified_base (231)..(231): a, c, t, g, unknown or other
  misc_feature (231)..(231): n is a, c, g, or t
  modified_base (246)..(246): a, c, t, g, unknown or other
  misc_feature (246)..(246): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtncctcatcagtagtgtttctntggggctgggtccgnagcctccgagggagggctggaatacgattggaagtgtctctcatagtggaggttcctattacagttccgtctctcaagagtcgagtcaccatactctagtcggactacggtccagacaatcctacgtttttcccagtaacgtatgtagtttcgtgtcgacccgtcgctgacgacgggttctttattactggtgcgagacggtacgacttattattgtagtttttagggagttgtttattcgactacccgtagacgtcggacggggtctccggacccgtggggtcgagggtattacgtcggtacaccgttctccgtagtcccgtacccg

SEQ ID NO: 138737 - DNA, 576 bp, Homo sapiens
  misc_feature: GYAE6OF01E379V.46.67.G01.1.454.CMB.1.raw
  modified_base (334)..(334): a, c, t, g, unknown or other
  misc_feature (334)..(334): n is a, c, g, or t
  modified_base (387)..(387): a, c, t, g, unknown or other
  misc_feature (387)..(387): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagttggtttcttcgtggggctgggtccggcagcctccgaggggaagggctggaatacattggaagtgtctctcattaggtggtaggttcctattacagtccgtctctcaagngtcgagtcaccattatctcgtagacacgtcagcaatctacgttttcccagaantgtattctgtgacccgcgctgacgcggtctttatacgtgtcgcgagaggacgtcttagttatgttagttttggagttggtttactttcgacctaccgtagtagtccgggtcggggtcctaccgggacccgtggggacccgagggaacttacgtcggtcctaccggtcccttacgttcgcccttaacccg

SEQ ID NO: 138738 - DNA, 657 bp, Homo sapiens
  misc_feature: GYAE6OF01CA73H.46.67.G01.1.454.CMB.1.raw
  modified_base (193)..(193): a, c, t, g, unknown or other
  misc_feature (193)..(193): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtggganacagtgtcaccatctacttcggccgggcaaggtcggaactattcgactaaccttattttaaattggtaatcaactatagaccgagggaccgaccctaagctacctaatctatgctgcactccgtagtttagacgaaaggtcgggtacccagtcgtaggttcgagtggctaggtgtatcgtagggactagtactttacgactctacacctaatactaagtactctagactaacgtagtaacgtatttacgactaactttattactagtactaactaacgtaattacgtaagtttacggttttaccggaacgtaaacgggacctaacgtaaccgttaaactaaacgtttaaaccgaaacgttacggtacggtaccgtacgtaccctaacctacgtttacgttcggtttaccctttacttaccgtttaccccgttaccccgtaacctactttccgtacgttaaaccg

SEQ ID NO: 138739 - DNA, 653 bp, Homo sapiens
  misc_feature: GYAE6OF01DLO1T.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatccctccctgtctgcaaccggtgggagacagtgtcaccatcacttggccgggacaaggtacggaactattcgaactaaccttaatttaaagtggtaatacaacataacgaccgagggaccggccctaagctacctaatctatcgctgcatccgagtttgacgtaaaggtcgggtacccagtcggtaggttcaggtggactaggtggtatcggtagggaactagtaatttccacttctaccacctaattacgaagttaactctacgtacgtaacgtagtaaagttactttacgtaacttaacttacttaactacgtaactaacgtaacgtaaattaacgttaacttcggtttaccgaaccggtaacggtaccgtaaccgtaaacttaaactaaaagttaaccggtaacgttagtacgtacgtacgaccgtaacgtatacgttcgttaccttactacttacccgttaccccactacttcgtagttacg

SEQ ID NO: 138740 - DNA, 815 bp, Homo sapiens
  misc_feature: GYAE6OF01DKIRE.46.67.G01.1.454.CMB.1.raw
  modified_base (236)..(236): a, c, t, g, unknown or other
  misc_feature (236)..(236): n is a, c, g, or t
  modified_base (249)..(249): a, c, t, g, unknown or other
  misc_feature (249)..(249): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcagggagtccgggcccacgactggtgaggccttcggacgaccctgtccctcacctgcgctgtctctggtcgcctcatcagtagtgtttctgngggctgggtccgnagcctccgagggagggctggaatactagttggagtgtctctctagtaggtggtacggttctattacgacgtccgtctctcgaagtagtcgtacgtaccactatactcgttcgtacggaaccaccgttccaacgtactaacttccgttacgttttacccaggtaacgtacgttagtacggtttctacggtaccgacccgggtcccgtcgttacggaaccggttaccggggttacgttttaaccgtttaacgttgggtacggtacggaaggtaaccggtacgggttactttagtttaagttacggttttaaggtttttagggtacgggttttcggttttaaccttttacccgggtaaacccttaccccggttaagggtaacccggtttacccggggggtaaccccgggggttacccgttacccccggggtaaaccccccggggttcggggggtaacccggtaaaggggtaaacccggtttaacccgggtttcccgggttaaccccggtaccccgggttttaccccgttttacccccggttaaccggtccccccgttaaaaccccccgg

SEQ ID NO: 138741 - DNA, 688 bp, Homo sapiens
  misc_feature: GYAE6OF01CT17E.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaaccgtgggagacagtgtcaccatcacgttgccgggacaagtcggaacattgactactatttaaagttgtaatcaaacagtaacgaccgagggacggaccctaagctacctaatctatgctgacatcctagtttacgacgtaacggtcggggtaccctagtcggtaggttcaaggtggacgaggtggtactggtaggaactagtatttcacttcctacactactactaagtaatctagacgtaacggtagtaaagttagtttacgaaccttaacgttttacttaacgttacgttaactaaacgtaagtaaatttaactaaacgtttcggttttaaccggaacgtaaacggtacccgtaaacgtaaaccttaaaacgttaaaacgttaaacggtaaccgttggttacggtacctttacgaacccgtaaccgtacttacgtttaccgttacccgtttacctaccgtttaccccgttacccgtacccttaacgttcccgttagttaacccg

SEQ ID NO: 138742 - DNA, 601 bp, Homo sapiens
  misc_feature: GYAE6OF01D2ETB.46.67.G01.1.454.CMB.1.raw
  modified_base (192)..(192): a, c, t, g, unknown or other
  misc_feature (192)..(192): n is a, c, g, or t
  modified_base (217)..(217): a, c, t, g, unknown or other
  misc_feature (217)..(217): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccgggnaagtcgaacattgacacctattaaatgtatcaacatagaccagggacgccctaagctcctaatctatgctgcatccagtttgacaaaggtgggtcccatcgaggttcagtggcagtggatcgtgggactagatttcactctcaccatctaagtaatctgactaagtagaaagtattttagactaactttattacttagtactaaactaagtaaatttaacaagtttgttttaccggaccgaaaggggtaaccaacggtaaacctaaactaaaactttaaaccggaacttaggtacggtacctaggcctaaaccctattcccgttgttaccctttactaaacgtttccccgtttacccccggacctaacttccgttaggtaaacc

SEQ ID NO: 138743 - DNA, 711 bp, Homo sapiens
  misc_feature: GYAE6OF01CW17A.46.67.G01.1.454.CMB.1.raw
  modified_base (172)..(172): a, c, t, g, unknown or other
  misc_feature (172)..(172): n is a, c, g, or t
  modified_base (415)..(415): a, c, t, g, unknown or other
  misc_feature (415)..(415): n is a, c, g, or t
tcagactagcagtacacgaccggtgctcgatttagagtatacatattgggtttgtcctcctgctggtggcagctcccagatgggtcctgtccctggtgcaactgcaggagtccgggcccagactggtgaggtccttcggagaccctgtccctcacctgcgctgtctctggtncctccatcagtagttggtttcctcgtggggctgggtccggcagcctcccgaaggggaacggggctagggaatacgtagttagggaagtgtctctacagttaggtggtacggttaccttattacacggttcccgtctactacaaagagtcgacgtccaacccgaattactcctcgttacggactaccggtcagactaaagtctacgttttcccagaagtattgacgtttctgtcgaccgccgtntacggacgtaccgggttcttttaatacgttggtacgcgaaggacgtacggtacttattaagttgtttagttttacgggagtttcggttttacttacgaaccctaccgtagtacggttaccgggacggggtccttaccggaaccccgggtgggaccgtaagggtacttacggtcggtaccgtccgtccgttaccttacggcccttaccgaacccggtaacgggtcccctaggttccccggttcccctttccccggacgtcccctaacccctaccgtaccgaaacgtcgtaaccccgg

SEQ ID NO: 138744 - DNA, 533 bp, Homo sapiens
  misc_feature: GYAE6OF01C2OMA.46.67.G01.1.454.CMB.1.raw
  modified_base (192)..(192): a, c, t, g, unknown or other
  misc_feature (192)..(192): n is a, c, g, or t
  modified_base (229)..(229): a, c, t, g, unknown or other
  misc_feature (229)..(229): n is a, c, g, or t
  modified_base (360)..(360): a, c, t, g, unknown or other
  misc_feature (360)..(360): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttggccgggcaagtcggaacnttgacactatttaatgtatcaacatagaccagggacggaccctaagctcctaatctatgctgcatccagtttgacaaggtgggtacccagtcgaggttcagtgcagtggatcgtgggacagatttcacttntccacatacagtaactctcgacaacgtgaagttattttagactaacttattactagtactaacagtaatttacaagtttgtttacgacgtaaggactacgattaacaaattaacgaagtgtacggctgacgaactatcttcgttcttactctcccttcccactactctgtaac

SEQ ID NO: 138745 - DNA, 533 bp, Homo sapiens
  misc_feature: GYAE6OF01EDH5G.46.67.G01.1.454.CMB.1.raw
  modified_base (193)..(193): a, c, t, g, unknown or other
  misc_feature (193)..(193): n is a, c, g, or t
  modified_base (319)..(319): a, c, t, g, unknown or other
  misc_feature (319)..(319): n is a, c, g, or t
  modified_base (465)..(465): a, c, t, g, unknown or other
  misc_feature (465)..(465): n is a, c, g, or t
  modified_base (500)..(500): a, c, t, g, unknown or other
  misc_feature (500)..(500): n is a, c, g, or t
  modified_base (528)..(528): a, c, t, g, unknown or other
  misc_feature (528)..(528): n is a, c, g, or t
tcagactagcagtacacgaccggtgctcgatttagagtatacatattgggtttggggagtctcggtcaggacacagcatggacatgaagggtccccgctcagctcctggggctcctgctactctggctccgaggtgccagatgtgacatcgagctgacccagtctccatcctccctgtctgcaaccgtggganacagtgtcaccatcacttgccgggcaagtcggaacattgacactattaaatgtatcaacatagaccagggacggccctaagctcctaatctatgctgcatccagtttgcaaagtgggtcccatcgngttcagtggcagtggatcgtgggacagactttcactctcacatcagtaatctagactaacgtgaaacgtattttgactaactttattactagtacaacagtaacttactaattgtttccggaccaaagggactaacgaccttaaanaaattaaacgaatgtacgtctagacactattcgtnttactctactccttccgacctattcctntaacg

SEQ ID NO: 138746 - DNA, 579 bp, Homo sapiens
  misc_feature: GYAE6OF01C8LFO.46.67.G01.1.454.CMB.1.raw
  modified_base (191)..(191): a, c, t, g, unknown or other
  misc_feature (191)..(191): n is a, c, g, or t
  modified_base (349)..(349): a, c, t, g, unknown or other
  misc_feature (349)..(349): n is a, c, g, or t
  modified_base (390)..(390): a, c, t, g, unknown or other
  misc_feature (390)..(390): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaaccgtggganacagtcgtcaccatcacttgccgggcaagtcggaacattgacaccttatttaagtggtatcaacatagaccagggacgccctaagctactaatctatgctgcatccagtttgcaaggtcgggtcccagtcgtaggttcaggtgcaggtgatcgtgganagtatttcactctcacatacagtatctgacgagtagaagtntttagactaacttattacgtatacaactagtaacttactaagttcggtttacgaccgtaacgggtactaccgaacttaaactaaacgttaacgaacgttcgggttacgccttacgaccctaaacctattaccgttcgttacctttactaccctttcccgttacccctaccgttaacttcgttgtaaccg

SEQ ID NO: 138747 - DNA, 534 bp, Homo sapiens
  misc_feature: GYAE6OF01AVROL.46.67.G01.1.454.CMB.1.raw
  modified_base (193)..(193): a, c, t, g, unknown or other
  misc_feature (193)..(193): n is a, c, g, or t
  modified_base (435)..(435): a, c, t, g, unknown or other
  misc_feature (435)..(435): n is a, c, g, or t
  modified_base (445)..(445): a, c, t, g, unknown or other
  misc_feature (445)..(445): n is a, c, g, or t
  modified_base (505)..(505): a, c, t, g, unknown or other
  misc_feature (505)..(505): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtggganacagtgtcaccatcacttgccgggcaagtcgacatgacactatttaaatgatcaacatagaccagggacgccctaagctacctaatctatgctgcatccagtttgacgtaaaggtcggggtacccagtcggtaggttcaggtggctaggtcggtatcgtagggacaggtctttcactcctactaaccatacaagtaactcgtagtacgaagtgtaagtatttgactaactatactgtacaanagtaacttanattcgttcgacgtaggactaacgactaactaaataacgatagtgtactgactactatctntacttacacttcctaccactactgtgtac

SEQ ID NO: 138748 - DNA, 554 bp, Homo sapiens
  misc_feature: GYAE6OF01C4PKL.46.67.G01.1.454.CMB.1.raw
  modified_base (335)..(335): a, c, t, g, unknown or other
  misc_feature (335)..(335): n is a, c, g, or t
  modified_base (350)..(350): a, c, t, g, unknown or other
  misc_feature (350)..(350): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctcgtggggctgggtccggcagcctcccgaggggaaggggctggaatacattggaagtgtctctcatagtggaggttcctagtacagtccgtctctcaagagtcgagtcaaccatatctctgacacgtcagcaatcagttttccngaagatgagttctgngtaccgcgctgacacgggtcgtttattacgtgtgcgagagacggctattatgtagtttttggaagttgttagttcgacaccgtagactcgacggggctcgaccccgtgggaccagggatacgtggtctaccgtctcttacgcccttccgaccgtacgggcccagtccggtccttccccgcgcctaccctcctacccagctaccg

SEQ ID NO: 138749 - DNA, 646 bp, Homo sapiens
  misc_feature: GYAE6OF01C5SSV.46.67.G01.1.454.CMB.1.raw
  modified_base (349)..(349): a, c, t, g, unknown or other
  misc_feature (349)..(349): n is a, c, g, or t
  modified_base (466)..(466): a, c, t, g, unknown or other
  misc_feature (466)..(466): n is a, c, g, or t
  modified_base (489)..(489): a, c, t, g, unknown or other
  misc_feature (489)..(489): n is a, c, g, or t
  modified_base (586)..(586): a, c, t, g, unknown or other
  misc_feature (586)..(586): n is a, c, g, or t
  modified_base (593)..(593): a, c, t, g, unknown or other
  misc_feature (593)..(593): n is a, c, g, or t
  modified_base (601)..(601): a, c, t, g, unknown or other
  misc_feature (601)..(601): n is a, c, g, or t
  modified_base (637)..(637): a, c, t, g, unknown or other
  misc_feature (637)..(637): n is a, c, g, or t
tcagactagcagtacacgaccggtgctcgatttagagtatacatattgggtttggggagtctcggtcaggacacagcatggacatggagggtccccgctcagctccgtggggctcctgctactctggctccggaggtgccagatgtgacatcgagctgacccagtcctccatccctccctgtctgaccaaccggtgggaacacgtaggttcaccacctatctacgttcggaccgggataaggtccggaactagtttacgaaccttaacctttaagtttaaaagttcggtaactacgaaactagtacggaaccgaacgggtacccgtaccctaagcctacctaatcgtancgtactcgactactccgtagttcgaacgtaacggtcgggtcctagtaccgtaggtacaggtgactaggtgtacgtcgaggtaactgtaactttcgactcgtacaacatacaagttancgtagactaagtagtaaagtttnttacgaacttaagttacttagaacaactaagtaacttaattaacgtagtttcggttaaccgaaccggaaggtaacacgtaaactaactaaagtaacncggtagngtacctanaccgtctaatcgtgtaccctgaccttccctacgatntcgataccg

SEQ ID NO: 138750 - DNA, 696 bp, Homo sapiens
  misc_feature: GYAE6OF01ET48H.46.67.G01.1.454.CMB.1.raw
  modified_base (195)..(195): a, c, t, g, unknown or other
  misc_feature (195)..(195): n is a, c, g, or t
  modified_base (256)..(256): a, c, t, g, unknown or other
  misc_feature (256)..(256): n is a, c, g, or t
  modified_base (368)..(368): a, c, t, g, unknown or other
  misc_feature (368)..(368): n is a, c, g, or t
tcagactagcagtacacgaccggtgctcgatttagagtatacatattgggtttgggggagtctcggtcaggacacagcatggacatgagggtccccgctcagctcctggggctcctgctactctggctccgaggtgccagatgtgacatcgagctgacccagtctccatccctccctgtctgcaaccggtggganacagtgtccaccatcacgttcgccgggcaagtcgaacattgacactatttaatgtatcaanatagaccgagggaccgccctaagcctcctaatcctagtcgctgctatccgtagtttcgacgtaaagggtcgggtacccagtcggtaggttccagtggactaggtcggatcgngggactaggtacttcacttctaccaccgtataccgtaagttaactcgttcgaccgtaacggttacgtaaagttaagttttacggtaactttaaacctttaattttaaccgttagttaaccgtaaactaacggttaaatttaacgtaaactttgggtttttaacccggaaccggtaaaccgggtaccgtaaacgtaaccttaaacgttaaaaccgttaaaaccgtaacgttacgggtacggtactacgggtaccctacgttaactttcgttacgttaccttaccgtacctttcccgttacccgtaccttaacgttcgtaacgttaaccg

SEQ ID NO: 138751 - DNA, 573 bp, Homo sapiens
  misc_feature: GYAE6OF01EYGK1.46.67.G01.1.454.CMB.1.raw
  modified_base (329)..(329): a, c, t, g, unknown or other
  misc_feature (329)..(329): n is a, c, g, or t
  modified_base (334)..(334): a, c, t, g, unknown or other
  misc_feature (334)..(334): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctcgtggggctgggtccggcagctcccgaggggagggctggaatacattggaatgtctctcatagtggagttcctattacagtccgtctctcaagagtcgagtcacatatctctggacacgtcagcaatctagtttccngaacntgagttctgtcgaccgcgcgtcgacgacgggtcgtttatacgtgtgcgagagacgtactattagtagttagttttggagttgttattcgactaccgtagacgtcggacggggctccgacccggtggggaccgaagggtacttacgtgtcctaccgtctccgttacgccctacccaccggacggcccacgttcccggtcccttcccccgtcggtccctacccctcctacccagcgtcccg

SEQ ID NO: 138752 - DNA, 674 bp, Homo sapiens
  misc_feature: GYAE6OF01C55K3.46.67.G01.1.454.CMB.1.raw
  modified_base (322)..(322): a, c, t, g, unknown or other
  misc_feature (322)..(322): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggacgaccctgtccctcacctgcgctgtctctggtcgcctcatcagtagttggtttctcgtgggctgggtcgcagcctccgagggagggctaggaatacgagttggaagttgtctctacagtaggtggacgtttcctattacacgttccgtctctacgaagtacgtcgagtccaaccatatctcgnggaccacgtccagacaatcgttacgtttccagaacgtgtgtagttcgtgtacgacccgcgtctaggacgtacgggttctttaatacgtggtacgacgaaggtacggtacgtacttagttagttagttagttttagggagtttaggttactttacggaaccttaccgtagtacggtaccggtacggggtcctacccggaccgtcggggaccgtaagggtacctacggttacggtaccgtaccgttcttacccgtacgcccgttacccgaaccggtaaccggccctacggtccccggtttcccgtcccccggtcgtacccctacccgtaccctacgaaaccgtccgtaccccgg

SEQ ID NO: 138753 - DNA, 588 bp, Homo sapiens
  misc_feature: GYAE6OF01BTKPR.46.67.G01.1.454.CMB.1.raw
  modified_base (250)..(250): a, c, t, g, unknown or other
  misc_feature (250)..(250): n is a, c, g, or t
  modified_base (307)..(307): a, c, t, g, unknown or other
  misc_feature (307)..(307): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggcagctcccagggaagggctggaatacattggaagtgtctntcatagtggaggttcctattacagtccgtctctcaagagtcgagtcaccatatctcnggacacgtccagcaatcacgttttccagaacgatgagttctgtcgaccgccgctcgacgacgggtcttttatactgtcgcgaagagacggtctatttagtgttattttggagttggtttattcgacaccgtagacgtcggacggggcctacggacccgtggggccaagggtactacgtggtccaccgtcctcctagccctaccgaccgaacgggtcccacggttccgttcccttaccccccgtggtacccctaccccttacccgacctaacgcgtaccccg

SEQ ID NO: 138754 - DNA, 613 bp, Homo sapiens
  misc_feature: GYAE6OF01E3GBJ.46.67.G01.1.454.CMB.1.raw
  modified_base (294)..(294): a, c, t, g, unknown or other
  misc_feature (294)..(294): n is a, c, g, or t
  modified_base (405)..(405): a, c, t, g, unknown or other
  misc_feature (405)..(405): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctcgtggggctgggtccggcagcctcccgaggggaaggggctggaatacagttggaagtgtctctcagtagtggaggttcctattacagtccgtctctacaagngtcgagtcaccatatctcgtgaccacgtccagcaatctacgtttccagaagatgtacgttcgtgtcgaccgcgctgacgtacggtctttatacgtgtgacgagacgacgtntagttatgttagtttggtagttgtttacttcgactaccgtagtagtccgggtacggggcctaccggacccggtcgggaccgaagggtaacttccgtcggtacctaccgttcctaccgttaccgccctacccgtaaccgaccgggtaccctacgttcccggttccccttccccgacgtccctaccccgtaccctccgaacgcgtacccg

SEQ ID NO: 138755 - DNA, 724 bp, Homo sapiens
  misc_feature: GYAE6OF01CUNS5.46.67.G01.1.454.CMB.1.raw
  modified_base (208)..(208): a, c, t, g, unknown or other
  misc_feature (208)..(208): n is a, c, g, or t
  modified_base (238)..(238): a, c, t, g, unknown or other
  misc_feature (238)..(238): n is a, c, g, or t
  modified_base (265)..(265): a, c, t, g, unknown or other
  misc_feature (265)..(265): n is a, c, g, or t
  modified_base (281)..(281): a, c, t, g, unknown or other
  misc_feature (281)..(281): n is a, c, g, or t
  modified_base (415)..(415): a, c, t, g, unknown or other
  misc_feature (415)..(415): n is a, c, g, or t
tcagactagcagtacacgaccggtgctcgatttagagtatacatattgggtttggggacctctgtgcaagaacatgaagcacctgtggtttgtcctcctgcctggtcggcacgcctcccagtacttgggtccctgtccctggtcaccaacgtgccaggagtccgggcccaagacgtggtgacggtcccttacggacgtccctgtcccncacccgtgccgtctcgtactcgtcggtacncctcagtcgagttcgttgtttctcggngggtactcggtccganacgtccgtaccggaaggggacggtactaggaatacgtagttacggacgttcgtacgttctacgtagttaggtcggtacgttacctacgttacgtacgtacccgtctacgtacgaagtcgtacgacgtacacgtntacgtctacgacgaccctcgacgacgctacgttccgtacgtttccaagtaacgtcgtggtacgttcgtgacgtaccgcgtacgtacgtaaccggttacggttactttacgttacgtgtacggacgaagtacgtacgtattaggttacttaggtttacgtttaggtaaggtttcgttaccgttaccgaaccgtccgtaaggtaccggtcccgggaccggttcccgacccggtaacccggtggtaccggaacggttaccgtacccgtaccggtcctacccgttacctacccgtcccgtcccgtaaacccgg

SEQ ID NO: 138756 - DNA, 533 bp, Homo sapiens
  misc_feature: GYAE6OF01AUCHS.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacggccctaagctcctaatctatgctgcatccagtttgcaaagtgggtcccatcgaggttcagtggcagtggatcgtgggacagtatttcactctcaccatcagtaatctgacaacgtgaagtatttgactaacttattactgtacaacagtaattacaagttgttttacggactaagggactacgtaactaacaaattaaacgaacgtgtacgctacgacacctatctcgtccttctacttccttaccccgacctacttcgtgtaac

SEQ ID NO: 138757 - DNA, 658 bp, Homo sapiens
  misc_feature: GYAE6OF01DG4S6.46.67.G01.1.454.CMB.1.raw
  modified_base (195)..(195): a, c, t, g, unknown or other
  misc_feature (195)..(195): n is a, c, g, or t
tcagactagcagtacacgaccggtgctcgatttagagtatacatattgggtttggggagtctcggtcaggacacagcatggacatgagggtccccgctcagctccgtggggctcctgctactctggctccgaggtgccagatgtgacatcgagctcgacccagtctccatcctccctgtctgcaaccggtggganacagtgtcaccatcacgttcggaccgggacaaggttacggaactagtttcgaacctaaccttaattttaaaacttggtattacaacataacgaccgaggggtaccggccctaagctacctaatcttatcgtctgctacttctagtttgacgaaacggttcgggtacccatcggtaaggttcaggtcggacaggtaggtatcgttagggactggtactttcacctcacacctataccgtaagttactcgtacacgtaacgtagaagtttacgtttagaacttaacgttacttacgtatacgtaataacgtaattaactaagttcgtttaccggaaccgtaaggaccgtaaactaagttaaactaaacgttaaaccgaaggttcggtacgacgttacgaaccgtacctaacttctacggttcttaaccgttacctcccttaccccgaacttcgttactggttacc

SEQ ID NO: 138758 - DNA, 609 bp, Homo sapiens
  misc_feature: GYAE6OF01BTTOQ.46.67.G01.1.454.CMB.1.raw
  modified_base (195)..(195): a, c, t, g, unknown or other
  misc_feature (195)..(195): n is a, c, g, or t
tcagactagcagtacacgaccggtgctcgatttagagtatacatattgggtttgggggagtctcggtcaggactacagcatggacatgagggtccccgctcagctcctggggctcctgctactcctggctccgaggtgccgagatgtgacatcgagctgacccagtctccatcctcctgtctgcaaccgtggganacagtcgtaccacatcacttggccgggcaaggtcgaactattcgactacctatttaatggtatcaacatacgacaggacgacctagctctatctatgctgacactcgtagtttcgacgtaacggtcgggtacctagtcggtaggttcgacggtggacgtaggtaggtagtccgtaggactagtacttcactctacacatcgaagtatctagactacgtagtaattactttacgaactaactttactacttacgtacaacgtaataacttacgttaagttcgtttaccgaacgttaacggtacctaacgtaacttaaactaaagttaaaccgattacgggtacgtactacggacctacgtagttaccgtcgttacttacctacgtttccctacccgtacctacttccgtgtaacc

SEQ ID NO: 138759 - DNA, 578 bp, Homo sapiens
  misc_feature: GYAE6OF01D7XVM.46.67.G01.1.454.CMB.1.raw
  modified_base (229)..(229): a, c, t, g, unknown or other
  misc_feature (229)..(229): n is a, c, g, or t
  modified_base (395)..(395): a, c, t, g, unknown or other
  misc_feature (395)..(395): n is a, c, g, or t
  modified_base (434)..(434): a, c, t, g, unknown or other
  misc_feature (434)..(434): n is a, c, g, or t
tcagactagcagtacacgaccggtgctcgatttagagtatacatattgggtttgggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccaggcaagtcggaacnttgacactatttaaattggtatcaacatagaccagggacggccctaagctctaatctatgctgcatccagtttgactaaagtcgggtcccagtcggaggttcagtggctaggtgatcgtggactagtatttcactctcacatacagttaactctagacaacgttanaacgtattttcgacttaactttattaacgtgtaaccaanacgtaaatttaacaagtttcggttttacggaccgtaaggggtaacctaagtaactaaacgtaaattaaacggaacttgtacggacttacgaccgacttattcctagttccttacgtaccttcccttaccccgccttatcgtacg

SEQ ID NO: 138760 - DNA, 725 bp, Homo sapiens
  misc_feature: GYAE6OF01ER02W.46.67.G01.1.454.CMB.1.raw
  modified_base (315)..(315): a, c, t, g, unknown or other
  misc_feature (315)..(315): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctcgtggggctgggtccggcagcctcccgaggggagggctggaatacagttggagtgtctctcatagtggaggttcctattacacgtccgtctctcaagagtcgagtcacattatcctcgtgacncgtccagcctaatctacgttttcccagaagactagtacgtttctcggttcgaccgccgtcgtagaccgtacggggtacttttacgttacgtggtacgacggtaaggacggtacggtacttaagtttagttaggtttaagtttttaggggagtttaggttttacttttaccggaaccgttaaccccttaagggtacgttacccggggtaccgggggttcctacccgggtaacccccgggttagggggacccgtaagggggtaaccttaccggtcgggttaccctacccggttccgtacccgttaccgaccccgtacccgacccggaaccgggtaccccaacggttccccggttacccgttcccccgtacggtccctacccccgttaccctacccgaacgtaccggtacccg

SEQ ID NO: 138761 - DNA, 674 bp, Homo sapiens
  misc_feature: GYAE6OF01B6W75.46.67.G01.1.454.CMB.1.raw
  modified_base (193)..(193): a, c, t, g, unknown or other
  misc_feature (193)..(193): n is a, c, g, or t
  modified_base (220)..(220): a, c, t, g, unknown or other
  misc_feature (220)..(220): n is a, c, g, or t
  modified_base (657)..(657): a, c, t, g, unknown or other
  misc_feature (657)..(657): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtggganacagtgtccaccatcacttgccggganaagtcggaacattgactactatttaacttggtatacaatatacgaccgagggaccgaccctaagctacctaatctatgctgctactccgtagtttcgacgaaagggtcgggtaccctagttcggtagtttccgaggtcggactaagggtggtacgtcggtagggaactagtactttaccgactacctcgtaacctagtacgtaacgttaactccgttagaaccgtaacgggttaataacggttattttacgaactttaaactttacttaacgtacgtaactaaacgtaagtttaacttaacgttaacgtttacggtttaaccggaaccggtaaacggaaccgttaacgaacttaaaaccgtaaacgttaaaccggtaagtcgtaacggtctacggtacctaccgtatacttcgttacttactaccttccgttacccncttaactccgtgtaacc

SEQ ID NO: 138762 - DNA, 659 bp, Homo sapiens
  misc_feature: GYAE6OF01CWY9N.46.67.G01.1.454.CMB.1.raw
  modified_base (175)..(175): a, c, t, g, unknown or other
  misc_feature (175)..(175): n is a, c, g, or t
tcagactagcagtacacgaccggtgctcgatttagagtatacatattgggtttgtcctcctgctggtggcagctcccagatgggtcctgtccctggtgcaactgcaggagtccgggccccacgactggtgaggccttcggagacccctgtcccctcacctgcgctgtctctggtncctccatcagtagtggttttctcgtggggctgggtccgcagctccgaggggaaggggctggaatacagttggaagtgtctctcagtagtggaggttcctattacagtccgtctctcaagagtcgagtcacctatactctctggaccacgtccagacaattctacgttttcccctgaacgtattgagttctggtgacccgcgctcgacgcgggtcttttagtactgtcgcgagacggtacggtacttattagtgttagtttttggtagttggtttatttcgacctacccgtagtacgtcgggacggggtcctacccggaccccgtcgggggaccgaaggggtaactacggttcggtacccgtacccggttccttacccgttacgcccgtacccgaacccggaaccgggtacccctacggttcccggttaccccgtttccccccgtcggtacccctacccccttcccgtacccaacgcgtaccccg

SEQ ID NO: 138763 - DNA, 620 bp, Homo sapiens
  misc_feature: GYAE6OF01CKBAI.46.67.G01.1.454.CMB.1.raw
  modified_base (194)..(194): a, c, t, g, unknown or other
  misc_feature (194)..(194): n is a, c, g, or t
  modified_base (216)..(216): a, c, t, g, unknown or other
  misc_feature (216)..(216): n is a, c, g, or t
  modified_base (250)..(250): a, c, t, g, unknown or other
  misc_feature (250)..(250): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaaccgtgggagacngtgtcaccatcacttggccggnaagtcgaacattgacactatttaaatgtatcaanatagaccagggaccgaccctaagctacctaatctatgctgcactcctagtttagacgtaaggtcgggtacccagtcggagttcaggtggacgagtggatcgtagggactagtattcacttcgtcaacctatactaagtatctgaactacgtagtaagttatttcgtactaacgtttattactagtaccaaactagttaaacttacgtaagttttcggtttaccgaaccgtaacgggaacctaacgtaaccttaaaacaaactttaacggaacttcgggtaagacgttacgaactacccgaatttccggtcgtttaacccttagttacccttaccccgggttacccctacgtaaccttcgtaacgttaacg

SEQ ID NO: 138764 - DNA, 522 bp, Homo sapiens
  misc_feature: GYAE6OF01AH893.46.67.G01.1.454.CMB.1.raw
  modified_base (219)..(219): a, c, t, g, unknown or other
  misc_feature (219)..(219): n is a, c, g, or t
  modified_base (405)..(405): a, c, t, g, unknown or other
  misc_feature (405)..(405): n is a, c, g, or t
  modified_base (411)..(411): a, c, t, g, unknown or other
  misc_feature (411)..(411): n is a, c, g, or t
  modified_base (474)..(474): a, c, t, g, unknown or other
  misc_feature (474)..(474): n is a, c, g, or t
  modified_base (482)..(482): a, c, t, g, unknown or other
  misc_feature (482)..(482): n is a, c, g, or t
tcagactagcagtacacgaccggtgctcgatttagagtatacatattgggtttgggggagtctcggtcaggacacagcatggacatgagggtccccgctcagctcctggggctcctgctactctggctccgaggtgccagatgtgacatcgagctgacccagtctccatcctccctgtctgcaaccggtgggagacagtgtcaccatcacttgccgggnaagtcggaacattgacacctatttaaattggtatcaacatagaccagggacggccctaagctcctaatctatgctgcatccagtttgcaaagtggggtcccatcgaggttcagtggcagtggatcgtgggacagtatttcacttctcaccatcaagtatctgcaacgtgaatattttgctaacttnttactntacaacagtaacttacaattgtttacggaccaaggacacgactaactaaattaacgaacttgngtctgacncctatctgtccttctacttccttcccgacctactctgtac

SEQ ID NO: 138765 - DNA, 676 bp, Homo sapiens
  misc_feature: GYAE6OF01ARPQ5.46.67.G01.1.454.CMB.1.raw
  modified_base (228)..(228): a, c, t, g, unknown or other
  misc_feature (228)..(228): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaccggtggagacagtgtcaccatcacttgccgggacaagtcgaactnttgactaccttaatttaaagttggtactacaacaagtacgaccgacgggaccgaccctaagcctacctaatctatcgtctcgcgtataccgtagtttacgacgtaaggtcgggtacctagtcgtaggttcaggtcgacgtaggtgacgtgtagggactagtactttcacgtccgtactactatcgtaagttaactcgtagaccgtaagtagtaagttacgtttacgacttaaactttacttaacgtagttaacctaacgtaagttaaactttaacgtaagtttacggtttaccggaaccgtaacggtaaccgtaaccgtaacgttaaacgtaaacgttaaaccgtaacgttacggtacggtacgtacgtaacccgtaaccttagttacgttccttacgtttacctaccctttacccgtaccccgttactacgttcttaaaggttaccg

SEQ ID NO: 138766 - DNA, 689 bp, Homo sapiens
  misc_feature: GYAE6OF01BM1N6.46.67.G01.1.454.CMB.1.raw
  modified_base (219)..(219): a, c, t, g, unknown or other
  misc_feature (219)..(219): n is a, c, g, or t
  modified_base (231)..(231): a, c, t, g, unknown or other
  misc_feature (231)..(231): n is a, c, g, or t
  modified_base (257)..(257): a, c, t, g, unknown or other
  misc_feature (257)..(257): n is a, c, g, or t
  modified_base (674)..(674): a, c, t, g, unknown or other
  misc_feature (674)..(674): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtgggagacagtgtcaccatcacttgccggganaagtcggaactnttgactactatttaaatggtatcaanatagaccgaggaccgcctaagctacgtaatctatgctgctactacctagtttagacgtaaaggttcggggtaccctagtccgtaggttcaggtcgcgtagtggtatcgtgggaatacgtagtttaccgactccttcgaaccctagttcctaagttaactcgtacggaccgtaaacggttaggtaaagtttacgttttacgaacctttaaaaccgttttattaaccgttacggttaacctaaaacgtaacggtaaacgtttttaacgaaacgtttttcggggttttaacccgaaccccggttaaaaggggtacccttaaaccgtaaaccttaaacgtaaaaccgttaaaccgtacgttaggtaccggtactacggactaccgtattcgtcgttacccttagtaccttcccgttacccnttatccgtagttacc

SEQ ID NO: 138767 - DNA, 645 bp, Homo sapiens
  misc_feature: GYAE6OF01B7XXN.46.67.G01.1.454.CMB.1.raw
  modified_base (195)..(195): a, c, t, g, unknown or other
  misc_feature (195)..(195): n is a, c, g, or t
  modified_base (223)..(223): a, c, t, g, unknown or other
  misc_feature (223)..(223): n is a, c, g, or t
  modified_base (234)..(234): a, c, t, g, unknown or other
  misc_feature (234)..(234): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgaccccagtctccatccctccctgtctgcaaccggtggganacagtgtccaccatcacttggccggganaaggtcgaacnttgactacttatttaaatgtatacaacatacgaccgagggaccgaccctaagcctacctaatctatgctgctactcctagtttcgacgtaaggtcgggtacccagtcggtaggttcagtcggacaggtggactcggtagggaactagtactttcactctaccacctatacgtaagttaactcgtacgacgtaacgtagtaaacgttattttacgaacttaacttttattaaccgttacgtaactaaacgtaattaaactttaacgtaagtttcggtttaaccggaacgtaaaggtacctaacgtaacttaaacgtaaacttaacggaacgttggtacgtactacgaacctacgtattccgttacgttaccttacgttaccttcccgttacccgtatacttacgtacgtacg

SEQ ID NO: 138768 - DNA, 681 bp, Homo sapiens
  misc_feature: GYAE6OF01CA714.46.67.G01.1.454.CMB.1.raw
  modified_base (211)..(211): a, c, t, g, unknown or other
  misc_feature (211)..(211): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggnagctcccgaggggaaggggctggaatacagttggaagtgtctctcatagtggaggttcctattacagtccgtctctcaagagtcgagtcaccatatctctggcacgtccagcaatctacgttttcccagaagatgtagttctgcgaccgccgctcggacgacgggtacgttttatacgtggtcgacggagacggtacggtacttagtttacgttagttagtttttagggaagtttcggttttatttaccggtacctaccccgttagtacgtcgggaccgggggtccgtacccggtaccccggttggggacccgtaacggggtaacgttaccggttacgggtacccttacccggttcccttcccgttaccggtccccgttacccgaacccggtaaccgggcccctaccggttcccggttccccttcccccgtcgggtcccctaccccctccctacccgaagccgtaccccg

SEQ ID NO: 138769 - DNA, 726 bp, Homo sapiens
  misc_feature: GYAE6OF01CPXIO.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtccgggcccacgactggtgaggccttcggagaccctgtccctcacctgcgctgtctctggtcgcctccatcagtagtggtttctcgtggggctgggtccggcacgctcccgaggggaagggctaggaatacagttaggaagtcgtctctcagtaggtggtacggttcctagttactacgtccgtctcgtacaaggtacgtacggagttccaacctattactccgtacgtacggacctaccgtaccacgtactaaactccttacgttttacccaggtaagtattgtacgtttctggtaccgacccggtccgtacgtacggtaaccggtacgggtttacgttttaacgttcggtggtacggtacggaaggtaacggtacggtacttttaagttagtttaggtttagtttttagggtaaggtttggtttactttaccgtaaccgtaccgtaggtacgtccgggacgggtccgttcccggacccggtcggggaccgtaacggggtatccggtacgtaccgtcccgtccttccgtaccgccctacccgaccggtaccggtccacggttcccggtaccccttccccgcgtacccctacccgaccctacgacgtccgtacccg

SEQ ID NO: 138770 - DNA, 633 bp, Homo sapiens
  misc_feature: GYAE6OF01D6WCC.46.67.G01.1.454.CMB.1.raw
  modified_base (192)..(192): a, c, t, g, unknown or other
  misc_feature (192)..(192): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttcggccgggacaagtcggaactattgacctaccttatttaaatggtatcaacatacgaccgagggaccgccctaagcctacctaatctatcgctgctactccgtagtttgacgtaaaggtcggggtaccctagtcggtaggttacaggtcggacgagtggatcgtagggaactagtacttccgactcgtacaaccgtatacgtaattactctagacgtaacgtagtaaacttatttacgaacttaactttacttacgtgtaacaataagtaattaacgtaacgtttcggtttaccgaacgaacgggtacctaacgtaactaaactaaacgttaaactaacgttgtacgtctacgacctaactattcgttacgttaccgttactaaccgtttccccgtaccccgtacttactccgtgttaaaccg

SEQ ID NO: 138771 - DNA, 639 bp, Homo sapiens
  misc_feature: GYAE6OF01BACI4.46.67.G01.1.454.CMB.1.raw
  modified_base (343)..(343): a, c, t, g, unknown or other
  misc_feature (343)..(343): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctcgtggggctgggtccgcagcctccgaggggagggctaggaatacagttggaagtgtctctcatagtggagttcctattacagtccgtctctacaagagtcgagtcactatatctcgtggacacgtccagacaatctacgttttccagaagntagtagttcgtgtcgaccgccgcgtcgacgtacgggtacttttatacgtgtagacgagagacgtactagttagagttttttttttttttttttagtaggttagttagtttagtttacgtacctaccgtagacgtacgggacgggtccgtccggacccggtcgggaccggaagggtaacgtacgtcggtaccgtaccgtccgtccgttacgccctacccgacccgaccgggtacccgtacgttcccgttcccgttccccgtccgtccctacccctaccctacccgacgacgtacccg

SEQ ID NO: 138772 - DNA, 582 bp, Homo sapiens
  misc_feature: GYAE6OF01BGE5C.46.67.G01.1.454.CMB.1.raw
  modified_base (250)..(250): a, c, t, g, unknown or other
  misc_feature (250)..(250): n is a, c, g, or t
  modified_base (330)..(330): a, c, t, g, unknown or other
  misc_feature (330)..(330): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctcgtggggctgggtccggnagctcccgagggaaggggctggaatacagttggaagtgtctctcatagtggaggttcctattacagtccgtctctcaagngtcgagtcacatatctctgacacgtcagcaatctagttttccctagaagtatgtagttctgtcgacccggccgtcgtgaaccgtacgggtacgttttaattacgtgttcggcgaggacgacggtcttagtttatgttagtttttggagtttggtttactttacgactaccctagtagtccgggaccggggtctccggaccccggtggggaccgagggtactcgtacggtcaccgtctccttcgccctacccg

SEQ ID NO: 138773 - DNA, 573 bp, Homo sapiens
  misc_feature: GYAE6OF01C563Q.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttggccgggcaagtcggaacattgacactatttaatggtatcaatatagaccagggacgccctaagctctaatctatgctgcatccagtttgcaagtcgggtcccagtcgaggttcagtgcaggtgatcgtgggactagtatttcactctacactatcagtaatctgactaagtcgtaagtacttttgactaactttattactcgtacaactagtaaattactaatttcggtttaccgaccgtaaagggacctaacgtaacttaactaaaagttaaccgaacttggtacgtaccttagaccgtaacctagttacttcgttacctttcgtaacttcccgttccccgacctacgttcttagtaaccg

SEQ ID NO: 138774 - DNA, 556 bp, Homo sapiens
  misc_feature: GYAE6OF01EIHAI.46.67.G01.1.454.CMB.1.raw
  modified_base (543)..(543): a, c, t, g, unknown or other
  misc_feature (543)..(543): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagacccctgtccctcacctgcgctgtctctggtgcctccatcagtagtggtttctctgggctgggtccgcagctcccagggagggctggaatacattggaagtgtctctcatagtggagttcctattacagtccgtctctcaagatcgagtcaccatatctctggacacgtccagcaatcagttttccctgaacgatgagtttctgtcgaccgccggctcgacacggggtctttagtactgtgcgagagacggctattatgtattttggagttggttatttcgacaccctagactcggacggggctccggacccgtgggccagggaacttacgtggtcaccgtctccttacgcctaccgaccgaggccccagtccggtaccttcccccgcggtccaccccttccnccaacgcgtaccc

SEQ ID NO: 138775 - DNA, 560 bp, Homo sapiens
  misc_feature: GYAE6OF01B336O.46.67.G01.1.454.CMB.1.raw
  modified_base (337)..(337): a, c, t, g, unknown or other
  misc_feature (337)..(337): n is a, c, g, or t
  modified_base (436)..(436): a, c, t, g, unknown or other
  misc_feature (436)..(436): n is a, c, g, or t
  modified_base (542)..(542): a, c, t, g, unknown or other
  misc_feature (542)..(542): n is a, c, g, or t
tcagactagcagtacacgaccggtgctcgatttagagtatacatattgggtttgtcctcctgctggtggcagctcccagatgggtcctgtccctggtgcaactgcaggagtcgggccccacgactggtgaggccttcggagacccctgtccctcacctgcgctgtctctggtgcctccatcagtagtggtttctcgtggggctgggtccgcagctcccgagggagggctggaatacagttggagtgtctctcagtagtggaggttcctattacagtccgtctctcaagagtcgagtcaccatatctctggacaccgtccagcaatctagttttcccngaagatgagttctgtgaccgcgctgacacgggtcgtttatacgtgtgcgagagacggctattatgttagttttggagttggttatttcgacaccctagngtcggacggggcctcggcccgtgggccagggtactcgtgtcctacgtctccgtacgccctaccgaccgacggcccacgtcgtcccttcccccgtcgccctaccccncctaccgaagcgtacccg

SEQ ID NO: 138776 - DNA, 649 bp, Homo sapiens
  misc_feature: GYAE6OF01CPGGC.46.67.G01.1.454.CMB.1.raw
  modified_base (192)..(192): a, c, t, g, unknown or other
  misc_feature (192)..(192): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccgggacaagtcggaacattgacaccttatttaaattgtatcaacatagaccagggaccggaccctaagctacctaatctatgctgcatcctagtttcgacgtaaaggttcggggtccctagtcggtaggttcaaggtggctaggtggtatcgtgggacagtatttaccacttcctccaacctatactaagttaacttcgtacgacgtaacggtagtaagtttattttacgaacttaaactttatttacttacgtaaccaaacgtaataaactttaactaagttttacggttttaccggaaccgtaacggaacctaacgtaaactaaacttaaaacgttaacgtaacgttggtacggactacgtaccgtacctatttaccgtcgtttaccttacctacctttaccccgtacccgtacccttacttccgtagttaaccg

SEQ ID NO: 138777 - DNA, 639 bp, Homo sapiens
  misc_feature: GYAE6OF01B1V8T.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtcgcctccatcagtagttggtttctcgtggggctgggtccggcagcctccgagggagggctggaatacattggaagtgtctctcagtagtggaggttcctattacagtccgtctctacaagtagtcgagtcaaccatactctcgtcgaacacgtacagctaaattctacgtttttcccagtaaacgtatggtacgtttcgtgttaccggacccgccggtctacggaccgtacggggttacgttttactttaacgtggtcggtacgaaggtaggtacggtacttatttagtagttagttttggagtttgtttacgttacgtacctaccgtagacgttccgggacggggtccttaccggcccggttaggggaccacggggtaataccggttcggtaccgacccgttagtacccttacgtcccgtaaccccgg

SEQ ID NO: 138778 - DNA, 601 bp, Homo sapiens
  misc_feature: GYAE6OF01AUGAV.46.67.G01.1.454.CMB.1.raw
  modified_base (217)..(217): a, c, t, g, unknown or other
  misc_feature (217)..(217): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggnaagtcggaacattgacacctatttaaattggtatcaacatagaccagggacgccctaagctacctaatctatgctgcatccagtttgactaaaggtgggtcccatcgagttcagtggcagtggatcgtagggacagtattcactctcacctatcagtactctagactaacgtgtaagtattttacgacttaactttacttactagtactaactagtaacttactaattgtttaccggacgtaacggactaacgacttaaactaaatttaaacgaaccgtgtacgggtacctacggtaccaaccttagttaccgttagtttacccgttacctaaccgtttaccccctttacccccggtaccgttaactttaccgttcggtaaacc

SEQ ID NO: 138779 - DNA, 753 bp, Homo sapiens
  misc_feature: GYAE6OF01DN3CR.46.67.G01.1.454.CMB.1.raw
  modified_base (193)..(193): a, c, t, g, unknown or other
  misc_feature (193)..(193): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatccctccctgtctgcaaccgtggganacagtgtcaccatccacgttggccgggacaaggtcggaaactagtttacgaactaccttaatttaaaacgttggttaacttacaaacaattaagaacccgaagggaccggaccctaagcctcctaatctatgctgctactcctagtttcgactaaaggtcgggtccctagtcgtaggttcagtggacagtgaacgtcgtagggactagtactttacacgttcctaccgtaacctacttactaaggttaaacttccgtaacggtaaccgtaaacggttaggaaagttttaagttttacggtaacctttaaaccgttttaatttaaccgttagttaaaccgtaaacgttaaagtttaaaactttaaacgttaacgttttacggttttaacccgggaaccgtaaagggtaaacccgtaacggtaaaccttaaaacgttaaaaacgtttaaaccgaaacggtttagttacggtactaaccggtaccaacccggttaattccgtttaccgttccttaacctaaccgttcccgttacccccgattaaccttcgttaagttaacccg

SEQ ID NO: 138780 - DNA, 1135 bp, Homo sapiens
  misc_feature: GYAE6OF01AZJKL.46.67.G01.1.454.CMB.1.raw
tcagactagcagtacacgaccggtgctcgatttagagtatacatattgggtttggtcctccctagctggtggcgaggctcccgagactgggtcctgtccctggtgcaactagcgacggaggtccgggcccaacggacgtaggtgtacggtccgttccggaaggaccccgttcggtacccttaccgaacccgttcgccggccttcgttacttcgttaggttcggccccttccaacgttaccgaaggttaccggttgggttttacccttacggtcgggggtccgttagggggttcccgggacgtaggggaccttacccccgaagggggaaaccgggggtccgttaggggaaaacgtttaccggtaagtttacgggaaaaggttcggttaccctcccgttaacgtaaaggtttacgggtacggggtaacgggttttaccccgttaaagttttaacccgtaacggttaccccggtttaccgttacccgttaaccggtaaaacgggtaaccggttaccccggtaaacggttccccgaaaaccccgtaactttaaaccgttcccgttaccgtttaacgggtaacctaacccgggtttacccgaaacggtaccgtaaaacgttacccgttaaaccggtttttttaccccccgtaagggtaaaaccggttaacgtaccggtaaacggttttccggttacggttaaccggtaaccccggttcccggtccgttacgggaaacccgtaaaccgggggttaaccgtttttaaccgttaaaccggttacgggttacgggaccgtaaacggtaacggtaacccgggttacgttaacgttttaacgtttaggtttaaacgttttttacggggaacgtttaagggtttaacgttttaccggtaaccgtaaccccgttaaggtaccgttccgggtaacccggggtcctacccggtacccccggtacggggtaccccgtaacggggtaaaccgttaccggttcgggttacccttaccccggttccgttaccccgttacccgtaccccgtaccccgtaacccggtaaccggtccccgaacggttcccgggttaccccgttcccccgtaccggtcccgtacccccgtacccgtacccgtaaggtccgtaccccgg

SEQ ID NO: 138781 - DNA, 550 bp, Homo sapiens
  misc_feature: GYAE6OF01D41DU.46.67.G01.1.454.CMB.1.raw
  modified_base (335)..(335): a, c, t, g, unknown or other
  misc_feature (335)..(335): n is a, c, g, or t
  modified_base (395)..(395): a, c, t, g, unknown or other
  misc_feature (395)..(395): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccgagggaaggggctggaatacattggaagtgtctctcatagtggaggttcctattacagtccgtctctcaagagtcgagtcaccatatctctggacacgtccagcaatcagttttcccngaagatgagtttctgtgaccgccgctgacacgggtcgtttattactgtgcgagagacggntattatgtagttttggagttggttatttcgacaccctagatcggacggggctcgacccgtggggccagggaatacgtggtcaccgtctcctagccctccaccgaggcccagtccggtccttccccgtcggtcccaccctccctccagcgtacccg

SEQ ID NO: 138782 - DNA, 690 bp, Homo sapiens
  misc_feature: GYAE6OF01DLSKT.46.67.G01.1.454.CMB.1.raw
  modified_base (379)..(379): a, c, t, g, unknown or other
  misc_feature (379)..(379): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtgggctgggtccgcagcctcccgagggaaggggctaggaatacagttggaagtgtctctcatgtggaggttcctattacagttccgtctctcaagagtcgagtcaacctatactctctaggacctacgtcccagtacaaattcgtacgttttccagaagattgtagttcttgtcgaccgcccgntaggaccgtacgggttcttttatacgtggtcgacggagacgtacggttcttaagttagttaggtttagtttttagggacgttttagggtttactttaccggaacctacccgttaggtaccggttaccgggacgggggtccctaccgggaccccggttaggggacccgtaacggggtaacttacggtccgggtacctacccggttctacccgttaccgccctacccaacccggacggaccccgtacgtcccggttcccccttccccgccggtaccccttacccccgtaccctacccgaaacgtccgaccccg

SEQ ID NO: 138783 - DNA, 615 bp, Homo sapiens
  misc_feature: GYAE6OF01DEWOT.46.67.G01.1.454.CMB.1.raw
  modified_base (99)..(99): a, c, t, g, unknown or other
  misc_feature (99)..(99): n is a, c, g, or t
  modified_base (198)..(198): a, c, t, g, unknown or other
  misc_feature (198)..(198): n is a, c, g, or t
  modified_base (242)..(242): a, c, t, g, unknown or other
  misc_feature (242)..(242): n is a, c, g, or t
  modified_base (562)..(562): a, c, t, g, unknown or other
  misc_feature (562)..(562): n is a, c, g, or t
tcagactagcagtacacgaccggtgctcgatttagagtatacatattgggtttgggggagtctcggtcaggacacagcatggacatgagggttccccgntcagctcctggggctcctgctactctggctcgaggtgccagatgtgacatcgagctgacccagtcctccactccctcctgtcctgccaaccggtggganacagtcgtccaccatccacgttcggccgggacaaggtcggaacnttgactacttatttaatgtatcaacatagaccgagggaccgccctaagctctaatctatgctgcatcctagtttgacgtaaggtcgggtacccaagtcggtaaggttcaggtgactaggtacgatcgtgggaactacgtactttacacttctacactatacagtaatctgacgtaagtgtaacttatttacgactaacgtttattacgtagtaaccgaactaagttaaacttacttagttacggtttaccgacgtaacgggtaacacgtaacttaaacgtaaacttaacgaacgttgtacggtactacgacctaaacgtnttaccgttcgttacccttactacttcccttacccgcttaacgtcctagtaacc

SEQ ID NO: 138784 - DNA, 846 bp, Homo sapiens
  misc_feature: GYAE6OF01CD5QD.46.67.G01.1.454.CMB.1.raw
  modified_base (175)..(175): a, c, t, g, unknown or other
  misc_feature (175)..(175): n is a, c, g, or t
  modified_base (210)..(210): a, c, t, g, unknown or other
  misc_feature (210)..(210): n is a, c, g, or t
tcagactagcagtacacgaccggtgctcgatttagagtatacatattgggtttgtcctcctgctggtggcagctcccagatgggtcctgtccctggtgcaactgcaggagtccgggcccacgactggtgaggccttcggacgaccctgtccctcacctgcgctgtctcgtggtcncctcatcagtagtgtttctcgtgggctgggtccgnagcctccgaggggaagggctaggaactacgtagttggaagtcgtctactactaagtaggttaggtacggtttacctattacgacgttccgttctaccgtacgaaaggtacggtacggtaacgttccaaccctaagttaacttccgtaccgttacgggaacctacccggttaccaacggaccttaaaacttccgtttaaccgttttttaccccgaaggtaaaacggtaagtttacggttaacgtttccgttacgttaccggaaccccggtccggtacggtttacggaaccgtaaccggggtttacgttttaaacgtttacccgttggtacggaccggtaagtaacgggtacggtactttaagttacgttaggtttaggtttttaggtaacggtttaggtttaacctttacggaaccctacccgttaaggtacggttaaccggggacgggggttccctacccgggtaacccccggttacgggggaacccgtaaagggtaaccgttacggttacccggtaccgtaccccgtttcttacccgtaccgtaccctaccgtaacccgaacgggtaccctacggttcccgttacccgttcccccgacggtcccctaccctacccttaccgaacgcgtaacccgg

SEQ ID NO: 138785 - DNA, 814 bp, Homo sapiens
  misc_feature: GYAE6OF01CYSF1.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgacggtccttcggacgacccctgtcccctcaccctgccgctgtcctcgtggtcaccctcatcagttagttcggttttctcggtggggtccttaggggtcccggctaggtccttacccggaaggggtaacggggtcgtagggaaactacgtaggttaggaacgttcgtacctcgtactagttaggtagggtaccgtttaccttaacgtttaacgtccggttacccgttcttaccgtaacgtaaacggtacggtaccggtacgtaacctaaccctagttaaccgtccttacggtaccgggtaaccgtacccgttaccgaaagtacccttaaacgtttcccgtttaacgtttttccccgaaaggtaacgtacgttacggttacgtttcgtacggtacggaccccggtcgtacgtacgtaaccgggttcgggtttaactttacgttacgtcggtcggacgtacggacggtaccgttattagtttacgtagttttacgtttggtacgtttacgttacttaccgaacccgttacgtagggtacgtaccggggacgggttacccgtacccggtacccgggtcgggacggtaacgggttacttaccggttcgtaccccgttacgtcccttacccggttccgccccgtaacccggg

SEQ ID NO: 138786 - DNA, 615 bp, Homo sapiens
  misc_feature: GYAE6OF01ESRLZ.46.67.G01.1.454.CMB.1.raw
  modified_base (171)..(171): a, c, t, g, unknown or other
  misc_feature (171)..(171): n is a, c, g, or t
  modified_base (334)..(334): a, c, t, g, unknown or other
  misc_feature (334)..(334): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtncctccatcagtagtggtttcttcgtggggctgggtccggcagcctccgagggagggctggaatacattggaagtgtctctcatagtggaggttcctattacagtccgtctctcaagagtcgagtcaccatatctctggacacgtccagcaatcagttttcccngaagatgagttctgtcgaccgccgctgacgtacgggtcgtttatacgtgtgacgagacgacggcttattatgttagttttgggagttggtttatttcgaacctaccgtagtacgtcggacggggcctccggaccccgtggggacccgaagggtaactacgttcggtactacccgttccgtaccgttaccgccctacccgaaccggaaccgggtccctaacggttcccggtacccgttcccccgtcggtaccctaccccgtacctaccgaacgcgtaccccg

SEQ ID NO: 138787 - DNA, 676 bp, Homo sapiens
  misc_feature: GYAE6OF01BMDG5.46.67.G01.1.454.CMB.1.raw
  modified_base (194)..(194): a, c, t, g, unknown or other
  misc_feature (194)..(194): n is a, c, g, or t
  modified_base (230)..(230): a, c, t, g, unknown or other
  misc_feature (230)..(230): n is a, c, g, or t
tcagactagcagtacacgaccggtgctcgatttagagtatacatagttgggtttgggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccggacaagtcggaacnttgactactattaatggtatcaacatagaccaggaccgaccctagctacctaatcctatcgctgccattcccgtagttttgactaaaggtcggggtacccagtccggtaggtttcgaggtcggcgtagtggacttcgtagggacctaggtactttcactctcacctatacgtagttaactcctagacctaacggtacgtaaagttacgttttgaaccttaacgtttactttaacgtgttaacctaaacgtagttaaactttaacgtaagtttcggttttaccggaaccgtaacgggaacctacgtaaaccttaactaaaacgttaaccggtaaacgttggttacggtaccgttacgaaccgtaaccgttacgttaccgttaccggttaccttacccgttacgttccccgtttaccccggtacctaaactttccgttacggttaacc

SEQ ID NO: 138788 - DNA, 695 bp, Homo sapiens
  misc_feature: GYAE6OF01D1P05.46.67.G01.1.454.CMB.1.raw
  modified_base (372)..(372): a, c, t, g, unknown or other
  misc_feature (372)..(372): n is a, c, g, or t
tcagactagcagtacacgaccggtgctcgatttagagtatacatattgggtttgtcctcctgctggtggcagctcccagatgggtcctgtcctggtgcaactgcaggagtcgggcccacgactggtgaggccttcggacgaccctgtccctcacctgcgctgtctctggtcgcctcatcagtagtggtttctcgtgggctgggtccgcagctcccgaggggacgggctggaatacagttaggaagtcgtctcgtcataggtggacggttacctattacgacgtcccgtctctacaagtagtcgagttacaccgattacgtcctacggtacggaccgaccgtccgaacgtacaaactcgtacgtttttacccnggtaacgtaagtgtaacgttctagtcgacccgtccgtcgtacgaccgtacgggtcgttttaacgttacgtgtcggacggaaggtacgacgggtatttagttagttgttacgttttaggagttcggtttattaccgaactaccgtagacgtcgggacgggtcctccggacccggttacgggaccgtaacggggtactacgtcggtacctaccggttacctccgttaacgccccgtccaacccggacggtacccctaggttcccggttaccccgttccccctgggtaccccttaccccgttccccgtaacaccgtccgtaccccg

SEQ ID NO: 138789 - DNA, 614 bp, Homo sapiens
  misc_feature: GYAE6OF01DIJ9N.46.67.G01.1.454.CMB.1.raw
  modified_base (223)..(223): a, c, t, g, unknown or other
  misc_feature (223)..(223): n is a, c, g, or t
  modified_base (262)..(262): a, c, t, g, unknown or other
  misc_feature (262)..(262): n is a, c, g, or t
tcagactagcagtacacgaccggtgctcgatttagagtatacatattgggtttggggagtctcggtcaggacacagcatggacatgagggtccccgctcagctcctggggctcctgctactctggctcggaggtgccagatgtgacatcgagctgacccagtctccatccctccctgtctgcaaccggtgggagacagtgtccaccatccacttggccggganaaggtcggaacattgacaccttatttaagttgtatcaanatagaccgagggaccgccctaagcctacctaatctatgctgctatccagtttgacgtaaaggtcgggtacccagtcgaggttcagtgacgagtggatcgtaggactagtatttcactcctacaacctatactaagtaactcgtacgacgtaacgtagtaagttagtttacgacttaactttaacttactagtactaacgtaattaacttacttaagttcggtttaaccggacgtaacggtaaccgtaacgaaccttaaataaaacgttaacgaacgttggtacgtacgacgtacctaacgtattcgtacttaccttataccttccgttacccgtactacgttcctgtaaccg

SEQ ID NO: 138790 - DNA, 748 bp, Homo sapiens
  misc_feature: GYAE6OF01CRZQE.46.67.G01.1.454.CMB.1.raw
tcagactagcagtacacgaccggtgctcgatttagagtatacatagttcgggtttggggagtctcggtcaggacacagcatggacatgagggtcccgctctagctccgtggggactcctgctacgtctcggctccgaggtgccagatgtgacatcgagctgaccagtactccatcctcctgtactggaccgtaaccggtgggacgactagtcgtaccgacactctacgttcggaccgggactaaacggtaccggaaactagtttacggaaccgtaaccttaagttttaaaacgttcggtaactacgaaaactaggtaaccgtaaccgggaaggggtcccgggtaacccgtaaggccttaacctaacgtcctagtcgccgtacgactactaccgtagtttacgacgtaacgggttcgggaccctagtacgtaggtttccaggttcggctagggtacgtactaccggtagggaactacgtactttacgacgttacgtaccgaccgtagtacctaagttaactcgtacggactaacggtacgtactttagttttacgacgttaaactttcgtaacgtacggtaaacaaacggttaacgttaacttaacgttaggttttacggtttaaccggaaccggttaaggtacctaacggtaaactttaacgaaacgtttacgtaacggtcggtacgaccgttacgacctaccgtattcgtcgttctaccgtactcccgtccgaatcgtcgtagtacc

SEQ ID NO: 138791 - DNA, 830 bp, Homo sapiens
  misc_feature: GYAE6OF01DMK0V.46.67.G01.1.454.CMB.1.raw
  modified_base (183)..(183): a, c, t, g, unknown or other
  misc_feature (183)..(183): n is a, c, g, or t
  modified_base (227)..(227): a, c, t, g, unknown or other
  misc_feature (227)..(227): n is a, c, g, or t
  modified_base (818)..(818): a, c, t, g, unknown or other
  misc_feature (818)..(818): n is a, c, g, or t
tcagactagcagtacacgaccggtgctcgatttagagtatacatattgggtttgtcctcctgctggtggcagctcccagatgggtcctgtccctggtgcaactgcgaggacgtccgggcccagactgggtgaggtccttcggacgacccctcgtccctcaccgtgccgtctgtctcgtggtcncctcatcgagttgttcggtttctcggtgggcgttcgggtcccgnacgtccgtaccggaggggtacgggctaggaatacgtagttaggaacgtgtcctcgtataaggttaggtggtacggtttccctaagttacgtacgttccgttctaccgtacaacgtacggtaccgtacgtaccctaaccgtacttacgttccgttccgtagggaacccctaccggtaccctaaggaaacccttatttacccgttaccgtttttaccccgaggtaaagttacggttcggttaaacgtttccgggttacgtccggaccccggtcccgtcgtacggtaacccggttaccggggtttactttttaaacgttcggtcggttacgggacggtaacggtaaccgtacggttactttaagtttacgttagttttacggtttggttaggtttacgttttacgttaacccgtaccgttaccgtacggtaacgtccggggaacggtcccgttacccgggtcccggaacgggtactaggggtaaccttcggtaccggtcctacccgttcgtcccgttcgaccccgttaccgaaccggtccgcccgtaccgtcccgttccccgttcccgaccgtccctacccgtaccctaccggngtccgtacccgg

SEQ ID NO: 138792 - DNA, 674 bp, Homo sapiens
  misc_feature: GYAE6OF01AHT5X.46.67.G01.1.454.CMB.1.raw
  modified_base (190)..(190): a, c, t, g, unknown or other
  misc_feature (190)..(190): n is a, c, g, or t
  modified_base (216)..(216): a, c, t, g, unknown or other
  misc_feature (216)..(216): n is a, c, g, or t
  modified_base (226)..(226): a, c, t, g, unknown or other
  misc_feature (226)..(226): n is a, c, g, or t
  modified_base (251)..(251): a, c, t, g, unknown or other
  misc_feature (251)..(251): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaaccgtgganacagtgtcaccatcacttgccggganaagtcgaacnttgactacctatttaatggtatcanatagaccagggaccgccctaagctactaatctatgctgcactccagtttagcgtaaacggttcgggtacctagtcgtaacggttcgagtggcgtagtggtatcggttagggaacctaggtactttaccacgttacctaccacgtatacgtaagttaactcgtacgtaccgtaaaggtcgtaaacgtaagttttcgtaaccttaaacttttacgttaacgttacgtactaaacctaaggttaacgttaaataccgttttacggtttaccgaacgtaacggggaacctaaccggtaaacttaaaccttaaaaggttaaaccgtaacgttacggttggtaccgttacggaaccgtaccctaacgttacgttccggttacttaccttacgttaccccttacccggaccttacttaccgtagttaacg

SEQ ID NO: 138793 - DNA, 628 bp, Homo sapiens
  misc_feature: GYAE6OF01D1CSS.46.67.G01.1.454.CMB.1.raw
  modified_base (257)..(257): a, c, t, g, unknown or other
  misc_feature (257)..(257): n is a, c, g, or t
  modified_base (403)..(403): a, c, t, g, unknown or other
  misc_feature (403)..(403): n is a, c, g, or t
  modified_base (473)..(473): a, c, t, g, unknown or other
  misc_feature (473)..(473): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggacgaccctgtccctcacctgcgctgtctctggtcgcctccatcagttagtggttttcttcgtggggctcggggtccgcngccgtccgaggggaaggggctaggaatacgagttggaagttgtctctcagttaggtggtacggtttccttaattaccgagtcccgtctctacaagagtcgagtccacatctctctcgacacgtccaagctaatctacgttttcccngaagatgtagttctggtcgaccgcgcgtacgacgacgggtcgtttaattcgtgtagcgagtacggacgtnttattagttgttaagtttttggagtttggtttagtttacgaccgttacctaggtcgtaccggtaccgggggtcctaccggtccccggtggggaccgtagggtaaccgttcgtcggtacccgtacgttcccgttacccgttcgccccgtaacccgg

SEQ ID NO: 138794 - DNA, 709 bp, Homo sapiens
  misc_feature: GYAE6OF01C2Y0M.46.67.G01.1.454.CMB.1.raw
  modified_base (198)..(198): a, c, t, g, unknown or other
  misc_feature (198)..(198): n is a, c, g, or t
  modified_base (217)..(217): a, c, t, g, unknown or other
  misc_feature (217)..(217): n is a, c, g, or t
  modified_base (228)..(228): a, c, t, g, unknown or other
  misc_feature (228)..(228): n is a, c, g, or t
tcagactagcagtacacgaccggtgctcgatttagagtatacatattgggtttggggagtctcggtcaggacacagcatgggacatgagggtccccgctcagctcctggggctcctgctactctggctccgaggtgccagatgtgacatcgagctgacccagtctccatcctcctgtctgcaaccgtgggatacagtntcaccatcacttgccgggnaagtcggaacnttgaccaccttatttaaatggtactacaactatacgaccagggaccgaccctaagctacctaatctatgctgcatccgtagtttgacgtaacgggtcgggtaccctagtacggaggtttcgacggtggcgtaggtggtactcggtagggactagtactttccacttcctacgaacctagtactaagtaacttctacgtaccgtaacggttagtaaagtttattttacgaaccttaaactttacttaacgttacgtaaccaaacgtaagttaaacttaacgttaaacgttttcgggtttaacccgggaaccgtaaacggggtaaccctaaacggtaaaccttaaaaccgtaaaacgtttaaaaccggtacgttaacgggttcgtacccgttaggaccctaaaccgttacttaccgtttacgttaccctttaccctaaccgtttcccccgttacccccgacttaaccgttcttaacggtaacc

SEQ ID NO: 138795 - DNA, 706 bp, Homo sapiens
  misc_feature: GYAE6OF01BUGF7.46.67.G01.1.454.CMB.1.raw
  modified_base (533)..(533): a, c, t, g, unknown or other
  misc_feature (533)..(533): n is a, c, g, or t
tcagactagcagtacacgaccggtgctcgattttagagtatacatattgggtttgggggacctcctgtgcaagaacatagaagcacctgtggtttgtcctcctgctggtggcagctcccagatgggtcctgtccctggtgcaactgcaggagtcgggcccgacgactggtgaggccttcggagaccctgtccctcgaccttggcgtcgtggtctctggtcgccctccatcagtagtggtttcttcgtcggggctgggtccgcacgcctcccgagggaacgggctggaatacgagttaggaagtcgtctcgtcagtagtggtacggttcctattacgacgtccgtctctacgaagacgtcgagtccaacctattactctcgtacgggaccaccgacccagtacaattccttaacgttttccctagaagacgttaggtacgtttcgtacggttccgacccgccgtacgtacggaccgtacgggttcgttttaactacgtgtgacgagacgcggtattagttgtgttagttttggngtttaggttttacttaccgacctaccgtaggtgtacccggggtacggggtccgttacccgggaaccccggggttcggggaaccggttaacggggtaaacttccgggtttaccgggttacccgttaccccggtttacgtttcccccgtttaacggtcccccgttaaacccccgg

SEQ ID NO: 138796 - DNA, 572 bp, Homo sapiens
  misc_feature: GYAE6OF01DUB8W.46.67.G01.1.454.CMB.1.raw
  modified_base (225)..(225): a, c, t, g, unknown or other
  misc_feature (225)..(225): n is a, c, g, or t
  modified_base (246)..(246): a, c, t, g, unknown or other
  misc_feature (246)..(246): n is a, c, g, or t
  modified_base (351)..(351): a, c, t, g, unknown or other
  misc_feature (351)..(351): n is a, c, g, or t
  modified_base (364)..(364): a, c, t, g, unknown or other
  misc_feature (364)..(364): n is a, c, g, or t
  modified_base (379)..(379): a, c, t, g, unknown or other
  misc_feature (379)..(379): n is a, c, g, or t
tcagactagcagtacacgaccggtgctcgatttagagtatacatattgggtttggggagtctcggtcaggacacagcatggacatgagggtccccgctcagcctcctggggctccctgctactctggctccgaggtgccagatgtgacatcgagctgacccagtctccatcctccctgtctgcaaccgtggagacagtgtcacatcgacttgccggcagtcgacntgacactattaatgtatcaanatagaccaggaccgaccctaagcctactaatctatcgtcgtgctactccgtagtttcgagtaaggtcgggtccagtcgaggttcagtggcagtggtatgtcgganagtattacgctcncacatacagtatcgngtactagagtaattatttacgaacttacttacttatcgtacaactaagtaattactaagtttcgtttaacggaccgtaacggtactaaccgtaataaaccgtaaattaaccgaagttcggtagtaccgtcgtaccgtaacgtacgtcgttgttaccttacgtactttccccgtacccgactactcgtgtaacg

SEQ ID NO: 138797 - DNA, 787 bp, Homo sapiens
  misc_feature: GYAE6OF01CCIJ2.46.67.G01.1.454.CMB.1.raw
  modified_base (175)..(175): a, c, t, g, unknown or other
  misc_feature (175)..(175): n is a, c, g, or t
  modified_base (212)..(212): a, c, t, g, unknown or other
  misc_feature (212)..(212): n is a, c, g, or t
tcagactagcagtacacgaccggtgctcgatttagagtatacatattgggtttgtcctcctgctggtggcagctcccagatgggtcctgtccctggtgcaactgcaggagtccgggcccacgactgggtgaggccttcgggagaccctgtccctcacctgcgctgtctctggtcncctcatcagtagttggtttctcgtgggctgggtccgnagcctccgaggggagggctaggaatacagttggaagttcgtcctctacagtaggtggtacggtttcctaagttacacgttcccgtcctctactaagagtcgagtccacctatacttctcgtaggacctaccgtccagtactaatcttacgttttcccagtaatagtgtagtttctagtccgacccgccgcgtacgaacggtacgggttacgttttaacgttaccgtggttcggacgaggtaacgggtaccggtacttaacgtttaagtaggttttagttttgggtaacggttttggttttaacgtttaccggtaaacctaccccgttaagtaccgggttacccggggtaaccgggggtcccgttacccggtacccccgggtagggggtaacccggaaggggttaaccgttaccgttacgggttacccgtacccgttcccgttacccgttaccgcccccgttaacccgaacccggtacccgggtacccctaaccggtttcccggttcccccgttacccccccgtggtaccccccttacccccgttacccgtaaccccgaacggtcccgtaccccgg

SEQ ID NO: 138798 - DNA, 724 bp, Homo sapiens
  misc_feature: GYAE6OF01AP4BI.46.67.G01.1.454.CMB.1.raw
  modified_base (214)..(214): a, c, t, g, unknown or other
  misc_feature (214)..(214): n is a, c, g, or t
tcagactagcagtacacgaccggtgctcgatttagagtatacatattgggtttgggggacctcctgtgcaagaacatgaagcacctgtggtttgtcctctccgctggtggcagctcccagatgggtcctgtccctggtgcaactgcaggagtcgggcccacgactggtgaggcctttcggagaccctgtccctcacctgcgctgtctctggtcncctccatcagtagttgtttctcgtggggctgggtccgcagcctcccgaggggacggggctaggaatacgtagttgggaagtcgtcttctacgatagggtgggtaacggtttcctaattaccgtacggttcccgttctaccttacgaaagtcggtacgacgtaccaacctattactcttcgtaggaccctacggtccaagactaactcttacgtttccctagaacgtagtcgtaacgtttcgtaggaccgtacccggtccgtacgttacggaaccgtacggggttcctttttaagtaccgtgggtacgtacggacgtaggtacccggtctttaagttagttagtttacggttttggtaaggttttacggtttacttaccggaacctaccgtaaggtaccgggttccgggaaccggggttcctaacccgggtcccgggtagggggacccgtaaagggcctttaaccggtcggttacccgttacgtcttacccggttacgcccctaacccggg

SEQ ID NO: 138799 - DNA, 539 bp, Homo sapiens
  misc_feature: GYAE6OF01DI6PY.46.67.G01.1.454.CMB.1.raw
  modified_base (512)..(512): a, c, t, g, unknown or other
  misc_feature (512)..(512): n is a, c, g, or t
  modified_base (526)..(526): a, c, t, g, unknown or other
  misc_feature (526)..(526): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtgggagacagtgtcaccatcacttgccgggcaagtcgaacattgacactatttaatgtatcaacatagaccagggacgccctaagctctaatctatgctgcatccagtttgacaaggtgggtcccagtcgaggttcagtggcagtggatcgtgggacagtatttcactctcacctatacagtaatctgacaagtagaagtatttagactaactttattactgtacaacagtaattactaattgttttacggaccgtaaagggactaacgactaactaaaacgttaacgaacgttagtggctgacctaaccgtatcgtgttccttntacttccttacccnctactcgtgtaac

SEQ ID NO: 138800 - DNA, 584 bp, Homo sapiens
  misc_feature: GYAE6OF01B6Q5Z.46.67.G01.1.454.CMB.1.raw
  modified_base (211)..(211): a, c, t, g, unknown or other
  misc_feature (211)..(211): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtncctccatcagtgtgtttctcgtggggctgggtccgcagcctccgagggagggctggaatacattggaagtgtctctcagtagtggaggtttcctattacagtccgtctctcaagagtcgagtcaccatatctctggacacgtccagcaatctagttttcccagaagatgtagttctgtcgaccgccgctggacgacgggtcgtttacttacgtgtgcgagagacgtctattagtgttagttttgggagtttggtttaactttcgacctaccgtagacgttccgggacggggtaccgtcccggtaccccggtggggacccgtaggggtaacttcggtacggtcccacccgttccttcccttacgcccctacccg

SEQ ID NO: 138801 - DNA, 569 bp, Homo sapiens
  misc_feature: GYAE6OF01ARZIO.46.67.G01.1.454.CMB.1.raw
  modified_base (217)..(217): a, c, t, g, unknown or other
  misc_feature (217)..(217): n is a, c, g, or t
  modified_base (417)..(417): a, c, t, g, unknown or other
  misc_feature (417)..(417): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggnaagtcggaacattgacacctatttaaattggtatcaacatagaccagggaccggccctaagctcctaatctatgctgcatcctagtttgacaaaggtgggtcccagtcgagttcagtgcagtgatcgtagggacagtatttcactctcacctatcagtaatctgacaagtgaagtatttgctaacttattactgtacaanagtaattacaagtttcgtttaccggacgtaacgggacctaacgtaacttaactaaaagtttaaccaacgttacgtaggtaccttacggaccaaccctattaccttcgttcccttataccttaccctttcccgacccacgttcttcggttaac

SEQ ID NO: 138802 - DNA, 604 bp, Homo sapiens
  misc_feature: GYAE6OF01DSW3L.46.67.G01.1.454.CMB.1.raw
  modified_base (414)..(414): a, c, t, g, unknown or other
  misc_feature (414)..(414): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttggccgggcaagtcggaacattgacacctatttaaatggtatcaacatagaccagggaccgccctaagctcctaatctatgctgcatcctagtttgacaaaggttcgggtaccagtcggtaggttcagttggactaggtggtactcgtagggtacagtactttcactctcacctatacctagtatcgtgacaacgtagaaagttntttacgactaacttattactagtactaactagtaacttactaagttcgtttacggaaccgtaacgggacctaacggtaaccttaaactaaagttaaacctaacgtaggtagtacctagaccgtaacctagttaccttagttacctttacgtaccttacccgttaccccgaccttacgttcctacgtaacg

SEQ ID NO: 138803 - DNA, 663 bp, Homo sapiens
  misc_feature: GYAE6OF01C5FGD.46.67.G01.1.454.CMB.1.raw
  modified_base (199)..(199): a, c, t, g, unknown or other
  misc_feature (199)..(199): n is a, c, g, or t
tcagactagcagtacacgaccggtgctcgatttagagtatacatattgggtttgggggagtctcggtcaggacacagcatggacatgagggtccccgctcagctcctggggctcctgctactctggctccgaggtgccagatgtgacatcgagctgacccagtctccatccctcctgtctgcaaccgtgggagacagtntccacatcacgttgccgggacaaggtcggaactattacgacaaccttaattttaaattggtaactcaaactagtaacggaaccgaacggggaccggacccctaaagcctacctaatctatcgctgcatccagtttcgactaaggtcgggtaccagtcgtaggtcaggtggtcaggtgatcgtgggactagtatttcactcacacctaatctaagtaactcgtagtactaacggtagtaaagttgttttaacgacctttaaagtttaacttacttaacgtaccaaacgtaattaaacgttaccttaaaggtttcgttttaacccgggaacgtaaacggtaccgtaaccgttaactaaactaaaacgttaacgaacttacgggtcgtaccgtacggacctaactacgtttccgttcgttaccgttactaccgttcccttaccccgtacttacttcccgtagtaacg

SEQ ID NO: 138804 - DNA, 669 bp, Homo sapiens
  misc_feature: GYAE6OF01BE494.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggcccttcgggacgaccctgtcccctcacctgcgctgtctcgtggtgcctccatcagtgttgtttctgtgggctgggtccggcagcctccgaggggacgggctaggaatacagttaggaagtgtcctctactagtaggtggtacggttcctaacttacacgttccgttctctacaagtcgtcgagtccaccatactctcgtacggacaccgtccagacctaattcctacgttttcccagtaacgagttacgtagtttcgtcggtacgtacccgccgtctacgaccgtacgggttacttttaatacgtggtcgcggagagtacggtacttagttattagttagttttaggaggtttcggtttacgtttacgtaaccgtaccgttacggtacgtcgggtaccgggtcctcggacccggtcgggacgagggtaactcggtcgtacctccgttcctcttaccgcctacccgacggaccggtccacggtcccgttccccttccccgtacgacccttccctacccgtaccgaagtcccgtacccgg

SEQ ID NO: 138805 - DNA, 611 bp, Homo sapiens
  misc_feature: GYAE6OF01CJJEO.46.67.G01.1.454.CMB.1.raw
  modified_base (194)..(194): a, c, t, g, unknown or other
  misc_feature (194)..(194): n is a, c, g, or t
  modified_base (232)..(232): a, c, t, g, unknown or other
  misc_feature (232)..(232): n is a, c, g, or t
tcagactagcagtacacgaccggtgctcgatttagagtatacatattgggtttggggagtctcggtcaggacacagaatggacatgagggtccccgctcagctcctggggctcctgctactctggctccgaggtgccagatgtgacatcgagctgacccagtctccatccctccctgtctgcaaccggtggganacagtgtccaccatcacttggccgggcaagtcggaacnttgacacctatttaaattgatcaacatagaccagggaccgaccctaagctacctaatctatgctgcatccgagtttgcgtaaaggtcgggtacccagtcgtaggttcagtgctagtcgatcgtaggactagtacttcactctacacctatacgagttaactcgtgacgtaacgtagtaagtacttttaggacttaaactttactacgtcgtacaaacgtataacttaactaatttcggttttacggaccgtaaagggacctaaacgtacttaaacgaaaacgtttaaacgacgtacgtaggtaccttacggacctaacacgtttacctcgtttacttacctacttcccgttacccgtactacgttccttagacttaccg

SEQ ID NO: 138806 - DNA, 667 bp, Homo sapiens
  misc_feature: GYAE6OF01DX236.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagacccctgtccctcacctgcgctgtctcgtggtcgcctcatcagtagtgttctcgtgggctgggtccgcagcctccgaggggagggctaggaatacagttggaagtgtctctcagtagtggaggttcctattacagtccgtctctacgaagagtcgagtccaaccatactctcgtcgacacgtccagactaatctacgttttccagaagatagtagttcgtgtacgaccgccgctacggaacgtacgggttacttttaagttacgtggtacgacggagaacggtacggtacgttaagttagttagtttagtttttaggtaggtttaggtttacgtttaccgtaacccgtacccgtaaggtacgtaccggtacgggggggtacctcccggaacccggtcgggaccgacgggtaacgtacgtcgtacgtaccgtccttccgtacgtccctacccgtaccgaccggtacccacgttccgtcccgttccccgtccgtacccgtacccctaccctacccgtaacgcgtacccg

SEQ ID NO: 138807 - DNA, 716 bp, Homo sapiens
  misc_feature: GYAE6OF01C7RZA.46.67.G01.1.454.CMB.1.raw
  modified_base (191)..(191): a, c, t, g, unknown or other
  misc_feature (191)..(191): n is a, c, g, or t
  modified_base (219)..(219): a, c, t, g, unknown or other
  misc_feature (219)..(219): n is a, c, g, or t
  modified_base (363)..(363): a, c, t, g, unknown or other
  misc_feature (363)..(363): n is a, c, g, or t
tcagactagcagtacacgaccggtgctcgatttagagtatacatattgggtttggggagtctcggtcaggacacagcatggacatgagggtccccgctcagctcctggggctcctgctactctggctcgagtgccagatgtgacatcgagctgacccagtctccatccctcctgtctgcaaccggtggganacagtgtccaccatcacgttggccgganaaggtcgaactattacgacctacttaattttaaagtggtatacaactagtaacgaccgacgggaccgccctaagctacctatctagtgctgctatccgtagtttcgacgtaaggtcgggtacctagtcgtacggttcaggtcgngtaggtggtagtcgtaggggtaactaggtactttccgaccttactaccaacctataaccgtaagttaacttccgtacggtaaccgtaacggttaaggtaagttttactttacgtaaacctttaactttacttaacgttacctaacgaaacgtaagtttaaacttaacgttaagttttaccggtttaccgggaacccgtaaagggtaaccgtaacgtaaaccttaaacttaaaaccgttaacgtaaaccgttggttaaacgccgttactacccgtaaaccgttaccgtttactcggtttaacccttacgtacctttacccccttaccggacctttaacgtccgttaagtaaccg

SEQ ID NO: 138808 - DNA, 639 bp, Homo sapiens
  misc_feature: GYAE6OF01AQE90.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggcctttcggagaccctgtccctcacctgcgctgtctctggtgcctccatcagtagtggtttcttcgtggggctgggtccggcagctcccgaggggaagggctggaatacattggaagtgtctctcatagtggagttcctattacagtccgtctctacaagcgtcgagtcaccatatctcgtggacacgtccagcaatctacgttttccagaagatgtagtttctgtcgacccgccgtctacgtaccgacgggtcttttaagtacgtgtcgcgtagtacggacggtcttaagttattaggttacgtttttgggagtttggtttactttaccgacctacccgtagtacgtcgggaccggggtcctaccggacccccggtaggggaccgtaaggggtaactacgtcgggtacctaccggttcctccgttacgccctacccgaccgtaccgggccctacgtccgttcccttcccccgtagtcccctacccctccctaccgaacgtcgtacccg

SEQ ID NO: 138809 - DNA, 646 bp, Homo sapiens
  misc_feature: GYAE6OF01BEFXM.46.67.G01.1.454.CMB.1.raw
  modified_base (227)..(227): a, c, t, g, unknown or other
  misc_feature (227)..(227): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaacggtgggagacagtgtcaccatcacttgccgggcaagtcgaacnttgactactattaaatgtatcaacatagaccagggaccgccctaagctactatctatgctgcatcctagtttgacgtaaagtcggggtacccagtcgtaggttcaggtcggacgaggtaggatcggtaggactaggtactttccacttcacgtaccattacaagttaactctacgacgtaacgtagtaacgtagttttagaccgttaaactttacgtttaacttcggtaaactaaacgtaagtaaactttaacgtaaagtttcggttttaaccggtaaccgtaaacgggtaactaaaccgtaacgttaaactaaaacgttaaacgtaacgttggtacgggtacctaggtacctaacgttacttacgttcgttacctttacctacctttcccgttacccgtactactcgtacgttaaccg

SEQ ID NO: 138810 - DNA, 553 bp, Homo sapiens
  misc_feature: GYAE6OF01BGT95.46.67.G01.1.454.CMB.1.raw
  modified_base (338)..(338): a, c, t, g, unknown or other
  misc_feature (338)..(338): n is a, c, g, or t
  modified_base (395)..(395): a, c, t, g, unknown or other
  misc_feature (395)..(395): n is a, c, g, or t
  modified_base (525)..(525): a, c, t, g, unknown or other
  misc_feature (525)..(525): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggcagctcccgaggggaggggctggaatacagttggaagtgtctctcatagtggaggtttcctattacagtccgtctctcaagagtcgagtcaccatatctctggacacgtccagcaatcagttttcccngaagatgagttctgtgaccgccgctgacacgggtgtttatactgtgcgagagacggntattatgtatttttggagttggtttacttcgacaccctagatcggacggggctcgacccgtgggccgagggaatcgtggtcacgtctccttacgcctccaccgacggcccagttccggtccttcccccgnggtcccacccctccgaccagcgtacccg

SEQ ID NO: 138811 - DNA, 726 bp, Homo sapiens
  misc_feature: GYAE6OF01BT7PI.46.67.G01.1.454.CMB.1.raw
  modified_base (286)..(286): a, c, t, g, unknown or other
  misc_feature (286)..(286): n is a, c, g, or t
  modified_base (346)..(346): a, c, t, g, unknown or other
  misc_feature (346)..(346): n is a, c, g, or t
tcagactagcagtacacgaccggtgctcgatttagagtatacatattgggtttgtcctcctgctggtgacagctcccagatgggtcctgtccctggtgcaactgcaggagtcggcccacgactggtgaggccttcggagaccctgtccctcacctgcgctgtctctggtgcctccatcagtagtggtttctcgtgggctgggtccgcagctcccgagggagggctggaatacattggaagtgtctctcatagtggtagttcctagtacagtccgtctctacgaagngtcgagtccacctatactctcgtaggactacgtccagacaatctacgttttccagaagtntgtagttctggtcgaccgccgctgaaccgtacgggtctttaatacgttgacgacgagaggtacggtacttagttagttagttagtttttggagtttaggttactttacgactacccgtagtacgttaccgggacggggtcctacccggtaccccgggtcggggtacccgtaaggggtaaacgttaccggttacgggttaccccgtaaccggttcccgttacccgtttaaaccggtcccccgttaaccccggtaaccccggtaaccgggttaccccccgtaacggtttccccgggtttacccccctttcccccccgggtcggtaacccccgtaccccccgttacccgttaaccccgaaaccgggtacccggtaacccccgg

SEQ ID NO: 138812 - DNA, 712 bp, Homo sapiens
  misc_feature: GYAE6OF01BAJ3F.46.67.G01.1.454.CMB.1.raw
  modified_base (213)..(213): a, c, t, g, unknown or other
  misc_feature (213)..(213): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggacgaccctgtccctcacctgcgctgtctctggtcncctcatcagtagtgtttctcgtggggctgggtccgcacgctccgaggggagggctaggaatactagttaggaagtcgtctcgtcagttagtcgggtacgtttccttaagttaccgacggttccgtcttctacgaaagtacgtccgtagtccaaccgtattactcttcgtacggaacctaccgtcagacctaactccgttacgtttcccaggtaagtacgtggtacgttcgtgtaccgaccgcgtactcgaaccggtacggttctttaacgtacgtgtacgacgtaggacgtacggtcttaagttagtagtttagttttacgggagttttacgtttaacgttaccgacctaccgtaggtaccggtaccggggtaccggggttcccgtacccgggtccccgggttagggggtacccggtaaacgggttaacgtttaccgggtccgggtttacccgtacccgtttacccgttaaccgttcccgtaaccccgtaacccccggg

SEQ ID NO: 138813 - DNA, 657 bp, Homo sapiens
  misc_feature: GYAE6OF01DRI7F.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggagacagtgtcaccatcacttgccgggcaagtcgaacatgactactattaatgtatcaacatagaccagggacgccctaagctactaatctatcgctgctatccgtagtttcgacgtaaaggtcgggtacccagtcgtaggttcagtggcgaggtggaatcgtgggacagtactttcgacttccgtccaacctatactaagttaactcgtacggacctaaacggttagtaaagtttacttttacggaaaccttaaacttttactttacgttacgttaacctaaacgtagttaaactttaacctaagttttcggttttaacccgggaccgtaaagggtaacccgtaacgtaaaccttaaaactaaacgttaaacggaacgtttaggtacggacctaagtaccctaactattacgttcgttaccctttacgtaaccttccctttaccccgaccttaatcccttagtaaccg

SEQ ID NO: 138814 - DNA, 754 bp, Homo sapiens
  misc_feature: GYAE6OF01CORW3.46.67.G01.1.454.CMB.1.raw
  modified_base (223)..(223): a, c, t, g, unknown or other
  misc_feature (223)..(223): n is a, c, g, or t
  modified_base (332)..(332): a, c, t, g, unknown or other
  misc_feature (332)..(332): n is a, c, g, or t
  modified_base (379)..(379): a, c, t, g, unknown or other
  misc_feature (379)..(379): n is a, c, g, or t
tcagactagcagtacacgaccggtgctcgatttagagtatacatattgggtttgggggacctcctgtgcaagaacatgaagcacctgtggttttgtcctcctgctggtggcagctcccagatgggtcctgtccctggtgcaactgcaggacgtcgggacccacgacgtgggtgaggtcccttacggacgaccctcgtccctcacctgcgctgtctcgtggtcncctcatcgtagttagttggtttcttcggtcgggggtcgttcgggtccggcgtagcccgtaccggaggggtaacgggtctaggaattacgagttaggaagtcgtctactntagtacggtaggtagtttcctattactacgtccgtactctacgaagngttcgactcaaccgtatactctacgtacgacacgtcacgtactaagtccgttacgtttccgtaggtaagtacttaggtacgttctacggtaccgacccgtccgtacgtacggtaccggttacgggtttacgtttagtaccggttgtaccggtagacggtacgtacggttacttaagtttagttacgttttaggttttagggtaggtttacggtttaacttaccgaaccgttaaccgtaggtaaccggtccggggtaacccggggcttacccccggggtacccgggtacggggtaccggtaaacggggttaccttacggggttcggtaacccgttacccgtttaccgttacccggttcccgtaccccggtaacccg

SEQ ID NO: 138815 - DNA, 627 bp, Homo sapiens
  misc_feature: GYAE6OF01ERY7J.46.67.G01.1.454.CMB.1.raw
  modified_base (215)..(215): a, c, t, g, unknown or other
  misc_feature (215)..(215): n is a, c, g, or t
  modified_base (340)..(340): a, c, t, g, unknown or other
  misc_feature (340)..(340): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtccgggcccacgactggtgaggcctttcggagaccctgtcccctcacctgcgctgtctctggtcncctccatcagtagtggtttctcgtggggctgggtccgcagcctcccgaggggaaggggctggaatacgattggaagtgtctctcattaggtggtagttcctattacacgttccgtctctcgaagngtcgagttccacatatcctctggacacgtcagcaatcttacgtttcccagaagatgtagttctcgtcgaccgccgactgaccgtacgggtacttttactacgtgtacgcgagacggacgtacttattagtgtagttttgggagtttaggtttatttacgactacccgttagcggtaccggaccggggtcctacccgggtaccccggtgggggacccctaggggtaaacttaccggttacgggtaccctacccggttacccgttccttaccggtccccgtaaccccgg

SEQ ID NO: 138816 - DNA, 910 bp, Homo sapiens
  misc_feature: GYAE6OF01DDDJV.46.67.G01.1.454.CMB.1.raw
  modified_base (173)..(173): a, c, t, g, unknown or other
  misc_feature (173)..(173): n is a, c, g, or t
tcagactagcagtacacgaccggtgctcgatttagagtatacatattgggtttgtcctcctgctggtggcagctcccagatgggtcctgtccctggtgcaactgcaggagtccgggcccacgactggtgaggccttcggagaccctgtccctcacctgcgctgtctctggtcncctcatcagtgttggtttcttcgtggggctggggtccggcagccgtcccgaggggaaggggctaggaatactagttggaagtgttctctcagtaggtggtacgtttacctattacgacggtcccgtctctacgaagcgtacgacgtacaaccgtattactcgtcgtaggaacctaccgtaccagactaacttccgttacgtttttaccccgaggtaaagtagttcggttacgtttccgtacgggtaccggtaccccggtcccgtcgttaaccggtaacccgggtacggggttttaccgtttttaacgttaccggttagggttacgaaccgggtaaggtaacggtaccgggttactttaagtttaagtttacggttttaagggttttttagggaacgggtttttaggttttaaccgttttacccggtaacccgttaaccccgtttagggtaaccggttcccgggggacccggggttcccgttacccgggtacccccgggtacgggggaccccgtaaggggttaaccttaccgggttccggttacccgttaccccgtttacccgtttaccccggtttaccgaccccccgttaacccggtaaaccccgggtaacccgggtacccccgttacccggtttcccccgggtttaccccccttacccccccggttaccgggaccccccctttaacccccgttacccccggttaaacccgaaacgggtcccccggtaaacccccgg

SEQ ID NO: 138817 - DNA, 559 bp, Homo sapiens
  misc_feature: GYAE6OF01BBRL2.46.67.G01.1.454.CMB.1.raw
  modified_base (337)..(337): a, c, t, g, unknown or other
  misc_feature (337)..(337): n is a, c, g, or t
  modified_base (387)..(387): a, c, t, g, unknown or other
  misc_feature (387)..(387): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccgcagctccaggggagggctggaatacattggaagtgtctctcatagtggaggttcctattacagtccgtctctcaagagtcgagtcaccatatctctggacacgtccagcaatcagttttccctgaacgntgagttctgtgacgtcgcgctgacacgggtctttatctgtgcgagagcgntattatgtattttggagttggttatttcgacctacctagacgtcggacggggctccggaccccgtggggccgagggtaactacgtggtaccaccgtctccttacgccctaccgaccgaacgggccccagtccggtccttacccccgtcggcccacccctcctccgagtaccg

SEQ ID NO: 138818 - DNA, 670 bp, Homo sapiens
  misc_feature: GYAE6OF01DTSVR.46.67.G01.1.454.CMB.1.raw
  modified_base (171)..(171): a, c, t, g, unknown or other
  misc_feature (171)..(171): n is a, c, g, or t
  modified_base (346)..(346): a, c, t, g, unknown or other
  misc_feature (346)..(346): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtncctccatcagtagtggtttctcgtggggctgggtccggcagctcccgaggggaaggggctggaatacagttggaagtgtctctcatagtggaggttcctattacagtccgtctctacaagagtcgagtcaccatatctctggaccacgtccagcaatcctagttttcccagaagntgtacgttctgtcgaccgccgctcgacgacgggtctttacttacgtgtcgacggagaacgacggtacttagtttagtagtttagtttttaggtaggtttaggttttatttaccgaactacccgtagtacgttccgggacgggggtcctaccggtaccccgtacgggggtaccgaaggggtaccttacggtcggtaccgtacccgttccttcccgttacgcccttacccgacccgaaccggggtcccctacggtttccccgggttccctttcccccccgcgggtacccctacccccgttcccgaccccgaaaggccgtaccccgg

SEQ ID NO: 138819 - DNA, 530 bp, Homo sapiens
  misc_feature: GYAE6OF01B4F31.46.67.G01.1.454.CMB.1.raw
  modified_base (331)..(331): a, c, t, g, unknown or other
  misc_feature (331)..(331): n is a, c, g, or t
  modified_base (445)..(445): a, c, t, g, unknown or other
  misc_feature (445)..(445): n is a, c, g, or t
  modified_base (477)..(477): a, c, t, g, unknown or other
  misc_feature (477)..(477): n is a, c, g, or t
  modified_base (505)..(505): a, c, t, g, unknown or other
  misc_feature (505)..(505): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagttagtggtttctcgtggggctggggtccggcagcctccgagggaaggggctggaatacattggaagtgtctctcatagtggaggttcctattacagtccgtctctcaagngtcgagtcaccatatctctggacacgtccagcaatcacgttttccctagaagatgtagttctgtacgaccgccgctgacgacgggtcgtttattactgtgcgagagcgctattntgtattttggagttgttattcgactacctagntcggcgggcctcgcccgtgggccaggancgtgtcaccgtctcctgcctacccg

SEQ ID NO: 138820 - DNA, 658 bp, Homo sapiens
  misc_feature: GYAE6OF01CAXQA.46.67.G01.1.454.CMB.1.raw
  modified_base (211)..(211): a, c, t, g, unknown or other
  misc_feature (211)..(211): n is a, c, g, or t
  modified_base (246)..(247): a, c, t, g, unknown or other
  misc_feature (246)..(247): n is a, c, g, or t
  modified_base (291)..(291): a, c, t, g, unknown or other
  misc_feature (291)..(291): n is a, c, g, or t
  modified_base (332)..(332): a, c, t, g, unknown or other
  misc_feature (332)..(332): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccagactggtgaggccttcggagaccctgtccctcacctgcgctgtctctggtcncctcatcagtagtgttctcgtggggctgggtccgnngcctccgaggggagggctaggaatacgagttggaagtgtctctnagtagtggtacgttcctattcgacgtccgtctctacgaagngtcgagtacacctatatctctacgactacgtcagctaatctacgtttccagagtctagtacgttctgtcgacccggtccgtcgtacgaacgtacgggttacgtttacgttacgtggttcggacgtacggacggtaacggtacttaagtttagttggtttaacgtttttagggaaggttttaggtttaacgttttacggaaccctaccgttaacgggtagtaccggggtaccggggtccgtacccgggtaccccggtaggggaccccgaagggtaacccgtacgtcggtaccctacccggttacctcccgttacgcccgtaaccccg

SEQ ID NO: 138821 - DNA, 779 bp, Homo sapiens
  misc_feature: GYAE6OF01CF54R.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctcgacccagtcctccactccctccctgtctcgacgaaccggtgggacgacagtcgtaccacctatccacgttcggacccgggacaacggtaccggaaactacttacgaacctaacctttaaagttttaaacgttggttaactaccgaaactagtaacggaaccgaaggggacccggaccctaagccttacctaatctagtcactgctactaccgtagttacgacgtaagggtccgggtaccagtcggagttcgaggtcggactaggtacggtatcggtagggaactaggttactttaccgacttccacgtaacctagtaactaagtaactccggtagtaaccgtaacgttaggtaactttacgtttaaccgaacctttaatttaacttaaccggttacgtaaacctaaacgttaacgtttaaacgttaacttaacggtttaccggtttaaacccgggaaccgtaaaaccgggtaaccgtaaaccctaaacgttaaaactaaaaccgttaaacggtaccgttaacggttacgaccgttacacccgttaaccttacgtttacccgttacgttacccttaaccgttaccttacccccgttacccaaccttacttaccggttaatacccg

SEQ ID NO: 138822 - DNA, 651 bp, Homo sapiens
  misc_feature: GYAE6OF01BLDPQ.46.67.G01.1.454.CMB.1.raw
  modified_base (196)..(196): a, c, t, g, unknown or other
  misc_feature (196)..(196): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtcctccatcctccctgtctgaccaaccggtggganacagtgtcaccatcacgttcggccgggacaaaggtcggaaactagttacgaactaacctttaattttaaaagttggtaactacaaacagttacgaaccgaacggggaccggaccctaagccttacctaaagttcctaatcgactgacacttcctaggtttagacgtaaacggtgggtacccagtcgtaggttcagtggactaggtgatcgtgggactagtacttcactctacaactatacgtaataatctagacaacgtagtaatacgtttagacttaactttattactatacaaacgtaagtaattaactaagtttcgtttaccgaaccgaacggtaactaaccgtaacttaaactaaaagttaaaccgtaagttcgtacggtactacgtacctaccttataccttcgttacttacctacttacccgttaccccacttacttcgtagttaaccg

SEQ ID NO: 138823 - DNA, 600 bp, Homo sapiens
  misc_feature: GYAE6OF01CLFZ6.46.67.G01.1.454.CMB.1.raw
  modified_base (149)..(149): a, c, t, g, unknown or other
  misc_feature (149)..(149): n is a, c, g, or t
  modified_base (189)..(189): a, c, t, g, unknown or other
  misc_feature (189)..(189): n is a, c, g, or t
  modified_base (204)..(204): a, c, t, g, unknown or other
  misc_feature (204)..(204): n is a, c, g, or t
  modified_base (209)..(209): a, c, t, g, unknown or other
  misc_feature (209)..(209): n is a, c, g, or t
  modified_base (232)..(232): a, c, t, g, unknown or other
  misc_feature (232)..(232): n is a, c, g, or t
  modified_base (249)..(250): a, c, t, g, unknown or other
  misc_feature (249)..(250): n is a, c, g, or t
  modified_base (451)..(451): a, c, t, g, unknown or other
  misc_feature (451)..(451): n is a, c, g, or t
  modified_base (468)..(468): a, c, t, g, unknown or other
  misc_feature (468)..(468): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggngtcgggcccagactggtgaggccttggagccctgtccctnacctgcgtctgtctntggtncctcatcagttagtggtttctgnggggctggggtccgacnnccgtaccgaggggaggggtctggaatactagttggaagtgtctctcagtagtggtaatgttctatacgtagttccgtctctacaagtcgttcgagtacacatagtctcgtaggacacgtacagacaatctagtttcccagtaagtatgtagttctggtagaccgcgtatcgaacgtcgggtatttattactggcgagtagnggaacgtcgttattagngtttaagtttggtagttgttacttcgacctaccgtagtacgttaccgggacgggtctccgggtaccccggtggggtaccgaacgggtaacttaacgtcgggtactacccgtttactcgttaccggtaccccg

SEQ ID NO: 138824 - DNA, 631 bp, Homo sapiens
  misc_feature: GYAE6OF01ELF53.46.67.G01.1.454.CMB.1.raw
  modified_base (195)..(195): a, c, t, g, unknown or other
  misc_feature (195)..(195): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtcctccatcctccctgtctgacaaccggtggganacagtgtcaccatcacttcggccggacaagtcggaactattgactacttaatttaaagtggtatacaacagtaacgaccgaaggggaccgtaccctaagcctacctaatctaagtgtcctgactacttccgtaagtttcgacgtaaagggtcgggtaccagtcggtaggttcaggtggacaggtggatcggagggactaagtcttcacctctacactactcgtaagttactcgtagacgtagtagtaagttactttacgacttaactttatacctagtacaagtaagttaacttactagtttcggttacgacgtaaggacctaacgtaactaaccttaaagtaaaccgtgtacggtacgtctacgtaacctacctagttaccttggttaccctttacgtacccttccgttccctaacgttacttcctacgttaccg

SEQ ID NO: 138825 - DNA, 599 bp, Homo sapiens
  misc_feature: GYAE6OF01EWCHO.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacaccttatttaaattggtatcaacatagaccagggacgccctaagctcctaatctatgctgcatcctagtttgactaaaggtcggggtcccagtcggtaggttcaggtggcaggtggatcgtgggacagtatttcactctacacatcagtaatctgactaacgtagaagtatttacgactaactttattacgtagtactaaacgtataactttaactaagtttcgtttaccgggaccgtaagggtacctaacgtaaccttaaactaaaacgttaaacgtaacgtggtacggtacgtacgtaccgtaacctattccgttcgttacctttacactttcccgttaccccgacctacttccgttagtaacc

SEQ ID NO: 138826 - DNA, 574 bp, Homo sapiens
  misc_feature: GYAE6OF01BH0CM.46.67.G01.1.454.CMB.1.raw
  modified_base (332)..(332): a, c, t, g, unknown or other
  misc_feature (332)..(332): n is a, c, g, or t
  modified_base (339)..(339): a, c, t, g, unknown or other
  misc_feature (339)..(339): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctcgtgggctgggtccgcagctccgagggagggctggaatacagttggaagtgtctctcagtagtggaggttcctattacagtccgtctctcaagagtcgagtcaccatatctctggacacgtcagcaatctagttttcccngaacgtntacgagttctgtcgaccgccgctggacctacgggtctttatacgtgtcgcgagagcgtctattatgtagttttggagttggttattcgactaccgtagtacgtcggacggggtctccggacccgtagggccgagggtactacgttcggtaccaccgttctccgttacgccctaccaccgacggtcccacgttccggtcccttccccgcgtacccaccctcctaccagcgtacccg

SEQ ID NO: 138827 - DNA, 646 bp, Homo sapiens
  misc_feature: GYAE6OF01BBWNB.46.67.G01.1.454.CMB.1.raw
  modified_base (171)..(171): a, c, t, g, unknown or other
  misc_feature (171)..(171): n is a, c, g, or t
  modified_base (208)..(208): a, c, t, g, unknown or other
  misc_feature (208)..(208): n is a, c, g, or t
  modified_base (252)..(252): a, c, t, g, unknown or other
  misc_feature (252)..(252): n is a, c, g, or t
  modified_base (282)..(282): a, c, t, g, unknown or other
  misc_feature (282)..(282): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtncctccatcagtagtggtttctcgtgggctgggtccgnagctccgagggaaggggctaggaatacagttggaagtgtctctnatagtggagttcctattacagtccgtctcncaagagtcgagtcaccatatctctggactacgtccagcaactctacgttttcccagaacgtatacgtattcgtgtcgaccgcgtcgtcgacgtacgggtctttaacgttactgtacggcgaaggacgtacggtcttaatttacgttgttaacgttttgggaagtttaggttaactttccgtaacctaccgtaagtacgtcgggaaccggggtctaccggtacccggtcggggaccgaagggtaacttacggtcgtaccgaccgttcttaccgttaccgccctacccgaccgaaccggtccctacgttcccggtcccttaccccgtcggaccctacccctacccgtacccgaaagtcgtaccccg

SEQ ID NO: 138828 - DNA, 726 bp, Homo sapiens
  misc_feature: GYAE6OF01ENLH3.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtgggctgggtccggcagcctcccgaggggaaggggctaggaatacgattggaagtgtctctcagtagtggaggttcctattacagtccgtctctcaagagtcgagttcaccatactctctggacacgtccagcaatctagttttcccagaagtatgtagttcgtgtcgaccgccgtctgaccgtacgggtcgttttacgttacgtggttcgacggtaagacggacggtacgttagtttatagttagtttttagggtagtttacggtttagtttaccgtaacctacccgttaaggtacgtaccgggtaccggggttccgttacccggtaacccccggtacggggacccggtaacggggtaaacgttaccggtcgggttacccgtaccgttacccgttacccgttacgtccccgtacccgtaacccgtaaccggggtaccccaacggttcccgggttaccccctttcccccccggttaccggtccccgtacccccgttaccccgtaacccgtaaacggtcccgtaacccccgg

SEQ ID NO: 138829 - DNA, 611 bp, Homo sapiens
  misc_feature: GYAE6OF01CZ8KD.46.67.G01.1.454.CMB.1.raw
  modified_base (223)..(223): a, c, t, g, unknown or other
  misc_feature (223)..(223): n is a, c, g, or t
  modified_base (284)..(284): a, c, t, g, unknown or other
  misc_feature (284)..(284): n is a, c, g, or t
tcagactagcagtacacgaccggtgctcgatttagagtatacatattgggtttggggagtctcggtcaggacacagcatggacatgagggtccccgctcagctcctggggctcctgctactctggctccgagtgccagatgtgacatcgagctgacccagtctccatcctcctgtctgcaaccgtgggagacagtgtcaccatcacttgccggacagtcgaantgacactatttaagtgtatcaactatacgaccagggaccgaccctagctacctaatcctancgctgaccatccagtttgacgtaacggtcgggtacccaagtccgaaggttcaggtggacagtggactcgtgggaacagtactttaccgacttcgtacaaccttatccgtaagttaaactccgtagacgtaacgtagtaaagtttctttagaactaactttataccgtagttacaaacgtaagtaattacgtaatttcggtttaaccggaactaaacgggtaccaacgtaaaccttaaacttaaacgtaacgtaacgttgacggtactacgtaccaaccgtattcgtacttaccttcaacgttccccttaccgactattcctagtacc

SEQ ID NO: 138830 - DNA, 560 bp, Homo sapiens
  misc_feature: GYAE6OF01EUSBV.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccaggggaagggactggaatacattggaagtgtctctcatagtggaggttcctattacagtccgtctctcaagagtcgagtcaccatatctctggacacgtccagcaatcagttttccctgaagatgagttctgtgaccgccgctgacacgggctttattactgtgcgagagacggctatttatgatttttggagtggttatttcgacaccctagatcggacggggctcgaccccgtggggccaggggaatacgtcgggtcaccgtctccttacgccctccacccgaacgggccccatccggttccttcccccctcggcccacccctccctcccaagcgtacccg

SEQ ID NO: 138831 - DNA, 687 bp, Homo sapiens
  misc_feature: GYAE6OF01BLSBY.46.67.G01.1.454.CMB.1.raw
  modified_base (237)..(237): a, c, t, g, unknown or other
  misc_feature (237)..(237): n is a, c, g, or t
tcagactagcagtacacgaccggtgctcgatttagagtatacatattgggtttggggagtctcggtcaggacacagcatggacatggagggtccccgctcagctccgtggggctcctgctactctggctccggaggtcgccagatgtgacatcgagctcgacccagtcctccactccctccctgtctgaccgaacggtgggacacagtcgtccacctatcgtacgttcggccggganaaggtcgaactattcgactaacttaatttaaagtgtactacaactacgtacgaccggaggggacccgtaccgtaagtccttaaccttaatcttacgtcgctcgactacgtccgtagtttacgaacgtaacgggttccgggtacctaggttcggtaacgggtttcgaggttcgggacgtagggtacggtactcgggtaacgggacttacgttactttaccgacctcctaaccaactatacgtaagtactcgtagaccgtaagttacgtaagttctttacgaactttaagttactacgtagtaactaataagttaacttaacgttacgtttacggttacgaaccgtaacggactaacgtaaactaaacgtaaactacgtacgtacgtacgctacgactccgtattcgtactacgtaccttaccgtacccgtacccattctaccgtagtaccg

SEQ ID NO: 138832 - DNA, 666 bp, Homo sapiens
  misc_feature: GYAE6OF01DUQQA.46.67.G01.1.454.CMB.1.raw
  modified_base (192)..(192): a, c, t, g, unknown or other
  misc_feature (192)..(192): n is a, c, g, or t
  modified_base (219)..(219): a, c, t, g, unknown or other
  misc_feature (219)..(219): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatccctcctgtctgacaacgtggganacagtgtccacatcacgttgccggganaagtcgaactattgaacctaccttaatttaaagttggtaatacaaacatacgaccgagggaccgaccctaagctactaatctatgctgactactaccgtagtttgacgtaacggtcgggtacctagttacggaggtttacgaggtacggacgtaggtggagtcgtagggactagtacttctactctacgactatacgaagtactctacgactaacggtagtaaagttatttacgtacttaaatttactttacgtaactaacgtaaactaagttaaacgtttaactaaacgtttacggttttaaccggaaccgtaaacgggtaaccgtaaaccgtaaaccttaaactaaaacgttaaacgtaacgttaggtaccgtacgtacgaaccgtaactacgttacgttacttacgttacctaccgttcccttaccccgtatacttcgtatacg

SEQ ID NO: 138833 - DNA, 668 bp, Homo sapiens
  misc_feature: GYAE6OF01C93AJ.46.67.G01.1.454.CMB.1.raw
  modified_base (195)..(195): a, c, t, g, unknown or other
  misc_feature (195)..(195): n is a, c, g, or t
  modified_base (619)..(619): a, c, t, g, unknown or other
  misc_feature (619)..(619): n is a, c, g, or t
  modified_base (656)..(656): a, c, t, g, unknown or other
  misc_feature (656)..(656): n is a, c, g, or t
  modified_base (662)..(662): a, c, t, g, unknown or other
  misc_feature (662)..(662): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccactccctcctgtctgacgaaccgtggganacagtcgtacaccatccacgttcggccgggacaaggtcggaactagttcgaacctaacctttaagttttaaacgttggttaatacgaaactagtaacggaacccgacggggacccggaccccttaaaggtcccttacctaaatccttaatcggtctggacctacttccgttagtttacgacgtaaacgggttcgggtaccctaggtcggtacggttcgaggtcggctaggtaggtactcggtacgggactaggtacttccactctacactatacgtagtactcgtagactacgtaatagttattacgacttaactttacttatacgtactaacgtaagttacttaacagtttcggttaacgacgtaacggtactaacgtaacctaaacgtaaagtaacgtagtcgtacgtactacgtacacttntacgttcgtaccttcgtaaccttcccgtaccctactnttcgtntaaccg

SEQ ID NO: 138834 - DNA, 760 bp, Homo sapiens
  misc_feature: GYAE6OF01BQFPG.46.67.G01.1.454.CMB.1.raw
  modified_base (192)..(192): a, c, t, g, unknown or other
  misc_feature (192)..(192): n is a, c, g, or t
  modified_base (213)..(213): a, c, t, g, unknown or other
  misc_feature (213)..(213): n is a, c, g, or t
  modified_base (235)..(235): a, c, t, g, unknown or other
  misc_feature (235)..(235): n is a, c, g, or t
tcagactagcagtacacgaccggtgctcgatttagagtatacatattgggtttgggggacctcctgtgcaagaacatgaagcacctgtggtttgtcctcctgctggtggcagctccagatgggtcctgtccctggtgcaactgcaggagtcgggcccacgactggtgaggtccttcggacgaccctgtcccncacctgcgctgtctctggtcncctcatcagtgttgttcttcgnggggctgggtccgcagcctccgagggacgggctaggaatacagttggaagttgtctctcagtaggtggtagttcctattacacgtcctctctacgaagcgtcgagtccaactattactcgtacgtcggaacctaccgtacctaaggactaaactttccgttaaccgttttacccgtaaggtaaacgtagttacggtaacgtttcgtacggttaccggaccccgtccggtacgttacggaacccggtacgggtttaccttttaagtaccgtaggtcgaccgggtaaggtacgggaaccggttatttaacgtttaggtttaggttttaaggtttttgggtacggttttacggttttaactttaccggtaaccctaaccgttaacggtacggttacccggggaccggggttccctaccccgggaacccccgggttagggggacccgttaaacggggaacttacccgggtaccggttacccgtaaccccggttcccgtttcccgttaacccggtcccgttaaaccccgg

SEQ ID NO: 138835 - DNA, 556 bp, Homo sapiens
  misc_feature: GYAE6OF01A4MLU.46.67.G01.1.454.CMB.1.raw
  modified_base (394)..(394): a, c, t, g, unknown or other
  misc_feature (394)..(394): n is a, c, g, or t
  modified_base (431)..(431): a, c, t, g, unknown or other
  misc_feature (431)..(431): n is a, c, g, or t
  modified_base (528)..(528): a, c, t, g, unknown or other
  misc_feature (528)..(528): n is a, c, g, or t
  modified_base (540)..(540): a, c, t, g, unknown or other
  misc_feature (540)..(540): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctcgtggggctgggtccgcagctccgagggaagggctggaatacattggaagtgtctctcatagtggtaggttcctattacagtccgtctctcaagagtcgagtcaccatatctctgacacgtccagcaatctacgttttccctagaacgatgagttctgtcgaccgccgctgacgtacggtcgtttatctgtgcgagagacgntattatgtattttggagttgttattcgactacgtagngtcggacgggctccggacccgtggggaccgagggtaactacgttcggtcctaccgtctccttacgcctaccaccgacggccacgtccgtcctccccncgtccctacccncctaccagcgtacccg

SEQ ID NO: 138836 - DNA, 553 bp, Homo sapiens
  misc_feature: GYAE6OF01EJFN4.46.67.G01.1.454.CMB.1.raw
  modified_base (249)..(249): a, c, t, g, unknown or other
  misc_feature (249)..(249): n is a, c, g, or t
  modified_base (373)..(373): a, c, t, g, unknown or other
  misc_feature (373)..(373): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctcgtggggctgggtccgnagctccgagggaagggctggaatacagttggaatgtctctcatagtggaggttcctattacagtccgtctctcaagagtcgagtcaccatatctctggacacgtccagcaatctagttttcccngaagatgagttctgtcgaccgccgctgacgacgggtcgtttatactgttgcgagagacggtcttagttatgttagttttggagttggtttatttcgacctaccttagacgtcggacgggggctccggaccccgtggggaccgagggaactcgtcgtcacccgtctccttgcccgtacccg

SEQ ID NO: 138837 - DNA, 831 bp, Homo sapiens
  misc_feature: GYAE6OF01CCX48.46.67.G01.1.454.CMB.1.raw
  modified_base (211)..(211): a, c, t, g, unknown or other
  misc_feature (211)..(211): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtcctggtgcaactgcaggagtcgggcccacgactggtgaggccttcggagaccctgtccctcacctgcgctgtctctggtcncctcatcagtagttggtttctcgtggggctgggtccgcagcctccgagggagggctggaatacgagttaggaagtcgtctctacagttaggtggtacggtttacctagtttaacgacggtccgttctacgtacaaggtagtcgacgtccaaccgtatactccttcgtacggaacctaccggtaccaacggtacctaaacgttccttaacgtttttacccgaggtaaacggtagttacggttaacgtttcgtcggttaccggtacccggtacccggtccgtacgggtaaccgttaaccgggggttacctttttaacggttacgttacgggtcggtaacgggaggtaacggtacggtttacctttaagttttacggtttaaggttttaggttttttaggggtaacggtttttagggtttttaacgtttacccggtaacccgtacccggttaacggtaaccgggttaccgggggaccggggggttccctaccccggggttaacccccggggtacgggggtaaccccggtaaggggttaaaccgtttaccgggtacccgggtttacccgttaccccggtttacccgtttacccgtttaaacccggtcccccgttaaacccccgg

SEQ ID NO: 138838 - DNA, 865 bp, Homo sapiens
  misc_feature: GYAE6OF01CWBRW.46.67.G01.1.454.CMB.1.raw
  modified_base (194)..(194): a, c, t, g, unknown or other
  misc_feature (194)..(194): n is a, c, g, or t
tcagactagcagtacacgaccggtgctcgatttagagtatacatattgggtttggggagtctcggtcaggacacagcatggacatgagggtccccgctcagctcctggggctcctgctactctggctccggaggtgccagatgtgacatcgagctgacccagtctccatccctccctgtctgcaaccgtggganacagtgtcaccatcacgttcggccgggacaacggtacggaactatttagaacctaacctttaattttaaaagttggtaacttacaaaacgtaacgtaacggaacccgaacggggtaacccggacccccttaaaggtacccttacccgtaaattaccttaacttcggaccttcggtacctaacttacccgttaagggtttttcggaaaccgtaaaagggtttcccgggggtaacccctaacggttaccgggtaagggttttaccgagggttacggggtacgtaagggtagggtaacgttacggtacggggtaaactaagggtttaccgttttaccgaccctttaccgtaacctaacctaacgttaacgtaaacggtttaacctcgtaacggtaaccgttaaacgggtttaacgtaaaaccggttttatttttaacggaaacccttttaaacgttttaacgttacccgtttaaggtaaccctaaaaggttaacttaaacgttttaacgtaacgttttacggtttacccgggaaacgtaaacgggtaacctaacggtaaacttaaacgtaaaaccgttaacggtaaccttagggttaacgccgttaacgaccgtaacttagttcttacgttaccttacgtacttaccccgtactaccgttactcgttataaccg

SEQ ID NO: 138839 - DNA, 715 bp, Homo sapiens
  misc_feature: GYAE6OF01BTOVH.46.67.G01.1.454.CMB.1.raw
  modified_base (138)..(138): a, c, t, g, unknown or other
  misc_feature (138)..(138): n is a, c, g, or t
  modified_base (665)..(665): a, c, t, g, unknown or other
  misc_feature (665)..(665): n is a, c, g, or t
tcagactagcagtacacgaccggtgctcgatttagagtatacatattgggtttggggagtctcggtcaggacacagcatggacatgagggtccccgctcagctccgtggggctcctgctactctggctcgagtgcagntgtgacatcgagctcgacccagtcctccactccctccctgtctcgcgaacggtgggagacagtcgtaccactatcacgttcggccggtacaacggtacgaactagttcgaactactttaatttaaacgtggtactacaacagtacgacgacggggtaccacccgtaagtcctacttaatcgtactcgctacgtacattaccgtagttacgaacggtaacgggtccgggtacctaagtccgggttagtacgaggttcggactaaggtcggacgtcggtaggacttagtacttcgactccgtacacgtatcgtaagtcttcgacggtaacgtagttacgtaagtttacgtttacgacgtttaacttttaacgttacggtaactaaccgtaaagtaaccggtttaaatttaaccggttaagttttaccgggttaaacccggaacggttaaaccggtaaacgtaacttaaaaccggttaaacttaaaaacgggtaactagggttctaccgggtactaccggactaaccgtnttacgtactttccttaacgcgtttacccgaccctacgctttagacgtacc

SEQ ID NO: 138840 - DNA, 637 bp, Homo sapiens
  misc_feature: GYAE6OF01E15FE.46.67.G01.1.454.CMB.1.raw
  modified_base (340)..(340): a, c, t, g, unknown or other
  misc_feature (340)..(340): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattgtatcaacatagaccagggacggccctaagctcctaatcctatgctgcatccagtttgcaaagtgggtcccatcgaggttcagtgcagtgatcngggacagatttcactctacacatcagtaatcgtgactaacgtagaagttattttagacttaaacttattactagtacaaactacgtaatttaacgtaagttcggttttaccgggacccgtaaagggggacctaacccggtaaacttaaaccgtaaaacgtttaaaaccgaaccgtttaggttacgggtaccttaaccggtaccgtaacccgttaaattccgtttaaggtttcccttttaacccaaacttttccccgtttaccccccgtacccttaactttacccgttggttaaaccc

SEQ ID NO: 138841 - DNA, 802 bp, Homo sapiens
  misc_feature: GYAE6OF01DROEW.46.67.G01.1.454.CMB.1.raw
  modified_base (221)..(221): a, c, t, g, unknown or other
  misc_feature (221)..(221): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtccgggcccacgactgggtgaggcctttcggacgacccctgtcccctcacctgccgcttgtctcgtggtcncctcatcagtagtggtttctcgtgggctgggtccgcagcctaccgagggacgggctggaatactagttggagtgtctctactataggtcggtacgttccttattacgacgttccgttctaccgtacgaagtcgtacgacgtaccacctatactctcgtacggtaccaccggtcaacgtctaaacgttccttacgtttttacccgagtaaacgtagtttacggtacgtttccgttaggttaccggaccccgggtacccgtacggtaccgggtaacccggtaccgggggtttactttttaaccgttaacggttcggtacggaaccggtaacggtaacgggtccggtttaactttaaggtttaaggtttcgttttaacgggtttttagggttacggttttaggtttaaccgtttacccgtaacctaccggttacggaccggttacccggggacccgggggttccgtaccccggggtaccccgggttgggggtaaccccggtaaagggttacccgtaccgtttaccgggtacccttaccccggttacccgtttacccgttaaacccgtccccgtaaacccccggg

SEQ ID NO: 138842 - DNA, 710 bp, Homo sapiens
  misc_feature: GYAE6OF01BSZPZ.46.67.G01.1.454.CMB.1.raw
  modified_base (178)..(178): a, c, t, g, unknown or other
  misc_feature (178)..(178): n is a, c, g, or t
  modified_base (673)..(673): a, c, t, g, unknown or other
  misc_feature (673)..(673): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactgggtgaggtcccttcgggagacccctgtccctcacctgcgtctgtctctggtcncctcatcagtgtggtttctcgtgggctgggtccgcagcctccgaggggacgggctaggaatacgtagttagggaagttgtcctcttacgagttaggttcggtacggtttcctaacttaccgacgttcccgttctccttacgaaaggtacgttcggaagtccctaacctattactctcgtaggacctacgtcagtacaattctacgtttccgagaagtatcgtagttcgtagcgaccgccgtctaggaaccgtacggttcctttaatacgtggtcgaccgtaggacggtacgtactttaagttagttagtttaaggttttgggtaagtttacgtttacgtttaccgaacctaccgtaggtacggtcgggacgggtccgtaccgggtacccggtggggaccgtaagggtacttaccggttcggtacccgtaccgtccttaccgtacgtcccgtacccgtacggtaccgtccctaagttccccgtacccttaccccgngtaccccacccgttaccaccgtacggtacgtacccgg

SEQ ID NO: 138843 - DNA, 568 bp, Homo sapiens
  misc_feature: GYAE6OF01CGUFM.46.67.G01.1.454.CMB.1.raw
  modified_base (192)..(192): a, c, t, g, unknown or other
  misc_feature (192)..(192): n is a, c, g, or t
  modified_base (219)..(219): a, c, t, g, unknown or other
  misc_feature (219)..(219): n is a, c, g, or t
  modified_base (337)..(337): a, c, t, g, unknown or other
  misc_feature (337)..(337): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttggccggganaaggtcgaactatgactaccttatttaaatgtatcaacatagaccagggacgccctaagctacctaatctatgctgcatccagtttgacaaagtcgggtcccagtcgagttcagtggnagtggtatcgtagggacagtatttcactctcacctatcaataactctagacaagtgaagttatttgactaactttattactagtacaatagtaaattactaatttcgtttacgacgtaagggacctaacgaacttaaacaaagttaacgaacgttgtacgactacgacctaaccgtattaccgttcgttccttactacttccccttacccgaccttacttcgtagtaaccg

SEQ ID NO: 138844 - DNA, 694 bp, Homo sapiens
  misc_feature: GYAE6OF01DMCM8.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccgcagcctccgagggagggctggaatacagttggaagtgtctctcatagtggtagttctattacagtccgtctctcaagtagtcgagtcactatatctctggacacgtccagcaatctacgttttcccagaacgtatagtacgttctgtcgtaccgccgtacgtagaccgtaacgggttctttacgttacgtgtcgtacgagtacggtacgggtactttaagtttagttagtttagttttttagggtacggttttcggtttaagttttacccggtaaccgttacccgttaaggttaaccggttaccggggacccggggggttccgttacccgggtaacccccgggttaggggggtacccggaaagggggtaaaccttacccggttacgggttaccccgttaacccggttcccgtttacccgttaccggtcccccgttaaacccccgg

SEQ ID NO: 138845 - DNA, 712 bp, Homo sapiens
  misc_feature: GYAE6OF01BIXWQ.46.67.G01.1.454.CMB.1.raw
  modified_base (192)..(192): a, c, t, g, unknown or other
  misc_feature (192)..(192): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttggccgggcaacggtcggaacattgacctaaccttaatttaaattggtatacaaacatagaccgagggaccggccctaagctcctaatctatgctgcatccgtagtttcgacgtaaaggtcggggtaccctagtcggtaggttcgaggtgggctaggtggattcggtagggactagtactttcgactctaccaaccctatacgtaagttaactcgtacgacctaaacggttaggtaaagtttacgttttacaacgtttaaaccttttagtttaaccttacgttaaccgtaaacgtaacgttaaactttaaacgttaacgtttttacgggttttacccgggaaccgtaaacgggaacctaaaccgttaaaccttaaaactaaaacgttaaaaccgtaacgtttacggtaggtacctcggaacctaacccgttattaccgtttgttacccctttacgtaaccgtttccccgtttacccccgcttaaaccttccgtttagtaaccg

SEQ ID NO: 138846 - DNA, 789 bp, Homo sapiens
  misc_feature: GYAE6OF01DFNW7.46.67.G01.1.454.CMB.1.raw
  modified_base (174)..(174): a, c, t, g, unknown or other
  misc_feature (174)..(174): n is a, c, g, or t
tcagactagcagtacacgaccggtgctcgatttagagtatacatattgggtttgtcctcctgctggtggcagctcccagatgggtcctgtccctggtgcaactgcaggagtccgggcccacgactggtgaggccttcggacgaccctgtccctcacctgcgctgtctctggtcncctccatcagtagttggtttctcgtgggctgggtccgcagcctcccgaggggaagggctaggaatacagttggaagtgtctctcagtaggtggtacgttcctattacacgttccgtctctacaagagtcgagtccaacctattactccttcgtcggacctaccggtccaagtacctaaactccttaacgttttccccgagaaagtattggtaacgtttcgtcgtcggacccgtccgtcgtacggaaccgtaccggggtttcttttaacgttacgttggtacggtcggaaggtaacggtacgggtactttaagttagttaggttttaagtttttcgggtaaggttttaggttttacctttaccggtaaccctacccgttaaggtaccggttaccggggtaccggggtccttacccgggaccccggtacgggggacccgtaagggttaaccgttacggtaccggttacccgtacccgttcccgttacccgttaccggtacccccgttacccgaacccgggtaacgggtcccctaaccggttccccggttccccctttcccccggaccggtaccccctacccccgttacccgtaaccgtaaccgtacccgtaccccgg

SEQ ID NO: 138847 - DNA, 745 bp, Homo sapiens
  misc_feature: GYAE6OF01AT5IO.46.67.G01.1.454.CMB.1.raw
  modified_base (83)..(83): a, c, t, g, unknown or other
  misc_feature (83)..(83): n is a, c, g, or t
  modified_base (737)..(737): a, c, t, g, unknown or other
  misc_feature (737)..(737): n is a, c, g, or t
tcagactagcagtacacgaccggtgctcgatttagagtatacatattgggtttggggagtctcggtcaggacacagcatgganatgagggtccccgctcagctcctggggctcctgctactctggctccgaggtgccagatgtgacatcgagctcgacccagtcctccactccctccctgtctgaccaccggtgggacgacaggtcgtaccacctatccgtaccgttcggacccgggtacaaacgtaccgggaaactagttcggaaaccttacctttaaattttaaagttcggtaactacgaaacgtaagtaaccggaaccggaacggggtacccgggtacccctaagtacctaccgttaactactaagtcgtctacgcctacgttccgtagttacggacgtaacgggtaccgggtccctaaggttacggtaacggttcgacggtttacgggaccgtaggggttacggtaacgttccggtaaggggtaacgtaacgttactttaccgtaccgttactacccgaactacgttaacgtacgttaactccgtaggtaaccgtaaggttacgtaagtttacttacgaacttaacgttaatacgtacgtaactaacgtaattaacttaacgttaacgttcggtaaccgaccgtaacgggtaacctaacgtaactaaacgttaacgtaaacgtacgtcgtacgacctacgactactagtctcgtcctactcttacctcacgtntcgtgtac

SEQ ID NO: 138848 - DNA, 826 bp, Homo sapiens
  misc_feature: GYAE6OF01B9YG7.46.67.G01.1.454.CMB.1.raw
  modified_base (195)..(195): a, c, t, g, unknown or other
  misc_feature (195)..(195): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtcctccatccctcctgtctgacaaccggtggganacagtgtcaccatcacgttcggccgggacaacggtaccggaactagttacgaaccctaaccttaatttttaaaacgttggttaactacctaaaaccgtaagttaacggaacccggaacgggggaacccggtaccccctaaaggcccttaccttaaattcctaagtcggtcctagacctacttacccgtaggttttacggaacgtaaaacgggttccggggttacccctaggttacggtacgggtttaccgaacgggttcggggtacgtagggttagggtacgttaccggtaggggtaacctaaggttaccttttaccaccgtttccctacctaacccttagttaccgtaagttaacttaccggtagaaccggtaaacggttagtaaacgtttcgtttttaacgaacctttaaacgtttttacttaacgttacgtaaactaaacttaaggtaaactttaaccgtaagttttcggtttaacccgggaaccgttaaacgggacctaaaccgtaaccttaaaacgtaaacttaaaccggacgttacggtaccggactaccggaacctaccgtagttacttccgtacctttaacacccgtttacccgttaccccgactttacttccgtagtaaccg

SEQ ID NO: 138849 - DNA, 675 bp, Homo sapiens
  misc_feature: GYAE6OF01C2VP7.46.67.G01.1.454.CMB.1.raw
  modified_base (193)..(193): a, c, t, g, unknown or other
  misc_feature (193)..(193): n is a, c, g, or t
  modified_base (196)..(196): a, c, t, g, unknown or other
  misc_feature (196)..(196): n is a, c, g, or t
  modified_base (385)..(385): a, c, t, g, unknown or other
  misc_feature (385)..(385): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatccctcctgtctgcaaccggtggganacngtgtccaaccatcacgttggccgggacaaggtcggaactagttcgaacctaccttaattttaaagtggtaactcaaactatacggacccgagggaccggacccctaagccttacctaatcctagtgcctgctactcctagtttacgactaaggtcgggtcccagtcggaggttcagtgcaggtgatcgngggactagtactttaccacttacgacctaactactacgtaagtaacttccgtacgacgtaacgttagtaaacgtttagttttaacgttaaactttatttactagtaactaaactagtaaactttaacgtaagtttacggttttacggaaccgtaaggtaccaacgtaactaaactaaaacgttaaaccgacgttacggtacgtcgtacgtaccgaacctacgttacgttccgttcctttaccgtactttaccccgtttccccgaacttacttccgttagtaaccgttacg

SEQ ID NO: 138850 - DNA, 724 bp, Homo sapiens
  misc_feature: GYAE6OF01E4Z8M.46.67.G01.1.454.CMB.1.raw
  modified_base (220)..(220): a, c, t, g, unknown or other
  misc_feature (220)..(220): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtccgggcccacgactggtgacggtccttcgggacgacccctgtcccctcacctgcgctgtctcgtggtcnccctcatcagttagtgtttctcgtggggctcgggtccgcacgcctaccggaggggacgggtctaggaatacgtagttggagtcgtctctacgataggtggtacgttctagtacgacgttcccgtctctacgaagtcgtcgtacgtaccactattactcctcgtacggacctaccgtacagtacctaattcgttaccgtttccctaaggaacgttgttaggtacgtttcgcggttaccgacccgtccggtcgttacggaaccggtacgggttcttttaacgtcgtggtgtaccggtaggaccggtacgttactttaagttagttaggtttaggttttggacgttttacggtttacttacccgaccctaaccggtaggtaccggtaccggggacccggggtccgtacccgggtaccccgggtgggaacccggtagggttaaccgtaccgggtttaccggtaccccgttaccgttaccctttcccgtacccgtccccgtaaccccgg

SEQ ID NO: 138851 - DNA, 772 bp, Homo sapiens
  misc_feature: GYAE6OF01DBYAR.46.67.G01.1.454.CMB.1.raw
  modified_base (396)..(396): a, c, t, g, unknown or other
  misc_feature (396)..(396): n is a, c, g, or t
tcagactagcagtacacgaccggtgctcgatttagagtatacatattgggtttgtcctcctgctggtggcagctcccagatgggtcctgtccctggtgcaactgcaggagtccgggcccacgactgggtgaggccttcggacgaccctgtccctcacctgcgctgtctctggtcgccctcatcagttagttggtttctcggtggggcgtggggtccgcacgccgtcccggaaggggacgggctaggaactacgtagttaggaagttcgtcctactctagtacggtggtacgttctattacgtacgtccttctacttacagtgtcgagtccacctatactctacgtacggacctaccgtccaagtctaacgttcgttaccgttttaccgagaaagtntcgtacgttcgtgtaccgaccggtccgtacgtcgtaacccggtcggttacgtttttacgtcgtacggtgtacggacggtacggtacgttacgttagttagttgtttagtttggtagtttagttaacttcgaaccgtccgtaggccgtacgggtaccgggcctacccgggaccggtaccggggaccgtaagggttaacctacggtaccgtacccgttacccggtaccctccggttaacccgcccccggtttacccgaaccccgggttaccggtcccccgttaacggtttccccccggttacccccgttccccccgggtaccgtacccccccgttcccttaacccccggtacccggtaacgtcccccggttaccccgg

SEQ ID NO: 138852 - DNA, 712 bp, Homo sapiens
  misc_feature: GYAE6OF01AYQPU.46.67.G01.1.454.CMB.1.raw
  modified_base (298)..(298): a, c, t, g, unknown or other
  misc_feature (298)..(298): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcgggagacccctgtcccctcacctgcgctgtctctggtgcctcatcagtagtggtttctcgtggggctgggtccgcagtccgtaccgaaggggaggctaggaatacagttaggagtcgtctctctagtaggtggtacggttcctagtacgagtccgtctctanaaggtcgtcgagtccacctattactctgtacggacacgtccagactatcgttacgtttccagtaagtctagtagttcgtaggtccgaccgccgtactacggaaccggtacgggttacgttttaacgtacgttggtacggacggaaggtacggtacggtacttagtttaagtacgttttagtttagggtagtttggtttacttaccgactaaccggtagacggtcgggaccgggtccgtacccggccggtacggggaccgtaagggtaacttccgtacgggtcctaacccgttccgttaccgtacccgtacctaccccgaacggtaccggtaccctacggttcccggtttaccccctccccccggtacgtaccccctaaccccgttaccctacccggaaaggtcccgtaccccgg

SEQ ID NO: 138853 - DNA, 662 bp, Homo sapiens
  misc_feature: GYAE6OF01DRL6I.46.67.G01.1.454.CMB.1.raw
  modified_base (404)..(404): a, c, t, g, unknown or other
  misc_feature (404)..(404): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggacaagtcggaacattgacacctatttaatggtatcaacatagaccagggaccgccctaagcctactaatctatgctgcatccagtttgacaaggtcgggtccagtcgagttcagtgcagtgatcgtagggacagtactttcactctacacctatactaagtaactcgtgacgtaacgttagtaagttnttttacgactaactttacttactcgtaacaactaagtaaacttaactaagtttcgtttaccggaaccgtaagggtaacctaaccggtaaaccttaaacgtaaaaacgtttaaccggaaacgttacggtacggtaccgttaccgtaaccgtaacccgttaagtttcccgttacgtttacccgttttaacccttaacccgtttttcccccgtttaacccccccggtaccctttaacctttcccgttacggtttaaacccg

SEQ ID NO: 138854 - DNA, 783 bp, Homo sapiens
  misc_feature: GYAE6OF01B4NXW.46.67.G01.1.454.CMB.1.raw
  modified_base (192)..(192): a, c, t, g, unknown or other
  misc_feature (192)..(192): n is a, c, g, or t
  modified_base (223)..(223): a, c, t, g, unknown or other
  misc_feature (223)..(223): n is a, c, g, or t
tcagactagcagtacacgaccggtgctcgatttagagtatacatattgggtttggggagtctcggtcaggacacagcatggacatgaggtccccgctcagctcctggggctcctgctactctggctcgaggtgccagatgtgacatcgagctgacccagtctccatccctcctgtctgctaaccggtggganacagtcgtcaccatcacgttcggccgggtanaaaggtcgaactagttgaacctacttaatttaaagttcggtattacaaacattacggaccaggggtaccgaccctaaagctaccgtaatcgtatgtctagtccatccgtagttttcggacgtaaaacggttcggggtacccctaaggttccggtaagggtttaccgagggttacggacgtaaggttagggaacttcgttacgggggaacctaagggttaactttttcccgaaaccgtttccttaccaacctaacgttacccggtaaattaacgtaccgttacgaacctaaaccgggtagtaaacggttacttttacgaacctttaaatttacgttaacgttacggtaactaaacgtaaacgttaactttaacgtaacgttttacggttttaacccggaaccggtaacgggtaaacccttaaccggaaaccttaaactaaaaccgtttaaaccggaacgtttacggtacggtaacctacgtaacccgtaaccgttagttacccgttagtttaccttaacgtaccgtttcccgttaccccgtactacttaccgtgttaaccg

SEQ ID NO: 138855 - DNA, 650 bp, Homo sapiens
  misc_feature: GYAE6OF01C6XQA.46.67.G01.1.454.CMB.1.raw
  modified_base (358)..(358): a, c, t, g, unknown or other
  misc_feature (358)..(358): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtcctccatcctccctgtctgcaaccggtgggagacagtgtcaccatcgacttggtcgggacaaggtacggaacatttgaactaaccttaatttaaagttggtactacaacagtagacgaggggaccgtccctaagctacctaatctatcgctgctatcctagtttgacaaggtcgggtccagtcgagtcagtggacnggtgatgtaggactagtattcactcgtacaccatactaagtactcgtagaccgaacgtagtaagttacgtttagaaccttaaatttacttacttacgtaacaaacgtaagttaaacttaacgttaagttcgttttaccgggaaccgaaagggtaacctaacggtaaaccttaaacgtaaaacgtttaaacgaaccgttaggtacgggtaacctaccggtaacctaaccgtatttaccgtcgttttacctactttaacctcccggttaccccaacttacttctacggttaacc

SEQ ID NO: 138856 - DNA, 601 bp, Homo sapiens
  misc_feature: GYAE6OF01EWFFG.46.67.G01.1.454.CMB.1.raw
  modified_base (213)..(213): a, c, t, g, unknown or other
  misc_feature (213)..(213): n is a, c, g, or t
  modified_base (246)..(246): a, c, t, g, unknown or other
  misc_feature (246)..(246): n is a, c, g, or t
  modified_base (282)..(282): a, c, t, g, unknown or other
  misc_feature (282)..(282): n is a, c, g, or t
  modified_base (432)..(432): a, c, t, g, unknown or other
  misc_feature (432)..(432): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcagggagtcgggcccacgactggtgaggccttcggagaccctgtccctcacctgcgctgtctctggtcncctcatcagtgtgtttctcgtgggctgggccgnagcctccgagggagggctggaactacagtggaagtntctctcagtaggtggaggttcctattacgacgttccgtctctacgaagtagtcgacgtcgacctatactctctgactacgtccagacaatctacgttttcccagaagtatgtagtttcgtgtcggaccgccgtgtacgaccgtacgggtntttaactcgtgtgcgagacgacgtcttattagtgtttagtttgggagtttggttatttccgacgtaccgtaggtacgtccgggacgggtccgtccggtacccggtcgggaccgtaagggtaacttcggtagtcccgtaccgttcctaccgttacggccctaaccccggg

SEQ ID NO: 138857 - DNA, 666 bp, Homo sapiens
  misc_feature: GYAE6OF01AM7ZG.46.67.G01.1.454.CMB.1.raw
  modified_base (196)..(196): a, c, t, g, unknown or other
  misc_feature (196)..(196): n is a, c, g, or t
  modified_base (421)..(421): a, c, t, g, unknown or other
  misc_feature (421)..(421): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtcctccactccctccctgtctgcaaccggtggganacagtgtcaccatcacgttggccgggacaaggtcggaactagttcgaacctacctttaatttaaagttggtactacaacagtacgaccgagggaccgaccctaagctacctaatctatgctgcatcctagtttacgacgtaaacgggtcgggtaccctagtcggtaggttacaggttggactaggtcggtactcgtggggaactagtactttcactctacaactntacagttactcgtacgactaacggtagtaaagttctttacgaactttaactttattaacgtacgtaactaaactaagttaaactttaacgtacgttttacggtttaccggaaccggtaaaggtaaccctaacgttaaaccgtaaacttaaaagttaaacctacggttgtacggtctaacggtacctaacttacttacgttccgttaccttactacgtttccctaccgtacctacttcgtagtaac

SEQ ID NO: 138858 - DNA, 645 bp, Homo sapiens
  misc_feature: GYAE6OF01DO238.46.67.G01.1.454.CMB.1.raw
  modified_base (173)..(173): a, c, t, g, unknown or other
  misc_feature (173)..(173): n is a, c, g, or t
tcagactagcagtacacgaccggtgctcgatttagagtatacatattgggtttgtcctcctgctggtggcagctcccagatgggtcctgtccctggtgcaactgcaggagtccgggcccacgactggtgaggccttcggagaccctgtccctcacctgcgctgtctctggtcncctccatcagtagttggtttcttcgtgggctgggtccgcagctcccgaggggaagggctaggaatacagttggaagtgtctctcagtagtggaggttcctattacagtccgtctctcaagagtcgagtcaccatatctctggacacgtcagacatctagttttcccctagaagatgtagttcgtgtcgaccgcgctagacgacgggtctttattactgtgcgagagcgtactattagtgttattttaggtagttggtttattcgacctacctagtactcggacgggcgtaccgacccggtgggaccgaagggtaacttacgtcggtaccgtaccgtccttacccgttacgacccctaccgaacccggtaaccgggtacccctaaccggttcccggttacccccgtttccccccggttaccggtcccccttaacccccgttccccgtaacccgaaccggtcgtaaccccccgg

SEQ ID NO: 138859 - DNA, 610 bp, Homo sapiens
  misc_feature: GYAE6OF01AGEGX.46.67.G01.1.454.CMB.1.raw
  modified_base (397)..(397): a, c, t, g, unknown or other
  misc_feature (397)..(397): n is a, c, g, or t
  modified_base (460)..(460): a, c, t, g, unknown or other
  misc_feature (460)..(460): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgccctccatcagtagttggtttctcgtggggctgggtccggcagccgtccgagggaaggggctagggaatacagttgggaagtgtctctcataggtggtaggttcctattacaggttccgtctctcaagagtcgagtccaccatactctcgtgacaccgtccagcaatctacgttttcccagaagtntgtagtttcgtgtcgaccgccgtcgtcgaacgcgggtcgttttactagtgtgcgagagacgtntagttgtgttagttttggagtttaggtttatttcgaaccgtaccgtacgtagtccgggtaccggggcctacccggtaccccggtggggacccgtaaggggtaacctggttcggtacctacccgtcttacccgttcgccccgtaaccccgg

SEQ ID NO: 138860 - DNA, 643 bp, Homo sapiens
  misc_feature: GYAE6OF01BLZ5Y.46.67.G01.1.454.CMB.1.raw
  modified_base (192)..(192): a, c, t, g, unknown or other
  misc_feature (192)..(192): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttggccggcaagtcgaacattgacactattaaatgtatacaacatagaccagggacgccctaagctacctaatctatgctgctactcctagtttcgacgtaaaggtcgggtacccagtcgaggttcaggtggcagtggatcgtaggacagtacttcactctacacctatactaagtatctagactaacgtagtaaagtagttttagacttaaactttattactacgtaactaaactaagtaaactttaactaacgtttggttttaaccggaaccggtaaacgggtaacctaaaccggtaaacttaaaacgtaaaacgtttaaaaccgaacgttaggtacgggtactaacggtacctaaccgtattaccgtttcgttacctttacctaaccgtttacccgttacccccgtaaccctactttccgtaacggttaacc

SEQ ID NO: 138861 - DNA, 521 bp, Homo sapiens
  misc_feature: GYAE6OF01AP2WM.46.67.G01.1.454.CMB.1.raw
  modified_base (487)..(487): a, c, t, g, unknown or other
  misc_feature (487)..(487): n is a, c, g, or t
  modified_base (517)..(517): a, c, t, g, unknown or other
  misc_feature (517)..(517): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggccctaagctcctaatctatgctgcatccagtttgcaaagtgggtcccatcgaggttcagtggcagtgatcgtgggacagtatttcactctcaccatcagtatctgcaacgtagaagtattttgactaacttattactgtactaactaagtaaattaaatgtttacgaccgtaagggacaacgtaactaactaaattaaacgactagtgctgacactntctgtcttacattccttcccgctatctgtntacg

SEQ ID NO: 138862 - DNA, 580 bp, Homo sapiens
  misc_feature: GYAE6OF01BWG1B.46.67.G01.1.454.CMB.1.raw
  modified_base (250)..(250): a, c, t, g, unknown or other
  misc_feature (250)..(250): n is a, c, g, or t
  modified_base (453)..(453): a, c, t, g, unknown or other
  misc_feature (453)..(453): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctcgtggggctgggtccggnagcctcccgaggggaagggctggaatacagttggaagtgtctctcatagtggtaggttcctattcagtccgtctctacaagtgtcgagtccaactatatctcgtgacacgtccagcatctacgttttcccagaacgtagtgtacgttctggtcgacccgcgtctgacgtcgggttactttagtacgtgtagcgagagacggtnttagttatgttagttttggagtttgtttactttcgactaccgtagtacgtcgggacgggtcctccggacccggtgggaccgtagggtaactcggtcgtacctaccgttctaccgttgcccgtacccg

SEQ ID NO: 138863 - DNA, 586 bp, Homo sapiens
  misc_feature: GYAE6OF01AFJAW.46.67.G01.1.454.CMB.1.raw
  modified_base (293)..(293): a, c, t, g, unknown or other
  misc_feature (293)..(293): n is a, c, g, or t
  modified_base (339)..(339): a, c, t, g, unknown or other
  misc_feature (339)..(339): n is a, c, g, or t
tcagactagcagtacacgaccggtgctcgatttagagtatacatattgggtttgtcctcctgctggtggcagctcccaggatgggtcctgtccctggtgcaactgcaggagtcgggcccacgactggtgaggccttcggagacccctgtccctcacctgcgctgtctctggtgcctccatcagtagtggtttctcgtggggctgggtccggcagctcccgaggggaaggggctgggaatacattggaagtgtctctcatagtggaggttcctattacagtccgtctctcaagntcgagtcaccatatctctggacacgtccagcaatctagttttcccngaagtatgtaagttcctgtacgaaccgccgcttagaccacgggtcgttttaatactgtgacgagagacggcttatattgtagtttttggagttggttatttcggactacccgtagacgttcggacggggctcggacccgtggggccagggtaatactgggtcaccgtctcctacgccctaccgaccacgggcccagtccggttcccttacccccgcgtcccacccctaccctaccgaagcgtacccg

SEQ ID NO: 138864 - DNA, 572 bp, Homo sapiens
  misc_feature: GYAE6OF01BUI29.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctcgtgggctgggtccggcagctcccgaggggaagggctggaatacgattggaagtgtctctcatagtggaggttcctattacagtccgtctctcaagagtcgagtcaccatatctctggacacgtccagcaatctagttttccctagaacgatgtagttctggtcgaccgccgctgacgtcgggtacgtttatacgtgtgcggagaggtacgctattagttgttattttggtagttggtttagtttcgactacctagacgtcgacggggctccgacccgtgggccagggtactacgtcgtctaccgtctccgttagcctaccaccgacggcccacgtccgtcccttcccccgtcgtccctacccctcctccacgcgacccg

SEQ ID NO: 138865 - DNA, 644 bp, Homo sapiens
  misc_feature: GYAE6OF01DSVEO.46.67.G01.1.454.CMB.1.raw
  modified_base (193)..(193): a, c, t, g, unknown or other
  misc_feature (193)..(193): n is a, c, g, or t
  modified_base (199)..(199): a, c, t, g, unknown or other
  misc_feature (199)..(199): n is a, c, g, or t
  modified_base (229)..(229): a, c, t, g, unknown or other
  misc_feature (229)..(229): n is a, c, g, or t
  modified_base (257)..(257): a, c, t, g, unknown or other
  misc_feature (257)..(257): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccactcctcctgtctgcaaccggtggganacagtnccacatcacttcggccggcaagtcgaactntcgaactacttaattaagtgtatacaanatacgaccgacgggaccgaccctaagcctactaatcttagtgctgctactccgtagtttcgacgtaacggtcgggtaccctagtacggtacggttcgaggtcggacgtaggttcggacgttcggtacgggtactaggttactttacaccgttcctaccgtaacctattacgtaacgttaacttcgtacggtaacgtaacggttaagtaaagttttacgtttaacgtaacctttaactttacgttacgttacgtaaacgtaacgtaattaactttaactagtttacggttacgaacgtaacggaactacgtaactaacgtaactaacgtatgacgtctacacgtactatcttcgttctactactttccgtacccatactcgtctaacg

SEQ ID NO: 138866 - DNA, 715 bp, Homo sapiens
  misc_feature: GYAE6OF01BRJO0.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgccaaccgtgggagacagtgtcaccatcacttgccgggcaagtcggaacattgactaccttatttaaattggtatcaacatagaccgagggaccgccctaagcctctaatctatgctgcatcctaggttttcgacgtaaacggtcggggtacccctagtaccggtagggttcgtacggtggaccgtaggtgggtacttccggtaggggaacctaggtacttttccgaaccttccgttaccaaccctaattaccgtaacggtttaactccgttacggtaacctaacgggttaacgttaaaacggttaacgttttttacggtaaccttaaacgttttactttaacttacgttaacctaaacgtaagtttaaactttaacttaaacgtttacggtttttaccgggaaccgtaaacgggtaacctaacggtaaaccttaaactaaaacgtttaaacgaacgttacgtaggtccgtagtacccgtaactagttcttgttccgttactaccgttccttaccccgactacttccgtagtaacc

SEQ ID NO: 138867 - DNA, 696 bp, Homo sapiens
  misc_feature: GYAE6OF01DXUC3.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatccctcctgtctgcaaccggtgggagacagtgtcaccatcacttgccggacaagtcgaacattgactacttatttaaattggtatacaacatagaccgagggaccggccctaagcctactaatctatgctgctatcctagtttcgagtaacggtcgggtcccattcggaagttcgaggtcggctaggtgtagtccgtagggactagtactttcacttcgtaccacctagtacctaagttaactcgtagtaaccgtaacggtagtaaagttagttttacgacttaaacttttacgtttaacttacggttaacctaaacgtaagttaaactttaacttaacgtttacggttttacggaacccggtaaacgggtaaccctaaccggttaaacctttaaaacgtaaaacgtttaaacgaaaccggtttaggtaccggttcgtaaccggtaccctaaacccttagttacctttgttcccgttaacttacccttacccgtttacccccgacctttacttaccgtaggtttaaccg

SEQ ID NO: 138868 - DNA, 677 bp, Homo sapiens
  misc_feature: GYAE6OF01AHS7V.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgaccagtctccatcctccctgtctgcaaccggtgggagacagtgtcaccatcacgttggccgggtcaaggtcggaacagtttcgactaccttaattttaaaattggtatacaactatagaccgagggaccggaccctaagctacctatctatgctgcatcccgtagtttacgacgtaaacggtcgggtaccctagttcggacggtttcgaggttcggcgtaggtggtatcgtagggactagtactttcaccgttctaccgtaacctagtaccgtaagtaacttcgtacgtaccgtaacggttagtaaaggttaacttttacgaaccttaaactttaagtttaaccgtagttaacccgtaaactaacgttaaactttaacgtaaacgttttcggtttaaccggaaccgtaacgggtaacctaacgtaaaccttaaacgtaaaacgttaaacgtaacgtcggtagtacgtacgactaccgtattcgtcgttctacttcgtaccttccccgtatcttcgtgtaacg

SEQ ID NO: 138869 - DNA, 734 bp, Homo sapiens
  misc_feature: GYAE6OF01BP6XS.46.67.G01.1.454.CMB.1.raw
  modified_base (192)..(192): a, c, t, g, unknown or other
  misc_feature (192)..(192): n is a, c, g, or t
  modified_base (217)..(217): a, c, t, g, unknown or other
  misc_feature (217)..(217): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccgggnaagtcggaacattgactactatttaatgtatcaacatagacaggacgccctaagctctaatctatgctgcatcctagtttgactaaaggtcgggtacccagtcgaggtttacaggtcggctaggtcggatcgtgggacagtactttcgactctacaaccatacgtaagtaactctacgactaacggttacgtaaagttacgttttacgaacttaaacctttactttaacgttacggttaactaaaccgtaaggttaaacttttaacgtaaacgttttacgggtttttaaccggaacccggttaaaacggggtaacccgtaaaccggttaaaccgttaaaccgttaaaaacggtttaaaacccggtaaacgtttacgggttaaccggttaacccgttaaccggtaacccgtaaacccgttaagtttaccgttaaccgggtttacccttttaacccgtaaacccgttttccccgtttacccccgtaacccttaacgttccccgtttaaggttaaacccg

SEQ ID NO: 138870 - DNA, 766 bp, Homo sapiens
  misc_feature: GYAE6OF01EBDEV.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcggagctcgaccagtcctcctactccctccctgtctcgaccgtaaccggtgggacgacgtaggtcgtaccaacctactacctacgttccgggaccgggtaacgtaaacggtaccggtaaactacgttacgaaccttaaccgtttaaattttaaagttagtaactaacaaactaagtaacgaaccggaacggggacccgtaacccgtaacgccttaacctaattcttagtcgtctcgactactacgttaggttcgaacgtaacgggttccgggtacctaggtacggttaggtcgaggtgacgtaggtgtactcggtacggatagttactacgactctaccactacgtactaagttactcgtacggaacgtaacgttaaggtaaactttcgtttaacgtaactttaactttacgttaacgttacgtaaacctaaacgtaagtttaaacgtttaacgttagtttcgggtttaaccggaacggtaaccggtaaacctaaccgttaaacttaaaaccgttaaaagttaaccgtaacgttacggtacgtaccgtaacgtacccgtaacttacttacgttcgttaccttacctacctttaccctacccgtacttctcgtataccg

SEQ ID NO: 138871 - DNA, 826 bp, Homo sapiens
  misc_feature: GYAE6OF01CWTAB.46.67.G01.1.454.CMB.1.raw
  modified_base (240)..(240): a, c, t, g, unknown or other
  misc_feature (240)..(240): n is a, c, g, or t
tcagactagcagtacacgaccggtgctcgatttagagtatacatattgggtttggggagtctcggtcaggacacagcatggacatgagggtccccgctcagctcctagggctcctgctactctggctccgaggtgccagatgtgacatcgagctgacccagtctccatccctcctgtctgcaaccggtgggagactagtcgtccaccatccacgttggccgggtacaaggtcggaaactntttcgacctaacttattttaaagtggtatacaaactagtacgaccgacgggaccggaccctaagctacctaatctatgctgctacgtcctagtttgactaaggtccgggtacccagtcgaggttcgaggtcggtacgaggtacggtagttcggtaggggaactacggttactttaccaccgttctaacccgaacctactacgtaacgttaacttccgttacgaacccgtaaacggttaaggtaaacgttttacgtttaacggttaaccttaaactttttacgttaaacctttacggttaaacctaaacgttaaaccgtttaaaactttaacgtttaaacggttttacccgggttttttaaccgggaacccgggttaaaacgggtaaaccccgtaaaccgtttaaaccgttaaaaccgtttaaaaaaccggttaaaccgttaaacggttaccgggtttaaccggggtaccttacgtaacccgtaaaccctttaacgtttacgtttccgttacccgttttaaccctaccgggttttaacccccttaccccggttaaccttaaccctttacgtaccgtttaaaaccggg

SEQ ID NO: 138872 - DNA, 701 bp, Homo sapiens
  misc_feature: GYAE6OF01A64NK.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccagactggtgaggccttcggagaccctgtccctcacctgcgctgtctctggtgcctccatcagtagtggtttcttcgtggggctgggtccggacagcctcccgaggggaaggggtctggaatacgtagttgggaagtgtctctacaagtagtgggaggttcctaagttacaggtccgtctactcaagtagtcgagtacacctatactctctggaaccacgtccagctaacgtctacgttttccgtagaagtacgttagtacgtttacgtggtacgaccccgtcggtacgtacggacgtaacggggttcttttaagttacgtgcgaacgtagacggtacggtacttagtttaagttagttaagtttttaggaggtttaggtttacttacgtacctaccgtaggtacgtacgggtacggggtcctaccggtacccggtgggtaccggtaacgggtaactaccggtaggtaccgtaccgtccgttaccgttacgcccgtaccgaaccggtaccggtacccgtacggtcccgttaccccgttccccgtcggacccctaccctacccgtaccgaaacggcgtaccccgg

SEQ ID NO: 138873 - DNA, 665 bp, Homo sapiens
  misc_feature: GYAE6OF01D0G5L.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtgggctgggtccggcagcctcccgaggggaaggggctaggaatacagttggaagtgtctctcatagtggtagttcctattacagtccgtctctacaagagtcgagtcaccatatctctggacacgtccagcaatctacgttttcccagaagtatgtagttctgtcgaccgccgtctcggaccgtacgggtcgttttaattacgtgtgacgagaggacggtcttaaaaagttgttagttagttttaggtagttaggtttacgtttacgtacctacccgtagtacgtaccgggacggggtccgtccggtaccccgtacgggccgaacgggtaacgttacgtcggtaccgtaccgttccgttccgttaccgtccctacccgtaacccggaaccgggtacccctacggttcccggttccccgttcccccgtccggtacccctaccccgtaccctacccgaacggccgtacccgg

SEQ ID NO: 138874 - DNA, 853 bp, Homo sapiens
  misc_feature: GYAE6OF01A33OS.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtccgggcccacgactggtgaggccttcggagaccctgtccctcacctgcgctgtctctggtgccctccatcagtagttggtttctcgtggggctgggtccggcagcctacccgaggggaaggggctaggaaatacgagttggaagtgtctctcagtaggtggaggttcctaattacagtcccgttctctacaagtacggtcgaacgtccaacctatacttcctacgtaggaccacgtacccagtacctaaattccgtaacggtttttcccaaggaaagtacttagtacgtttacgtcggtacgaacccgtccgtctaacggaaccgtaccgggggttactttttaaacgttaccggtggttaccggacggtaacggtaacgggtaaccggttacctttaaagtttaacgttaggttttaaacgttttttgggggtaaagttttcgggttttaaatttaccccggtaaacctaccccgtttaaaggtacgtaccgggggtaacccggggtacccttaccgggaaccccccgggttggggacccggtaaacggggtaacgttaacccggttaccggtacccgtaaccccgttcccgttacccttaaccggaccccttaacccgaaaccccgggtaaccggggtaccccccttaacggttcccccggtttacccccttacccccccgtacggtcccccgttaacccccttaaccccggtacccctaaaaggtcccgggaaaccccc

SEQ ID NO: 138875 - DNA, 689 bp, Homo sapiens
  misc_feature: GYAE6OF01BM4YR.46.67.G01.1.454.CMB.1.raw
  modified_base (622)..(622): a, c, t, g, unknown or other
  misc_feature (622)..(622): n is a, c, g, or t
tcagactagcagtacacgaccggtgctcgatttagagtatacatattggggtttggggaggtctcgggtcaccgggaccacgtacgcgattggacattggagggtccccgctcagctcctggggctcctgctactctggctccggaggtgccagatgtgtactattcgagtcttaggaccctagtctccatcctcctgtctgcgaacggtggagacgagtgtcaccatcacggttcgccggcaagtcgaactgttcgactaccttatttaactggtactcaactatagaccgagggaccggcctaagctacctaatctactgctcgcgacgtaccgtagttgacgtaaggtcgggtacctagtacggtaggttacgtagtacggcgaagttaggaacttcggtaggggtaactaaggtactttaccaacttccgtaacgtaaccgaagttacgaagttaacctcgttaacggtacgtaacggttagtaacgttaagttttacgaacttaaactttacttaacgttaacgttaccgtaaacgtaacgttaaattaacgtaagtttacgtttacggaacgtaaggaacctaacgtaacgtaacgtaaagttaaccgattacggngtacctagtctaacgtatcgttagtacttacgtacgttccgttaccgtaccgtagtcgttacgtacg

SEQ ID NO: 138876 - DNA, 649 bp, Homo sapiens
  misc_feature: GYAE6OF01D65DM.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccggaggtgccagatgtgacatcgagctgacccagtctccatcctcctgtctgcaaccgtgggagacagtgtcaccatcacttgccggacaagtcggaacatgacaccttaatttaaagttgtatcaacataagaccgagggaccgccctaagcctacctaatctatcgctgctactccgtagtttgacgtaaaggttcggggtacccctaagttcggtaggttcgaggtaggcgaggtcggtaagtcggtagggactaaggtactttacgactcctacgactacttacgtaagttaacttcgtacgacgtaacgtagtaaacgttagtttacacttaaactttacttaccttagttaacctaagtaagttaaacttaactaagtttcggtttaacggaccgtaacgggaactaacgtaacttaaacgtaaaacttaaaccggtattacggtgaccttagaacctaccgtattccgttattccttactaacttcccgtaccccgaactacgtctacggttac

SEQ ID NO: 138877 - DNA, 621 bp, Homo sapiens
  misc_feature: GYAE6OF01AD2T2.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacgttcgccggcaagtcggaactagttgacaccttatttaaagttggtatacaactatacgaaccgaggggaccgtccctaaagcctacctaagtccttaagtcgtctcgctactccgtagtttcgacgtaaggtcgggtccagtcgtaggtcagtcgctaggtgatcgtaggactagtattcactctaccgactactctaagtactcttacgactaacgtacgtagttacgttgacttaacttatttactcgtaactaactaacgtaattactagttacgtttaccggacgaacgggactacgaacttaacgtaaacgttaacgacttggtcgtacctgtaacccgtacgtaacttcgttcgttaacctttccgaacgtttccccttacccaccttacgttccgttaagttacg

SEQ ID NO: 138878 - DNA, 619 bp, Homo sapiens
  misc_feature: GYAE6OF01ECBZR.46.67.G01.1.454.CMB.1.raw
  modified_base (172)..(172): a, c, t, g, unknown or other
  misc_feature (172)..(172): n is a, c, g, or t
  modified_base (234)..(234): a, c, t, g, unknown or other
  misc_feature (234)..(234): n is a, c, g, or t
tcagactagcagtacacgaccggtgctcgatttagagtatacatattgggtttgtcctcctgctggtggcagctcccagatgggtcctgtccctggtgcaactgcaggagtccgggcccacgactggtgaggccttcggagaccctgtccctcacctgcgctgtctctggtncctcatcagtagtgttcttcgtgggcgtgggtccgcagctccgagggagggctaggaatacnttggaatgtctctcagtagtggagttcctattacagtccgtctctacaagtacgtacgagtcaccatatctcgtgacacgtcagacaatctacgttttccagaacgtatcgtacgttacgtggtacgaccgccgacgtcgaacgtacgggttacgtttatacgtgtgacgtagacggacgtctagttattgttagtttggtagtttagtttacgttaccgtactacccgtagtacgtcggtacggggtcctaccggacccggtcgggtacgacgggttaatacgtcgtccgtaccgtctaccgtacgtccgtaccaaccgtaccggtcccacgttcccgtcccgttccccgtacgtaccctacccctccgaaccgacgtcgaccg

SEQ ID NO: 138879 - DNA, 641 bp, Homo sapiens
  misc_feature: GYAE6OF01CU73Q.46.67.G01.1.454.CMB.1.raw
  modified_base (193)..(193): a, c, t, g, unknown or other
  misc_feature (193)..(193): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgccaaccggtggganacagtgtcaccatcacttggccgggcaaggtcggaacattgactactattttaagtgtatcaacatagaccgagggaccggccctaagctacctaatctatgctgcactcctagttgacgtaaaggtcgggtaccagtcgtaggttcaggtggctaggtgatcgtgggactagtatttcgactcgtaccactactactaagttaactcgtacgactaacggtacgtaagtttacgttttacgaacctaacgtttaacttacttacgttaccaaagtaacgttaaactttacgtaacgtttgttttaacccggaaccgtaaacgggtacctaaccgtaaacgttaactaaaacgttaaccgaagtttacggtacggactcgacgtaacctagttcttagttaccttcgtaaccttcccgttaccccgacttaacgtcccttgtaacccg

SEQ ID NO: 138880 - DNA, 616 bp, Homo sapiens
  misc_feature: GYAE6OF01AY1XI.46.67.G01.1.454.CMB.1.raw
  modified_base (187)..(187): a, c, t, g, unknown or other
  misc_feature (187)..(187): n is a, c, g, or t
  modified_base (189)..(189): a, c, t, g, unknown or other
  misc_feature (189)..(189): n is a, c, g, or t
  modified_base (192)..(192): a, c, t, g, unknown or other
  misc_feature (192)..(192): n is a, c, g, or t
  modified_base (196)..(196): a, c, t, g, unknown or other
  misc_feature (196)..(196): n is a, c, g, or t
  modified_base (208)..(208): a, c, t, g, unknown or other
  misc_feature (208)..(208): n is a, c, g, or t
  modified_base (220)..(220): a, c, t, g, unknown or other
  misc_feature (220)..(220): n is a, c, g, or t
  modified_base (564)..(564): a, c, t, g, unknown or other
  misc_feature (564)..(564): n is a, c, g, or t
tcagactagcagtacacgaccggtgctcgatttagagtatacatattgggtttggggagtctcggtcaggacacagcatggacatgagggtcccgctcagctcctggggctcctgctactctggctccgaggtgccagatgtgacatcgagctgacccagtctccatcctcctgtctgcacgtggancngtncacntcacttgccggnaagtcggaactnttcgactacctatttaaatgtatacaacatacgacgaggacgccctaagcctacgtaactctactcgctcgctactccgtagtttcgacgtaaggtcgggtcccagtcggtaggttcagtcggactagtcggatcgtggacaggtacttcgtactctacacctatcgaagtacttcgtacgaccttaaggtacgtaaagttctttaggactttaacttacgtttactacgtacaacgtaagtactttaactaactttcggtttaccgacgtaacgggtactaacggtaacttaaacgtaaacttaaacgtactggttacacgttacgacgtacctattaccgtntttaccgtacttaacgtccccgttttacccgatccgttacttcggtaaaccc

SEQ ID NO: 138881 - DNA, 642 bp, Homo sapiens
  misc_feature: GYAE6OF01DSUQH.46.67.G01.1.454.CMB.1.raw
  modified_base (212)..(212): a, c, t, g, unknown or other
  misc_feature (212)..(212): n is a, c, g, or t
  modified_base (233)..(233): a, c, t, g, unknown or other
  misc_feature (233)..(233): n is a, c, g, or t
  modified_base (247)..(247): a, c, t, g, unknown or other
  misc_feature (247)..(247): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcgggagaccctgtccctcacctgcgctgtctctggtncctcatcagtgtgtttctcgnggggctgggtccgnagctccgagggagggctggaatacattggaagtgtctctcattaggtggtacggttcctatttacaggttcccgtctctacaagacgtcgacgtcaacctatacttctctagaccacgtcagtcaatctcgttttccctagaagtataggtgttcgtgtcgaccgccgtctcgacgtacggtcgtttattacgtgtcgcgagaggacggtcttaagttgttacgttagtttttaggtaggtttgtttacgtttcgaaccgttacccgttaggtaccggtccgggtaccggggtccgttaccccggtacccgggtacgggggaccggtaacgggtaacgttaccggtaccgggtacccgtacccgttccttacccgttcggtccccgtaaccccgg

SEQ ID NO: 138882 - DNA, 843 bp, Homo sapiens
  misc_feature: GYAE6OF01C96RZ.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgccctcatcagtagtggtttctcgtgggctgggtccggcagctcccgaggggaaggggctggaatactagttggaagtcgtctctacagttaggtggtaggttcctaattaccgacgtccgtcgtctcaagagtcgagtccaccatactctcgtggaccacgtccacgacaaatctacgttttccccagaacgtagtgtagtttctaggtccgaacccgccgtacgtacggaaccgtaccggggttacgttttaacgttaacgttcggtggtaccggtaggaacggtaccggtacgtttaagtttagttggtttaagttttttaggggtaaggttttaggtttaacgttttaccgtacccgttaaacccgttaacggtacggtttaacccgggacggggggtcccgtacccgggtacccccggtacgggggtacccggtaacggggttaaacgttaccggtaccgggttacccgtacccgttacccgtttacccggttacgtcccccgttaaccccgtaaccccggtaaacccggggtacccccttaacggtttaccccccggggtttacccccgttttaccccccccggttacccgggtaaccccccttaccccccccggttaccccccttaacccccggtaaaccgggtaacccggttaaccccccccggg

SEQ ID NO: 138883 - DNA, 731 bp, Homo sapiens
  misc_feature: GYAE6OF01EVZFE.46.67.G01.1.454.CMB.1.raw
  modified_base (379)..(379): a, c, t, g, unknown or other
  misc_feature (379)..(379): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtccgggcccacgactgggtgacggccttcgggacgtacccctgttcccctcaccgtgccgtctcgtctcgtggtcgacctccatcagttagttggttttccttcggtggggtcctggggtcccgctacggtccgtccggaaggggaaggggtctaggtaatacctaggtttaggaagttcgtcgtctactaaggttaggtcggggttaacgtttcccttaagttaccgnggttcccgtctccgtacgaagtacggtcgaacgttccgaactactactcctcgtacggactaccgtacgaacgtactaacttctttacgggtttcccctaaggtaaagtacgttaggtaagtttccgtcgtaccggtacccgccgtacgtacgtaccggtaacgggttcgtttagtacgttggtagacggtaggacgtacgggtattacgttagttaggttacgttttaggagggtttgtttactttaccgaccgtacccgttaggaccgttcgggaccgggtcctacccggtaccgggtcgggacgtaggacctaacgcgtccgtcgttctcccgttagtcccctaaccgg

SEQ ID NO: 138884 - DNA, 709 bp, Homo sapiens
  misc_feature: GYAE6OF01B6CNB.46.67.G01.1.454.CMB.1.raw
  modified_base (199)..(199): a, c, t, g, unknown or other
  misc_feature (199)..(199): n is a, c, g, or t
tcagactagcagtacacgaccggtgctcgatttagagtatacatattgggtttgggagtctcggtcaggacacagcatggacatgagggtccccgctcagctcctggggctcctgctactctggctccgaggtgccagatgtgacatcgagctgaccctagtctccatccctccctgtacctgacctaaccggtggganacgagtcgtccaaccgataccgtacgttcggcccggggataacggtcggaaactagtttcgaacctaaaccttaattttaaaacgttgggtaacttaccaaacgtattaacggacccggtaagggacccggtaccctaaaggtcctaccgtaatcgtaactggcctgacctagttcctaaggtttcgacgtaaacggtcggtaccctagtcgtacggttacaggtcgagtcgtgacgttccgaggacctaaggtacttacgcgttacctacaacctagtacgtaagtactccgtaagtaccgtaaggacttaagttacgtttacgaactttacttacttaacgttcgtaacgtaacgtacgttaaattcgtaacgttcggtttaccggacggtaagtaccctaagtaaccttaaacgtaaaccgttaacgagttaggacgttacacgtaacccgcgttactacgttcggttaccttacgttactcccgttaccagtacgtgtaagtaccg

SEQ ID NO: 138885 - DNA, 684 bp, Homo sapiens
  misc_feature: GYAE6OF01BOHIF.46.67.G01.1.454.CMB.1.raw
  modified_base (193)..(193): a, c, t, g, unknown or other
  misc_feature (193)..(193): n is a, c, g, or t
tcagactagcagtacacgaccggtgctcgatttagagtatacatattgggtttggggagtctcggtcaggacacagaatggacatgagggtccccgctcagctcctggggctcctgctactctggctccgaggtgccagatgtgacatcgagctgacccagtctccatcctccctgtctgcaaccggtggganacagtgtcaccatcacttggccggcaagtcggaacattgacaccttatttaaatggtatacaacatacgaccgacgggaccggacccctaagcctacctaatctatcgctgctactccgtagtttcgacgtaaggtcggggtacctagtcggtaggttcgaggtgcgtaggtggacgtcggtacggactacgttacttacctactctaccactacgtacgtaattaactcgtacgaccgtaacgtaggtaattacgtttacgtaactttaacgtttaacttaccgttacgtaaccgtaaacgtaacgttaaacttaacgttaacgtttcgggttttaaccggaacccggtaaacggaacctaaccggtaaacttaaaccgttaaaacgttaaaccggtacgtagggtacgtacgtaccgacctaccgtattaccgttacttccttacttacccgttacccttacccgaccttagttacctgtaccgttacg

SEQ ID NO: 138886 - DNA, 582 bp, Homo sapiens
  misc_feature: GYAE6OF01B0U7R.46.67.G01.1.454.CMB.1.raw
  modified_base (193)..(193): a, c, t, g, unknown or other
  misc_feature (193)..(193): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtggganacagtgtcaccatcacttggccgggacaaggtcggaactattcgacaccttatttaaattggtatcaacatagaccagggaccgccctaagctacctaatctatgctgcactcctagtttgacgtaaaggtcggggtcccagtcgtaggttcgagtggcgaggtggatcgtagggactagtacttcactctacacatacagtaatctagactaacgtagtaattagtttagacttaaactttattactcgtaccaagtaataaacttacgtaatttcggtttacgacgtaaggactaacgacttaaacaaagttaacagtgtagtctgacctactataccttcgttacttacctacttcccgttacccgactacttccgtagttaaccg

SEQ ID NO: 138887 - DNA, 726 bp, Homo sapiens
  misc_feature: GYAE6OF01BURK5.46.67.G01.1.454.CMB.1.raw
  modified_base (219)..(219): a, c, t, g, unknown or other
  misc_feature (219)..(219): n is a, c, g, or t
  modified_base (230)..(230): a, c, t, g, unknown or other
  misc_feature (230)..(230): n is a, c, g, or t
  modified_base (253)..(253): a, c, t, g, unknown or other
  misc_feature (253)..(253): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatccctccctgtctgcaaccgtgggagacagtgtcaccatcacttggccgggnaagtcggaacntgacactattaaattgtatcaanatacgaccgagggaccgacccctaagccccttactaattctacgtcgtcgtcgactacttaccgttaggttacggaacggttaaacggggtccggtacctacggttacgggtacgttacggtacgtaggacgtaggtacggtacgttcgggtacgggtacgtaaggtttacctttaccctaaccgttcctacccgtaaacttacgtaacgttaaacgtttactccgtaacgtaaccgtaaccggtaagttaacgtttagtttaccgtaactttaaaccttttattaaccgttacgtaacctaaagtaacggtttaaacttaacgttaacgtttttcgggttaacccggaaccggttaacgggaacctaacgtaaacttaaacgtaaaccgttaacgagttacggcgtacgtacaccgtactacgttactcgttccttactaccgttccctaccccgatacgttcgtaagtacc

SEQ ID NO: 138888 - DNA, 587 bp, Homo sapiens
  misc_feature: GYAE6OF01DSOYL.46.67.G01.1.454.CMB.1.raw
  modified_base (157)..(157): a, c, t, g, unknown or other
  misc_feature (157)..(157): n is a, c, g, or t
  modified_base (177)..(177): a, c, t, g, unknown or other
  misc_feature (177)..(177): n is a, c, g, or t
  modified_base (217)..(217): a, c, t, g, unknown or other
  misc_feature (217)..(217): n is a, c, g, or t
  modified_base (351)..(351): a, c, t, g, unknown or other
  misc_feature (351)..(351): n is a, c, g, or t
  modified_base (403)..(403): a, c, t, g, unknown or other
  misc_feature (403)..(403): n is a, c, g, or t
  modified_base (562)..(562): a, c, t, g, unknown or other
  misc_feature (562)..(562): n is a, c, g, or t
tcagactagcagtacacgaccggtgctcgatttagagtatacatattgggtttgtcctcctgctggtggcagctcccagatgggtcctgtccctggtgcaactgcagggagtccgggcccacgactggtgaggcccttcggagacccctgtcccctnacctgcgctgtctctggtcncctcatcagtagttggtttcttcgtggggctgggtccggnagcctcccgaggggaaggggctaggaatacgagttgggaatgtcctctcagtaggtggtaggttctattacagtccgtctctcaagagtcgagtcaccatatctctggacacgtcagtcaatctagttttcccngaagatgagttcgtgtcgaccgcgctgacgacgggtctttattacgtgtcgngagagacggtactattatgttagtttggagttgttatttaccgactaccgtagtacgtcggtacgggtcctcggaccccgtcgggtaccgaagggtaattcgtgtccgaccgttctccttacgcctaccgaccgaccggcctcgtccgtcccttcccgnggtcccacctccactagcgtacccg

SEQ ID NO: 138889 - DNA, 711 bp, Homo sapiens
  misc_feature: GYAE6OF01BM76W.46.67.G01.1.454.CMB.1.raw
  modified_base (152)..(152): a, c, t, g, unknown or other
  misc_feature (152)..(152): n is a, c, g, or t
  modified_base (209)..(209): a, c, t, g, unknown or other
  misc_feature (209)..(209): n is a, c, g, or t
  modified_base (289)..(289): a, c, t, g, unknown or other
  misc_feature (289)..(289): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctnacctgcgctgtctctggtgcctcatcagtagtggtttcttcgtggggctgggtccgnagctccgagggagggctggaatacagttggaagtgtctctcagtagtggaggttcctattacagttccgtctctacaagngtcgagtcaccatatctcgtggacacgtcagctaatctacgttttccagtaagacttgacgtttcgtggtacgacccggtccgtcgtacggaaccgtacgggtacttttagttaaccgtggtacgcggaacggagtaccggtacttaagtttagttcggtttaagtttttcgggaagtttaggttttaacgtttacccgaactacccgttaagacgttaccgggtacgggggtccttaccgggaccccggttgggggacccgtaaggggtaacttaccggtcggttaccgacccgttcttaaccgttaccggtcccttaacccgaacccggtaaccgggcccctaacggttcccggttacccccttcccccggtacggtccccttaccccccttacccgtcccgaaacggtccgtaccccgg

SEQ ID NO: 138890 - DNA, 672 bp, Homo sapiens
  misc_feature: GYAE6OF01DLKYK.46.67.G01.1.454.CMB.1.raw
  modified_base (194)..(194): a, c, t, g, unknown or other
  misc_feature (194)..(194): n is a, c, g, or t
  modified_base (296)..(296): a, c, t, g, unknown or other
  misc_feature (296)..(296): n is a, c, g, or t
  modified_base (300)..(300): a, c, t, g, unknown or other
  misc_feature (300)..(300): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatccctccctgtctgcaaccggtggganacagtgtccaccatcacttcggaccgggcaagtcggaactattcgacaccttaatttaacttgtatcaacataacgaccagggaccgccctaagctactaanctangctgctatccagtttcgacgaaggtcgggtcccaagtcgtagttcagtcgcagtgatcgtaggactagtctttcacgtctaccgactatacaataactcgtacgaacgtacgttagtaaagtttagtttacgtaaaccttaacttttaacgttactacgttaacaaacgtaaggttaaactttaacgtaagttttcgggtttaaccgggacgtaaaacgggttaccaaacggttaaccgttaaaacgtaaaacgtttaaaccggaaccgttggtacggtacctaacggtaccctaaccgtaagttcccttaaggttaccctttaccgaccgtttcccgttaccccgaccttaacggttccttaggttaaccg

SEQ ID NO: 138891 - DNA, 626 bp, Homo sapiens
  misc_feature: GYAE6OF01BNSO7.46.67.G01.1.454.CMB.1.raw
  modified_base (195)..(195): a, c, t, g, unknown or other
  misc_feature (195)..(195): n is a, c, g, or t
  modified_base (229)..(229): a, c, t, g, unknown or other
  misc_feature (229)..(229): n is a, c, g, or t
tcagactagcagtacacgaccggtgctcgatttagagtatacatattgggtttgggggagtctcggtcaggacacagcatggacatgagggtccccgctcagctcctggggctcctgctactctggctccgaggtgccagatgtgacatcgagctgacccagtctccatccctccctgtctgcaaccggtggganacagtgtcaccatcacttgccggacagtcggacnttgacactattaaattggtatcaacatagaccgagggaccgccctaagctacctaatctatgctgcatcagtttagactaaggtgggtcccagtacgaggttcgaggtcggctaggtggtactggtagggactagtactttcactctaccaccgtaatactaagtaactcgtacgacgtaacgttagtaagttagttttagaccttaaactttacttaccgttagtaactaacgtaataaacttaacttaagtttcggtttaccggaaccgtaacgggaacctacgtaaacttaaactaaagttaaaccgaacgttggtacggtacgtagacccgtacctacgttaccttgttacccttctaccgtttcccttacccctactcgttcgtgttaaccg

SEQ ID NO: 138892 - DNA, 602 bp, Homo sapiens
  misc_feature: GYAE6OF01EG6R2.46.67.G01.1.454.CMB.1.raw
  modified_base (192)..(192): a, c, t, g, unknown or other
  misc_feature (192)..(192): n is a, c, g, or t
  modified_base (228)..(228): a, c, t, g, unknown or other
  misc_feature (228)..(228): n is a, c, g, or t
  modified_base (256)..(256): a, c, t, g, unknown or other
  misc_feature (256)..(256): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccgggcaaggtcgaacnttgactaccttatttaaatggtatcaanatagaccagggaccgccctaagctacctaatctatgctgacatccagtttgactaaaggtgggtcccagtcgaggttcagtggcagtgatcgtgggatagtattcactctcaccatacagtatctagacaacgtgtaagttagtttcgactaaactttacttacgttagtactaactaagtaactttaactaatttcgttttaccggaccgtaaagggtacctaacgtaacttaaactaaacttaaaccgtaacgttaggtacgtactacgtacctacgtacttacgttcgttacctttaccaaccgtttcccttaaccccgtaccttacttcgtacgttaacccg

SEQ ID NO: 138893 - DNA, 670 bp, Homo sapiens
  misc_feature: GYAE6OF01C1PDP.46.67.G01.1.454.CMB.1.raw
  modified_base (194)..(194): a, c, t, g, unknown or other
  misc_feature (194)..(194): n is a, c, g, or t
  modified_base (197)..(197): a, c, t, g, unknown or other
  misc_feature (197)..(197): n is a, c, g, or t
  modified_base (220)..(220): a, c, t, g, unknown or other
  misc_feature (220)..(220): n is a, c, g, or t
  modified_base (231)..(231): a, c, t, g, unknown or other
  misc_feature (231)..(231): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtcctccatcctccctgtctgcaaccggtggganacngtgtcaccatcacttgccggganaagtcgaactnttcgacactatttaaatgtatcaacatagaccagggacgaccctaagctacctaatcaatgctgctatcctagtttacgacgtaaacggtcggggtaccctagtcgtaggttcaggtcggtcaggtggacgtcgtagggaactagtactttacgacttacttccaactagtactaaggttaactacgtcggactaacggtagtaaagttacgtttttagaaccttaaactttaactttacgtacttaacctaaagtaacgtttaaatttaaccgtaattttacgggtttaaccggaaccgtaaacgggtacctaaccgttaataaactaaaaacgtttaacgaacgttagtacggtacgtaccgaacgtaacccttattaccggttcttaaccttcgtaactttccccgttaccctacctaacgttcctaagtaaaccg

SEQ ID NO: 138894 - DNA, 562 bp, Homo sapiens
  misc_feature: GYAE6OF01BYDMC.46.67.G01.1.454.CMB.1.raw
  modified_base (191)..(191): a, c, t, g, unknown or other
  misc_feature (191)..(191): n is a, c, g, or t
  modified_base (216)..(216): a, c, t, g, unknown or other
  misc_feature (216)..(216): n is a, c, g, or t
  modified_base (306)..(306): a, c, t, g, unknown or other
  misc_feature (306)..(306): n is a, c, g, or t
  modified_base (397)..(397): a, c, t, g, unknown or other
  misc_feature (397)..(397): n is a, c, g, or t
  modified_base (406)..(406): a, c, t, g, unknown or other
  misc_feature (406)..(406): n is a, c, g, or t
tcagactagcagtacacgaccggtgctcgatttagagtatacatattggggtttggggagtctcggtcaggacacagcatggacatgagggtccccgctcagctcctggggctcctgctactctggctccgaggtgccagatgtgacatcgagctgacccagtctccatcctcctgtctgcaaccgtgganacagtgtcaccatcacttgccgggnaagtcgaactattgactaccttatttaaagtgtatacaacatagaccaggacgccctaagctctaatctatgctgctatccgtaggtttnacgtaaaggtcgggtacccaagtcggtaagttcgaaggtcggacgagtggagtcgtaggggacagtatttcactctacacatcagtaatcngacaagtanaagtattagactaacttattactagtacaactagtaattagtaattgttacgactaaggacctaacgtaactaaagtaacttaaacgatcggtagtctagtacctaacgtagtactcgttcctactaccgttccttacccacttactcgtgtaacg

SEQ ID NO: 138895 - DNA, 666 bp, Homo sapiens
  misc_feature: GYAE6OF01AED2E.46.67.G01.1.454.CMB.1.raw
  modified_base (212)..(212): a, c, t, g, unknown or other
  misc_feature (212)..(212): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagacccctgtccctcacctgcgctgtctctggtcgcctccatcagtagttggtttctcgtggggctgggtccgnagcctccgaggggaagggctggaatacagttggaagtgtctctcagtaggtggacggttcctattacagttccgtctctacgaagtacgtcgagtccacctattactctcgtcggacacgtccagctaactcttacgtttccagaagtatgtagttcgtgtcgacccggccgcgtacgaccgtacgggttacttttacgttactggtagacggagacgtacgtacttattagttagtttagttttaggagtttacggttacttaccgacctacccgtagtacgtaccgggacggggtcctccggacccggtacgggaccgtaagggtactacgttacgtacccgtccgttactcccgtaccgccctacccgaaccggtacccggaccctaccggtcccgttccccttaccccggtcgtacccctacccctacccgtaccgacggccgtaccccg

SEQ ID NO: 138896 - DNA, 671 bp, Homo sapiens
  misc_feature: GYAE6OF01EPZ98.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatccctcctgtctgcaaccggtggagacagtcgtacacctatcgacttggaccgggacaaaggtaccggaaacagtttacgaacctaacctttaaattttaaaacgttggtaactacaaactataacgaaccgagggaccgaccctaagacctacctaatctatgctgactatcctagtttgacgtaaaggtcgggtacccagtcgaggttcaggtggcgtagtggatcgtggacagtattcactctacactatcgtagtatctagacgtaacgttagaagttactttacgacttaaacgtttattaaccgtgtaagaaactaattaaactttaacgtaagtttacggttttaccggaaaccgtaaagggtaacctaaacgtaaaccttaaagttaaaaacgttaaacgtaactagggtacgacgtacggtacctaacctagttaccgttcgttaccttacgtaacttccccgttaccccaccttaacttccgtacgttaaaccg

SEQ ID NO: 138897 - DNA, 798 bp, Homo sapiens
  misc_feature: GYAE6OF01BEKJ7.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtgggagacagtgtccaccatcacgttggcccgggacaagtccggaactattgaacctaccttattttaaattggtatacaacatagaccagggaccggaccctaagctacctaatctatgctgcacttccgtagtttgactaaaacgggttcggggtcccctaagttccggtaggtttccgaaggtcggacaggttggactcggtgggacgagttactttcgaccttcgtacctaacccgattacgtaacggttaacttccgttacgaacgtaacgggttaggtaacgtttacgtttttacggaacctttaaaccgtttactttaccgttaggttaacctaaacgtaacggtttaaactttaaccgttaacgtttttacgggtttaaccgggtaaaccccggtaaaggggtaacccgttaaacccggttaaaccttaaaacgttaaaaaccgtttaaaaccggtaaacgttaccgggttaacggtaccgttacccggtaaaccctaacccgtttaacgtttaacccgtttcggtttaaccctttaccgttaaaccgttttacccccttaccccgggttaaccccttacgtttacccgttaaggtttaaccc

SEQ ID NO: 138898 - DNA, 777 bp, Homo sapiens
  misc_feature: GYAE6OF01DVJAV.46.67.G01.1.454.CMB.1.raw
  modified_base (175)..(175): a, c, t, g, unknown or other
  misc_feature (175)..(175): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgagggccttcggacgaccctgtccctcacctgcgctgtctcgtggtcncctcatcagtagtgtttctcgtggggctcggggtccgcacgccgtccggaaggggacgggctaggaatacgtagttggaagtgtcctctcgtagtaggtggtacggttcctaattaccgtagtccgtctctacgaagcgtcgagtccacctatactctcgtagaccacgtccagactaatccttacgtttcccagtaacgtagttacgtacgtttctcggtaccggacccggtccccgacgtaccggaacggttaccggggtttactttttaacgttacgtggttacgaccggaaggacgggtacggtactttaagtttagttaacggtttagttttacgggtaggttttacggtttacgtttaccggtaaccctaccgtaacggtaccgtccggggtaccgggttacccgtacccggtacccgggtcggggtaaccgaacggggtaacttaccggtcggttaccgtcccgttaccctaccggttaccgtccccgaacccgtacccggaaccggtcccgtaccgtttccccggtccccgtttacccccggtcccggtaccccttacccccgttaaccctacccgacggtaccctcccccggg

SEQ ID NO: 138899 - DNA, 655 bp, Homo sapiens
  misc_feature: GYAE6OF01AXICA.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctcgtggtgcctccatcagtagtgtttctcgtggggctgggtccgcagctccgagggaaggggctggaatacgattggagtgtctctcataggtggtagttcctattacagtccgtactctacaagacgtcgagttccaacgattactcgtagtcggacaccgttccagacctaacgttaccgtacgttttcccgtaggaacgtagtagtacgtttcgtggtcgacccgtccgtcgtacggaaccgcgggttacgttttaacttaccgtggtcgacgggtaacgacggtacggtactttaagttagttggttagtttttgggagttttaggtttaactttccgaactacccgtagtacggtcgggtaccggggtctacccgggcccggtggggaccggtagggtaactcggtccggtactaccggttacctccgttacggcccttaacccgg

SEQ ID NO: 138900 - DNA, 817 bp, Homo sapiens
  misc_feature: GYAE6OF01D817P.46.67.G01.1.454.CMB.1.raw
  modified_base (338)..(338): a, c, t, g, unknown or other
  misc_feature (338)..(338): n is a, c, g, or t
tcagactagcagtacacgaccggtgctcgatttagagtatacatattgggtttgggggacctcctgtgcaagaacatgaagcaccttgtggtttgtcctcctgctggtggcagcctcccgagagttcgggtcctcgtcccgtggtcgacaacgtgcgagggcgtccgggcccagtacgtgggtgacggtccgttcggactccctcgtccctacaccgtgccgtctcgtctcgtcggtctacctcatcgtaggttgttcgtttctcggtcgggtcgtcgggtccgcgcgtccgtaccggaggggacggtctaggaatcgtagtagggattcgtctcganagttggcggtacgttctaacgtcgacgttcgtctctaagaacgtcgtcgtaacgtcctacctatcgttcctcggtacgacctacgtacacgtaactaacctcgtttaacgttcgaagtaactcgttcggttactttcgacggtaccgtaccccgggtctaaccggtacggttaaccggtacgggtttttaccttttaacgacggttcggtaccggacggtaacggtacggtccggttttaacttaaggtttcggtttaaggtttttacggtttacggggttaagttttacccggtttaaaccttccggttaaaacccgtccgggttaacggtaaccggggttcccgggtacccgggtacccggtaacccggggttccccggggtagggaaaccccggttaagggttaaaccttcccggggttaccttaaccccggttccgtttaccccggtttacgtcccccgtccggtaaacccccgg

SEQ ID NO: 138901 - DNA, 642 bp, Homo sapiens
  misc_feature: GYAE6OF01E3GKU.46.67.G01.1.454.CMB.1.raw
  modified_base (194)..(194): a, c, t, g, unknown or other
  misc_feature (194)..(194): n is a, c, g, or t
  modified_base (229)..(229): a, c, t, g, unknown or other
  misc_feature (229)..(229): n is a, c, g, or t
  modified_base (295)..(295): a, c, t, g, unknown or other
  misc_feature (295)..(295): n is a, c, g, or t
  modified_base (367)..(367): a, c, t, g, unknown or other
  misc_feature (367)..(367): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatccctccctgtctgcaaccggtggganacagtgtcaccatcacttgccggcaagtcggaacnttgacaccttattaaattggtatcaacatagaccagggaccggaccctaagcctacctaatctatnctgcactcctagtttgactaaaggtcggggtcccagtcgtaggttcgaggtggcgaggtggatcgtgggacngtatttcactctacacctatctataatctagcaacgtgtaagttattttagtaattagtactagtactaactagtaacttaactaacgtttcggttttacgggaaccgtaaaggggacctaaccggtaaaccttaaacgttaaaactttaaaccggtaaccgttaggtacgggtacgtaccgaaccgtaaccctacgtttaccgttacggttcctttacctaaccctttacccgtttacccccgaccgttaacttccgttaacgtacgtttaccg

SEQ ID NO: 138902 - DNA, 603 bp, Homo sapiens
  misc_feature: GYAE6OF01B1YA9.46.67.G01.1.454.CMB.1.raw
  modified_base (482)..(482): a, c, t, g, unknown or other
  misc_feature (482)..(482): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggcctttcggagaccctgtccctcacctgcgctgtctctggtcgcctcatcagtagtggtttctcgtggggctggggtccgctagcctccgagggagggctggaatacattggaagtgtctctcagtagtggtaggttcctattcagttccgtctctacgaagagtcgagtcaccattactctcgtggactacgtaccagtctaacttcgtagttttcccctaggtaaagtagttggtacgtttcgtcgtacggtaccgaccgtcgtacgacgtacgggtctttagttactgtgcgagacggtacgcttattntagttagttttaggagttgttagtttcacgtacctagcgtcggccgggtcctcggacccggttcgggacgtacgggtactacggttcgtacgacgttcccgtaccgtcgtcccgtaacccg

SEQ ID NO: 138903 - DNA, 571 bp, Homo sapiens
  misc_feature: GYAE6OF01BJQRX.46.67.G01.1.454.CMB.1.raw
  modified_base (211)..(211): a, c, t, g, unknown or other
  misc_feature (211)..(211): n is a, c, g, or t
  modified_base (384)..(384): a, c, t, g, unknown or other
  misc_feature (384)..(384): n is a, c, g, or t
  modified_base (445)..(445): a, c, t, g, unknown or other
  misc_feature (445)..(445): n is a, c, g, or t
  modified_base (450)..(450): a, c, t, g, unknown or other
  misc_feature (450)..(450): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtncctccatcagtagtggtttctcgtggggctgggtccggcagcctccgaggggaggggctggaatacattggaagtgtctctcatagtggaggttcctattacagtccgtctctacaagtgtcgagtcaaccatatctctggacacgtacagcaatctacgttttcccagaagntgtacgttctgtcgaccgtccgctgacgtcgggtactttatacgtgtgacgagaggacgtnttatntgttagttttggagttgtttatttccgactaccgtagacgtccggcggggtcctccgggaccccgtgggaccgtagggtaactcgtcggtacgtaccgttactccgttagccctaacccgg

SEQ ID NO: 138904 - DNA, 559 bp, Homo sapiens
  misc_feature: GYAE6OF01B0OE1.46.67.G01.1.454.CMB.1.raw
  modified_base (233)..(233): a, c, t, g, unknown or other
  misc_feature (233)..(233): n is a, c, g, or t
tcagactagcagtacacgaccggtgctcgatttagagtatacatattgggtttggggagtctcggtacaggacacagcataggacatggagggtccccgctcagctcctggggctcctgctactctggctccgaggtgccagatgtgacatcgagctgacccagtctccatcctccctgtctgcgaaccgtgggagacagtgtcaccatcacttggccggcaaggtcggaacnttgactacctatttaaattggtatacaacatagaccagggacggccctaagcctcctaatctatgctgcatcgagtttgactaaggtcgggtccagtcgagtcagtggagtgatcgtggacagtattcactcacacactcagtaactcgtagactaagtagtaagtatttacgactaacgtttatactgtaacaactataatttacaagttacgtttcgacgtaacgggactaacgtaataactaaagttaacgtaacgtgtacgctacgactaactcttacttacgttcttctacttccgttcccgactacgtctaggtactacg

SEQ ID NO: 138905 - DNA, 590 bp, Homo sapiens
  misc_feature: GYAE6OF01AP73I.46.67.G01.1.454.CMB.1.raw
  modified_base (193)..(193): a, c, t, g, unknown or other
  misc_feature (193)..(193): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtggganacagtgtcaccatcacttggccgggcaagtcggaacattgactaccttaatttaaattggtatcaacatagaccgagggaccgccctaagctacctatctatgctgcactccgtagtttcgacgtaaaggtcggggtacccctagtcggtaggttcgaggttggacgtaggtgggatcgtagggactaggtatttcactctacaccatactagtactctagactaacgtagtaagtactttagactaacttattactagtacaacgaagtaacttaactaagttcgtttacggaccgtaacggactaaccgtaactaactaaacgttaaacgtaacgtggtacgtacgtacgactactattctcgttactctacttccttacccactactcgtgtac

SEQ ID NO: 138906 - DNA, 511 bp, Homo sapiens
  misc_feature: GYAE6OF01B3J94.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtgggagacagtgtcaccatcacttgccgggcaagtcgaacattgacacctattaaatgtatcaacatagaccagggacggccctaagctcctaatctatgctgcatccagtttgcaaaagtggggtcccatcgaggttcagtggcagtggatctgggacagatttcactctcaccatcagtaatctgcaacgtgaagtattttgctaacgttattactatactaacataaattacaattgtttacgccaagggactacgaactaactaaattaacaacgtgtagctagcaccatctcgtcttcattccttcccacactctgtac

SEQ ID NO: 138907 - DNA, 840 bp, Homo sapiens
  misc_feature: GYAE6OF01DOX99.46.67.G01.1.454.CMB.1.raw
  modified_base (192)..(192): a, c, t, g, unknown or other
  misc_feature (192)..(192): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctnacctgcgctgtctctggtgcctccatcagtagttggtttcttcgtgggctgggtccggcagcctaccggagggaagggcgtaggaactacgtagttgggaagttcgtctcgtactaagttaggtacggtacggtttaccttaagtttaccgaacgttcccggttcttccgtaacgaaaggtacgttcggtaacgtaccgtaacccgtaagttactccgtacgtacggaacctaccgttccgaacggactaacgttccgtttaacgtttttcccaaggtaacgtacgttaggtacgtttacgttacggtacggaccccgtcgtcgtacggtaaccgtacggggtttacttttaacgttacggttggttcggacggtaacgggaacggtaccggttacttttaacgttacggttttaggtttaacgttttttagggacggtttttacgggttttaaccgtttacccggtaaacccgttacccgttaaaggttaccgggttacccgggggtaacccggggttacccgttaaccccgggtccccggggttaacggggacccggttaaacggggtaaccgttaaccgggttccggtaaccccgtacccggtttacccgtttaccccgttaacgtccccccgttaaaccccggg

SEQ ID NO: 138908 - DNA, 669 bp, Homo sapiens
  misc_feature: GYAE6OF01D73TY.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgacgtggtgaggccttcggacgaccctgtccctcacctgcgctgtctctggtcgccctccatcaggtagttggttttcttcgtggggcgtgggtccgcagcctccgagggaggtgcgtaggaatactagttggaagtgtctctcataggtggacggtttcctattacgacgtccgtctctacaagacgtcgaagtcaacatactctcgtgacacgtcagactaatctacgttttcccagtaagtattgtacgttccttggtccggacccgtcccgtcgtacggaccgtaccggggtttcttttaacgtttaccgtcggtggacggagaacggtacggtcttagttagttcggtttagttttagggtaggtttagttttacgttccgaacctaccggttaataccggttaccggggaccggggtccgtaccccggtaccccgggtacggggacccggtaagggtaacttacggtcggttaccctacccgttcccttcgtccgtacccccg

SEQ ID NO: 138909 - DNA, 619 bp, Homo sapiens
  misc_feature: GYAE6OF01DNJ2I.46.67.G01.1.454.CMB.1.raw
  modified_base (213)..(213): a, c, t, g, unknown or other
  misc_feature (213)..(213): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccagactggtgaggccttcggacgaccctgtccctcacctgcgctgtctcgtggtcncctccatcagttagttggtttcttcgtggggctcggggtccgcagccgtaccggaggggaacgggctaggaatacgtagttggaagtgtctctcagtagtggtacgttctattacgagtccgtctctacgaagtgtcgagtcacctatactctcgtagacacgtcagacaatctacgtttccagaagtgtagtagttcgtggtcgaccggtcgtcgtacgacgtacgggttctttatacgtgtcgacgagagtcgtattattagtgttagtttggtagtttcgttacttcgacctaccgtagtacgtcgggaccgggtccgtaccggtacccggtggggaccgtaagggtaaccgtacgttccgggtacctacccgttaccttcccgttaacgccccgtaacccgg

SEQ ID NO: 138910 - DNA, 620 bp, Homo sapiens
  misc_feature: GYAE6OF01AMWXC.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacgttggccgggacaagtcggaacattgactaccttatttaaattggtatacaacatagaccgagggaccgccctaagctacctaatctatgctgctatcctagtttgacgaaaggtcgggtcccagtcgaggtttcaggtggacagtggatcgtgggactaggactttcactctacacatcagtatctagcgaacgtgaaagttattttagaccttaattacttactacgtacaaacgtaagtaacttaactaagtttacggtttaccggaccgtaaacgggtactaaccggtaaaccttaaacgtaaacgttaaaccgtaacgttacggtacggtactacgacctaaccgtacttccgttcttaccgttaccttacgttccccttaccccgacttaccgttcgtagtaaccg

SEQ ID NO: 138911 - DNA, 586 bp, Homo sapiens
  misc_feature: GYAE6OF01DQRFR.46.67.G01.1.454.CMB.1.raw
  modified_base (191)..(191): a, c, t, g, unknown or other
  misc_feature (191)..(191): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaaccgtggganacagtgtcaccatcacttgccgggcaagtcggaacattgacacttatttaaatggtatcaacatagaccgagggacgccctaagcctactaatctatgctgcatcctagtttgacaaaggtcgggtacccagtcgtaggttcaggtgcagtgatcgtgggactagtatttcactctcacctatacagtaactctgactaacggtagtaagttatttagaacttaactttattacttagtaccaagtagtaaatttactaagtttcggtttaccggaaccgtaaagggtacctaacgtaacctaaactaaacgttaaacgaacttggtacggacttagacctaacctattccttcgttaccttactacttcccttaccccgattacttcgtgtaac

SEQ ID NO: 138912 - DNA, 545 bp, Homo sapiens
  misc_feature: GYAE6OF01D44DC.46.67.G01.1.454.CMB.1.raw
  modified_base (248)..(248): a, c, t, g, unknown or other
  misc_feature (248)..(248): n is a, c, g, or t
  modified_base (439)..(439): a, c, t, g, unknown or other
  misc_feature (439)..(439): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtgtttctcgtggggctgggtccgnagctccgagggaaggggctggaatacattggaagtgtctctcatagtggaggttcctattacagtccgtctctcaagagtcgagtcaccatactctctggacacgtccagacaatctacgttttcccagaagtatgtacgttctgtcgaccgccgctgacacgggtctttagttactgtgcgagacgacgnttatatgtattttggagttgttattcgactacctagactcggacggggtctaccggcccgtgggaccagggactacgtcggtccaccgtctcctgccctaacccgg

SEQ ID NO: 138913 - DNA, 583 bp, Homo sapiens
  misc_feature: GYAE6OF01EGAL4.46.67.G01.1.454.CMB.1.raw
  modified_base (248)..(248): a, c, t, g, unknown or other
  misc_feature (248)..(248): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctcgtgggctgggtccgnagctccgagggagggctggaatacgattggaagtgtactctcattagtggaggttcctattacagtccgtctctcaagagtcgagtcacatatctctggacacgtccagcaatctacgttttcccaggaatatgtagttctcgtcgaccgcgtctgacgtacgggtcgtttacttactggtcggacgtaggaggtacggtacttagtttagtgttaagtttttggagtttggtttacgtttcgactaccctaggacgtcggacggggtctacccggtacccgtggggaccgagggtaactcgtcggtcctaccgttcctccgttcgccctacccg

SEQ ID NO: 138914 - DNA, 561 bp, Homo sapiens
  misc_feature: GYAE6OF01CSFJD.46.67.G01.1.454.CMB.1.raw
  modified_base (525)..(525): a, c, t, g, unknown or other
  misc_feature (525)..(525): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatgtatcaacatagacagggacgccctaagctacctaatctatgctgcatccagtttgactaaaggtggggtacccctaagtcggtaggttcaggtggcaggtggatcgtgggaactagatttcacttctcaccatacagtaatctgactaacgtgaaagtattttagactaactttattactgtacaacgtaataattaacaatttcgtttaccggacgtaagggacctaacgtaacttaacaaaacttaacgaactgtagtctacgactacctatacttnttcttactacttcccttacccacctactctgtaacg

SEQ ID NO: 138915 - DNA, 743 bp, Homo sapiens
  misc_feature: GYAE6OF01E4IPC.46.67.G01.1.454.CMB.1.raw
  modified_base (172)..(172): a, c, t, g, unknown or other
  misc_feature (172)..(172): n is a, c, g, or t
  modified_base (257)..(257): a, c, t, g, unknown or other
  misc_feature (257)..(257): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagacccctgtccctcacctgcgctgtctctggtncctccatcagtagtggtttcttcgtggggctgggtccgcacgctcccgaggggaggggctaggaatacagttggaagtgtctctnatagtggaggttcctattacagtccgtctctcaagagtcgagtcaccatatctctgacacgtccagcaatctagttttcccctagaagtacgtagtacgttctggtcggaacccgtccgcctcggaaccgaccggggtcgtttttaagttaaccttgggtcgtacggtaaggacgggaaccgggtccttaatttaagttacgttaagttttttgggaggtttagggtttatttaccggtaacctacccgtaagtacgttcgggaaccgggggtcctacccgggaccccgttcgggggacccgaaggggtaaacttaccggttacggttaccgaccccggtttaccgttcccgttaacggtccccttaccccaaacccggtaaaccggggaccccctaacggttccccgggttacccgtttaccccccccggttcggtaccccctacccccttaccccgtaaccccaaacggtaaccgtacccccgg

SEQ ID NO: 138916 - DNA, 586 bp, Homo sapiens
  misc_feature: GYAE6OF01CPMSI.46.67.G01.1.454.CMB.1.raw
  modified_base (313)..(313): a, c, t, g, unknown or other
  misc_feature (313)..(313): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactgggtgaggccttcggagaccctgtccctcacctgcgctgtctctggtgcctccatcagtagtggtttcttcgtggggctgggtccgcagctcccgaggggaaggggctggaatacagttgggaagttgtctctcatagtggaggttcctattacagtccgtctctcaagagtcgagtcaccatatctcnggcacgtccagcaatctagttttcccagaagtatgagtttcgtgtgacccgccgctcgacgcgggtctttagtacgtgtgcgagagacggtctagttatgttatttttggagttggtttatttcgacctacccgtagtacgtcggacgggggtcctcggtaccccgtggggacccgtaggggtatacgtggtccaccgtctcctagccctcaccgacggcccacgttcccggtccttccccgtcggaccctaccctcccaccacgcgtacccg

SEQ ID NO: 138917 - DNA, 703 bp, Homo sapiens
  misc_feature: GYAE6OF01CK2WM.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtcctccatcctccctgtctgcaaccggtggagacagtgtcaccatcacttggccggacaagtcggaactattgactactaatttaaatggtatacgaactatacgaaccgtagggaccgtaccctaagacctacctaatctactcgctgactactacgtacgttcgacgtaaacggtcggtacctagtacgtaggttcgaggtcgacgtaggtgtatcggtagatacgtagttctacctctacgactaagtctaagtactcgtacgtacgtaacgttagtaacgttacgtttaggaaccttaagtttaacttacgtagttacgtaaacttaggtaaaccttataaccgtttggtttaccgaacggtaaacggtaaccgtaaccgtaaacttaaaccgttaaaacgttaaccggttaacgtaagggtttaccggaaccgttaccgaaacccgtaccgttaaattccggttaccgtttaccgttaccgttaaccgttacccccggttaacccgtacccttaaccgtttacgttaccgttaaccg

SEQ ID NO: 138918 - DNA, 612 bp, Homo sapiens
  misc_feature: GYAE6OF01BK3FO.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggacaagttcggaacattgacaccttatttaaatggtatacaacatagaccagggacgccctaagctacctaatctatgactgcatcctagtttagacgtaaaggtcgggtacccagtcggtaaggttcacggtggacaggtaggactcgtaggggactaagtactttccaactcttacgaaccatacaagtaatcgtagacgaacgtagtaaagttatttagacttaactttattactagtaactaaacaagtaagttaactaagtttcgtttaacggaccgtaaaggacctaacgtaactaaactaaagttaaacgaactagtacgacgtagtaccaacgtattcgtacgttccttactaacgtttccctaccccgtactaacttccttggtaacc

SEQ ID NO: 138919 - DNA, 695 bp, Homo sapiens
  misc_feature: GYAE6OF01AOF0H.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtcgcctccatcagtagtggtttctcgtgggctgggtccggcagcctcccgaggggaagggctaggaatacgagttggaagtcgtctctcagttaggtggtagttccttattacacgttccgtctctacaagcgtcgacgtcaaccgtatactctcgtacggactaccgtcagactaactcgttacgttttccagaagtctgtacgttctggtacgaccgccgtctacgtacgtacgggttctttactcgtgtcgacgagacggtacgtacttattagttgtttaggttttaggtaggtttagtttacgtttaccgaacctaccgttacggtaccgtcgggtaaccggggtcctacccggtacccggtacggggtacccggtaagggtaaccttacgggtcgttacccgtaccgttccgttaccgttacgtcccctaaccgtaacccggtacccgtccctaacggttcccgttaccccgttccccgtcgtacccctaccccgtcccgtaaccgacgtccgtaacccg

SEQ ID NO: 138920 - DNA, 650 bp, Homo sapiens
  misc_feature: GYAE6OF01DPN89.46.67.G01.1.454.CMB.1.raw
  modified_base (345)..(345): a, c, t, g, unknown or other
  misc_feature (345)..(345): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctcgtggggctgggtccggcagctcccgaggggaaggggctaggaatactagttggaagtgtctctcatagtggaggttctattacagtccgtctctcaagagtcgagtcaccatactctctggacacgtcagacaatctacgttttcccagaanagtgtagttctgtcgaccgcgctgacgacgggtctttagtacgtgtgcgagagacggtctagttagtgttagttttggagttggtttacttcgtacctaccgtagtacgtcgggacggggtcctaccggaccccgtggggaccgtaaggggtaacttacgtcgggtacctaccgttccgttacccgttacgccccgtaccgaacccggtaaccgggtcccctaacggttccccggtttaccccgttcccccccgtcgggtaaccccctacccccgttacccgacccgtaacggtccgtacccccg

SEQ ID NO: 138921 - DNA, 638 bp, Homo sapiens
  misc_feature: GYAE6OF01DLNCG.46.67.G01.1.454.CMB.1.raw
  modified_base (191)..(191): a, c, t, g, unknown or other
  misc_feature (191)..(191): n is a, c, g, or t
  modified_base (220)..(220): a, c, t, g, unknown or other
  misc_feature (220)..(220): n is a, c, g, or t
  modified_base (231)..(231): a, c, t, g, unknown or other
  misc_feature (231)..(231): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaaccgtggganacagtcgtcaccatcacgttggccggganaaggtcgaacnttgacacttatttaatgtatcaacatagaccagggaccgccctaagcctacctaatctatgctagcatccgtagtttgacgtaaaggtcgggtccagtcgtaggttcaggtgcgtaggtgagtcgtagggacagtactttcacgtctacgacctatctaagtatcgtgtactaacggtagtaagtttatttacgacttaacgtttacttacgtagtaacctaaagtacgttaaatttaacgtaagtttacggttttacggaaccgtaaacgggtacctaacgtaaccttaaactaaaagttaacgaacgttacggtaggacgttacgaccgtaacctattactttcggttacctttaccgtaccgtttaccccgtttaccccgtccttaagttcccgttagtaaccg

SEQ ID NO: 138922 - DNA, 715 bp, Homo sapiens
  misc_feature: GYAE6OF01B5AZG.46.67.G01.1.454.CMB.1.raw
  modified_base (215)..(215): a, c, t, g, unknown or other
  misc_feature (215)..(215): n is a, c, g, or t
  modified_base (237)..(237): a, c, t, g, unknown or other
  misc_feature (237)..(237): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtccgggcccacgactggtgacggccttcggacgacccctgtccctcacctgcgctgtctctggcncctccatcagtgttgtttctgnggggctgggtccgacagcctccggaggggacgggctaggaactacgtagttggaagtcgtactcgtcagtaggtagggtacggtttcctagttaaccgtggtccctcgtctacgaagtacgtcgagtaccactatagtctacgtaggaccaccgtcagactaacttactacgttttaccgagaacgtagtcggtagtttcgtcggtacgacccgtcgtacgttcggaaccggtacgggttacgtttaagtcgttggtacgacgtaggtaccggtacgttattaagttagttacgttttaggtttgggtaggttttcggtttaccttaccggtaacccgtacgttagttaccggaccggggtaccggggtcccttaaccccgggtcccgggttacgggaacggtacgggttaacgttaccggttaccggtacccgttacccgttcccttacccggttacccggccccttaaaccccggg

SEQ ID NO: 138923 - DNA, 775 bp, Homo sapiens
  misc_feature: GYAE6OF01BLL10.46.67.G01.1.454.CMB.1.raw
tcagactagcagtacacgaccggtgctcgatttagagtatacatattgggtttggggagtctcggtcaggacacagcatggacatggacgggtccccgctcagcctccgtggggctcctgctactctggctccggaggtgccagatgtgacatcgagctcgacccagtcctccacttccctccctgtctcgaccgaaccggtgggacacgtagtcgtaccacctattcgtacgttcggacccggggactaagggtaccggaactagttacgaacctaacctttaaattttaaagttggtaactacaaactacgtaacggaccggacgggacccgtaccctaacgcctacctaactctatcgtctcgactacttccgtaggtttacgaacggtaacggttccggggtaccctacggttacggtacggttacggaggtcgggacgtagggtaggtacgttcggtacgggaactagttaactttccgtacgttacctaacctaaccgttaactaacgttaagttaacgtccggttacgtaacgtaaccggttaagttaaacgtttacgttttacgtaaacgtttaactttaacgttacgttacgtaacctaaacgtaacgttaactttaacgttacgtttacgggttacgaacgtaacggacctaacgtaaacttaaacgttaaacgtaacgtacgtaggtaccgtactacgtaacctcgtacgttcgttcttaccttaccgtacgttaccccgtacgttactacttccgtagttacc

SEQ ID NO: 138924 - DNA, 722 bp, Homo sapiens
  misc_feature: GYAE6OF01ESV77.46.67.G01.1.454.CMB.1.raw
  modified_base (219)..(219): a, c, t, g, unknown or other
  misc_feature (219)..(219): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtccgggcccacgacgtggtgacggccttcggacgaccctgtcccctcaccgtgcgctgtctcgtggtcncctcatcagtagttggtttctcggtggggctcggggtccgcacgccgtaccggaggggaacgggctaggaatacgtagttggaagtgtctctcagtaggtggtacggttctattacgacgttccgtctctacaagtacgtcgacgtacactatactctcgtacgactacgtacagactaactcttacgttttcccagtaagtatgttacgttcgtcgtaccgaccgtcgtcgtacggaaccgtacgggttcttttaacgttcgtgtaggtacgtagacgtacggttacttagttagttagtttaggttttacgggtagtttacggtttacttaccggtaaccgtaccggttaaggtaccgggttacccggggtaccggggtacccgttaaccccgggtaccccgggtaggggaacccggtaaggggttaaacccttcggttacccgggttaccctacccggtttacccgttcccgtttacccggaccccgttaaacccccggg

SEQ ID NO: 138925 - DNA, 701 bp, Homo sapiens
  misc_feature: GYAE6OF01D2RMG.46.67.G01.1.454.CMB.1.raw
  modified_base (190)..(190): a, c, t, g, unknown or other
  misc_feature (190)..(190): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaaccgtgganacagtgtcaccatcacttgccgggcaagtcgaacattgactacctatttaatgtatcaacatagaccagggacggccctaagctacctaatctatgctgctatccgtagtttcgacgtaaaggtcggggtaccctagtcggtaggtttcaggtggcaggtgatcgtgggactaaggtactttacacgttcctacacctattaccgtaagttaactcgtacgaccgtaaacggttagtaaagttacgttttacgaaccttaaaccttttaactttaaccgttacgtaacctaaacgtaaggttaaacttttaaacgtaacgtttttcgggtttttaacccgggaacccgtaaaaggggtaacccgtaaacgtaaacctttaaaccgtaaaacgtttaaaccggtaacgttaggttcgggtaccctttagacccgtaaccttacttaccgttcggttaccctttactaaccgtttcccttaccccccggacttaccgtttcgtagttaacccg

SEQ ID NO: 138926 - DNA, 727 bp, Homo sapiens
  misc_feature: GYAE6OF01BLDWX.46.67.G01.1.454.CMB.1.raw
  modified_base (191)..(191): a, c, t, g, unknown or other
  misc_feature (191)..(191): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaaccgtggganacagtgtcaccatcacttggccgggcaagtcggaacattcgacacttattaaattgtatcaacatagaccagggaccgccctaagctcctaatctatgctgctatccgtagtttcgacgtaaaggtcggggtacccaggttacgtaggtttccgaaggttcgggacgtaggtcggtaagttccgtagggggtaaactacggttaacttttccgaaccgttaccgttacccgtaacctaaacgttacccgtaagtttaaacgttccgttaggaacccgttaaacggttaggtaaacgttaagtttttacgaacctttaaacgtttaagtttacctacggtaacctaaacgtaacgttaaacgtttaacgtaaacgtttcggttttaaccgggaaccggtaaacgggtaacctaacggtaaccttaaacgtaaacgttaaaaccgtaatacgggtagtacgtacgtacctaaccgtattaccttcggttaccttacgtaacttcccgtttaccccaccgttaacttccgtggtaaacc

SEQ ID NO: 138927 - DNA, 584 bp, Homo sapiens
  misc_feature: GYAE6OF01DW1OE.46.67.G01.1.454.CMB.1.raw
  modified_base (253)..(253): a, c, t, g, unknown or other
  misc_feature (253)..(253): n is a, c, g, or t
  modified_base (318)..(318): a, c, t, g, unknown or other
  misc_feature (318)..(318): n is a, c, g, or t
  modified_base (383)..(383): a, c, t, g, unknown or other
  misc_feature (383)..(383): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactgggtgaggccttcggagaccctgtccctcacctgccgctgtctctggtgcctccatcagtagttggtttcttcgtggggctgggtccgnagcctccgagggaagggctggaatacgagttggaagtgtctctcatagtggagttcctattacgngtccgtctctcaagagtcgagtcacatatctctgacacgtcagcaatctacgttttcccagtaanagtgtagttctgtcgaccgcgctacgacgtacgggtctttacttgtgtgcgagaggcgtctattatgttagttttgagtttgttatttcgaactaccgtagtacgtcgggaccgggtctaccggtacccggtggggacccgtagggtaactaccgttcggtacccgtaccgttacgttacccttacggcccctaaccccgg

SEQ ID NO: 138928 - DNA, 734 bp, Homo sapiens
  misc_feature: GYAE6OF01BBFK6.46.67.G01.1.454.CMB.1.raw
  modified_base (223)..(223): a, c, t, g, unknown or other
  misc_feature (223)..(223): n is a, c, g, or t
  modified_base (360)..(360): a, c, t, g, unknown or other
  misc_feature (360)..(360): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtccgggcccaggactgggtgacggcccttcgggacgacccctgtcccctcgacctgccgtctgtctctggtcncctcatcgagtgtggtttctcgtggggctcgggtccgcaggcctacccggaggggaacggggtctagggaaatacgtagttagggaagtgtctcgtacagtaggtaggtacggtttcctaattaccgtagtcccgtntacgtactaagtacgtacgacgtacaacctattacctctcgacggacgaccgtaccaagtactaactcgttaaccgttttcccgaaggtaaactacgttagttacgttcggtacgttaccgaccccggttccgacttacggtaccggtacgggttaccttttagttacgttcggtagtacggaacgtaggtacggtacttaagtttacttggtttaggtttttgggacgtttttaggttacgttaccaaccgtacgtacgtacggtccggggtccggggtaccgtccccgggtacccggtggggacccggaagggtaaccgttacgtccggtaacccggtacccgttaccgttacccgtccgtccctaacccgg

SEQ ID NO: 138929 - DNA, 766 bp, Homo sapiens
  misc_feature: GYAE6OF01EEC53.46.67.G01.1.454.CMB.1.raw
  modified_base (174)..(174): a, c, t, g, unknown or other
  misc_feature (174)..(174): n is a, c, g, or t
tcagactagcagtacacgaccggtgctcgatttagagtatacatattgggtttgtcctcctgctggtggcagctcccagatgggtcctgtccctggtgcaactgcaggagtccgggcccacgactggtgaggcccttcggagacccctgtccctcacctgcgctgtctctggtncctccatcagtagtggtttctcgtggggctgggtccggcagcctcccgaggggaaggggctaggaatacagttagggagtgtctctcaagtaggtggtacggttcccttaattacgacgttccgtctctacaagtagtcgagtaccaccatactctcgtggacacgtccagactaactctacgttttacccagaagtagttacgtagtttccgtggttacgacccgtcccggtactcggaaccgtaccggggttcttttaacgttacgtggtcgacggaaggacgtaccggtacgtttaatttagttaggtttaaggtttttagggtaggtttacggttttaactttaccgaacccttaacccgtaggtaaccggtcgggtaaccggggtccgtacccgggtacccggtacgggggaaccggtaaggggtaacgttacgtccgggttacctacccgggttcttacccgttaccggtcccctaacccggtaacccggaaccgggtccccgttaacggttccccggttaccccgtttccccccggaccgttacccctaccccgttacccgtaccgaaaccgtcccgtaccccgg

SEQ ID NO: 138930 - DNA, 608 bp, Homo sapiens
  misc_feature: GYAE6OF01EVJ3O.46.67.G01.1.454.CMB.1.raw
  modified_base (214)..(214): a, c, t, g, unknown or other
  misc_feature (214)..(214): n is a, c, g, or t
  modified_base (252)..(252): a, c, t, g, unknown or other
  misc_feature (252)..(252): n is a, c, g, or t
  modified_base (331)..(331): a, c, t, g, unknown or other
  misc_feature (331)..(331): n is a, c, g, or t
  modified_base (384)..(384): a, c, t, g, unknown or other
  misc_feature (384)..(384): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactgggtgaggccttcggagaccctgtcccctcacctgcgctgtctctggtcncctccatcagtagtggtttctcgtggggctgggtccgnagcctccgagggaagggctggaatacattggaagtgtctctcatagtggaggttcctattacagtccgtctctacaagngtcgagtcaccatatctctgacacgtcagacaatctacgtttcccagaacgtntgtagttctgtacgaccgccgcgtgacgacgggtcttttaagtactggtcgacgtaggacgacggtacttagttagtggttagtttttgggaggttggttttactttacgacctacctaaggtgttccgggacggggtcctacccgggacccggtggggaccgtagggtaacttacgtacgggtacctacccggttaccctaccgttaccgcccgtaaccccgg

SEQ ID NO: 138931 - DNA, 810 bp, Homo sapiens
  misc_feature: GYAE6OF01EUW6K.46.67.G01.1.454.CMB.1.raw
  modified_base (154)..(154): a, c, t, g, unknown or other
  misc_feature (154)..(154): n is a, c, g, or t
  modified_base (175)..(175): a, c, t, g, unknown or other
  misc_feature (175)..(175): n is a, c, g, or t
  modified_base (196)..(196): a, c, t, g, unknown or other
  misc_feature (196)..(196): n is a, c, g, or t
  modified_base (209)..(209): a, c, t, g, unknown or other
  misc_feature (209)..(209): n is a, c, g, or t
tcagactagcagtacacgaccggtgctcgatttagagtatacatattgggtttgtcctcctgctggtggcagctcccagatgggtcctgtccctggtgcaactgcaggagtccgggcccacgactggtgaggtccttcggagaccctgtccctnacctgcgctgtctcgtggtcncctcatcagtgtgtttctcgngggctgggtccgnagctccgaggggaacggctaggatactagttggatgtctcacagttagtgacgttctaatactagtccgtctctacgaagtcgtcgaggttaccaaccgtattacgttaccgtccgtacgggtaaccctacggtacccaacggtacctaaaacgtttccgttaaccgtttttacccgaaggtaaacgtacgttaggttaacgtttccgtacggtaccggtacccgtaccgtcgttacggtaaccggttaaccgggttacgttttaaacgtacgttaggttacggtacggtaacggtaacggttaccggttaacttaagtttacgtttaaggtttaacggtttttacgggtaaggtttacggttttaactttacccggaacccgttaaccgttaggtaccggttcggggacccgggttacgtacccggtaccggtcgggtaaccgtaagggtaacgtcggttaccggtaccgttaccggttccttacgggtaccctacccgtacccgaaccggggtaccgttacccacggtttccccggttacccccgtacccggtccgtaaccctaccccggtaccctaaccggacgtacccggtaccccg

SEQ ID NO: 138932 - DNA, 677 bp, Homo sapiens
  misc_feature: GYAE6OF01BUFKN.46.67.G01.1.454.CMB.1.raw
  modified_base (234)..(234): a, c, t, g, unknown or other
  misc_feature (234)..(234): n is a, c, g, or t
  modified_base (245)..(245): a, c, t, g, unknown or other
  misc_feature (245)..(245): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatagtcgacgatcccgaggctcgtaccgagtccgtcctagtcctaccgtgtcctagacgaaccgtggagacagtcgtcaccatcacttgccgganaagtcggaacnttagacaccttatttaaactggtatacaacatacgaccagggaccgaccctaagctacctaatctatcgactgctactccgtagtttcgacgaaaggttcggggtaccccaaggtttccgtaacgggttctaagggttcggaccgtaggtacgggtaagtcccggtaggggtaacctaggtactttccgaaccttcgtacctaacgtacttacgaagttaactcgtacgtacgtaacgtaggtaactagttacgacttaacttattactgtaccgtaatacgtaacttacgtattaccggtttacgaaccgaggtaacgtaaccgtaacttaaacgtaaacgttaacggaaccttgggtacgccgttaacgaccttaccgaacttcggtccttcttaaccgtacttcccgttccgacctactgtcgtaaccg

SEQ ID NO: 138933 - DNA, 779 bp, Homo sapiens
  misc_feature: GYAE6OF01EY7D9.46.67.G01.1.454.CMB.1.raw
  modified_base (197)..(197): a, c, t, g, unknown or other
  misc_feature (197)..(197): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactgggtgaggccttcggagaccctgtccctcacctgcgctgtctctggtgcctccatcagtagtggtttcttcgngggctgggtccgcagcctccgaggggagggctaggaatacgagttgggaatgtcctcgtcagttaggtggaggtttcctaattacagttcccgtctctacaagagtcgagtccactatactctcgtggacaccggtccagacaatcgtacgtttttccccagtaagtatcgtagtttcgtgtcgaccgtccgtctggacgtaccgggtcgttttactacttggtcgtcgaaggacggtaccggtactttaattacgttaggtttaagtttttagggacggtttaggttttaacgttttacccgtaaaccgttaccccgttaagtaccgggttaccgggaccgggggttcccgtacccgggtacccccggtacgggggacccggtaacggggtaacgttaccggttacgggtacccgtacccggttcccgtttacccgttaccgtacccccgtaccccggtaaacccgggtaaccgggtaccccgttacccggttcccggtttacccccgttaccccccggtccggttaaccccccttacccccgtacccctttaacccggtaaaccggccgtaacccccggg

SEQ ID NO: 138934 - DNA, 734 bp, Homo sapiens
  misc_feature: GYAE6OF01DIWMH.46.67.G01.1.454.CMB.1.raw
  modified_base (249)..(249): a, c, t, g, unknown or other
  misc_feature (249)..(249): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtccgggcccagactgggtgacggccttcggacgacccctgtcccctcacctgccgtctgtctcgtggtcaccctccatcagttagttcggtttcttcgnggggctgggtccgcagccgtccgaggggagggctacggaatacgtagtaggagtcgtctctctagtaggtggtacgtttctattacgacgtccgtctctacaagtagtcgagtaccacgtactattctgtacgacaccgtcagtacaacttcgtacgttttcccgagaagtacgtgtagttacgtcggtacggtccccgccgtacgtacggaccggtaccgggttcgtttaattaccggtggtacggtacggaggtacggtaccggttactttaagttaggttaggtttagtttttagggtaggtttacggttttaattacccgaacccgttaccgttaacgtaccggtaccgggggtcccggggacccttaccccgggtacccccgggtagggggtacccgtaaaggggttaaccgttccggttaccggttccccggttaccctacccgtttacccggttacccggccccgttaaacccccggg

SEQ ID NO: 138935 - DNA, 601 bp, Homo sapiens
  misc_feature: GYAE6OF01C6MMP.46.67.G01.1.454.CMB.1.raw
  modified_base (217)..(217): a, c, t, g, unknown or other
  misc_feature (217)..(217): n is a, c, g, or t
  modified_base (282)..(282): a, c, t, g, unknown or other
  misc_feature (282)..(282): n is a, c, g, or t
  modified_base (381)..(381): a, c, t, g, unknown or other
  misc_feature (381)..(381): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtgggagacagtgcaccatcacttgccgggnaagtcggaacattgacactatttaaatgtatcaacatagaccagggacgccctaagcctactaancgtatgactgctatccaagtttgactaaagggtgggtacccaagtcgaggttcagtggcagtgatcgtgggaacagtatttccacttctccaaccgtanacctagtaatctgactaacgtagaagttatttagaacttaacttagtttactagtactaacaacgtaatttaacgtaacgtttggttttaacggaccgttaacgggaactacgtaacctaaactaaacttaaaccgaacgttaggtacgggtctacgacctacctagttacttacgttccttacgttacttcccttacccgacctaacttcgtagtaacc

SEQ ID NO: 138936 - DNA, 804 bp, Homo sapiens
  misc_feature: GYAE6OF01AUSHZ.46.67.G01.1.454.CMB.1.raw
  modified_base (173)..(173): a, c, t, g, unknown or other
  misc_feature (173)..(173): n is a, c, g, or t
  modified_base (211)..(211): a, c, t, g, unknown or other
  misc_feature (211)..(211): n is a, c, g, or t
  modified_base (294)..(294): a, c, t, g, unknown or other
  misc_feature (294)..(294): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcgggagaccctgtccctcacctgcgctgtctctggtcncctccatcagtagtggtttctcgtggggctgggtccgnagcctccgaggggaagggctaggaatacagttggaagttgtctctcagtagtggaggtttcctattacagtcccgtcttctanaagagtcgagtccacctatatcctctggaccacgtccagcaatctacgtttccagaagtatgtagttctggtacgacccgccgtcgtcgaacgacgggttacttttaataccgtggtcggacggaggtacggtaccggtacttaagtttagtacgttttagttttagggtaggtttacggttttaacgttttaccgaaccgttaacccgttaaggtaccggttaccgggggacccgggggttacctaccccgggttaacccccgggtagggggtaaccccggtaaaggggtaaccgtttaccggttaccgggttaacccgtaccccggtttccgttaccccggtttaccggtaccccccttaacccggaaaccccgggtaacccggggtcccccttaaccgggttccccgggtttacccccccgtttacccccggttacccggggtacccccctaaacccccccggtttccccgtaaacccccgtaaaggggtacccccgtaacccccgg

SEQ ID NO: 138937 - DNA, 729 bp, Homo sapiens
  misc_feature: GYAE6OF01BCMFI.46.67.G01.1.454.CMB.1.raw
  modified_base (197)..(197): a, c, t, g, unknown or other
  misc_feature (197)..(197): n is a, c, g, or t
tcagactagcagtacacgaccggtgctcgatttagagtatacatattgggtttggggagtctcggtcaggacacagcatggacatgagggtccccgctcagctcctggggctcctgctgctctggctccgaggtgccagatgtgacatcgagctcgacccagtcctccactccctccctgtctgccaaccgtggganacagtgtcaccatcacgttcggccgggacaacggtaccggaactacgttcgaacctaacctttaaattttaaaagttggttaactaccaaactataacggaacccggaacggggacccggtaccccctaaggcccttacctaaattcctatcgctgcctactcccgtaggtttcgaacggtaaagggtccggggtaccctacgtacggtacggtttcgaggtcggacgaggtcggtactcggtagggacctaggtactttaccacttctaccaacctatacctaagttaacttcgtcgtaacgtaacgttagtaaagttactttagaaccttaacgtttaactttaacttacgtaactaacgtaagttaattaacgttaagtttaccggttttaccggaaccgtaaagggtaacctaacgtaaccttaaacgtaaaacgttaaaccggtacgttaggtaccgacgtacggacctaacctacgttccgtcgttacctttacttaccttcccgttacccctactcgttcgtacg

SEQ ID NO: 138938 - DNA, 558 bp, Homo sapiens
  misc_feature: GYAE6OF01EL5OH.46.67.G01.1.454.CMB.1.raw
  modified_base (335)..(335): a, c, t, g, unknown or other
  misc_feature (335)..(335): n is a, c, g, or t
  modified_base (548)..(548): a, c, t, g, unknown or other
  misc_feature (548)..(548): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggaaggggctggaatacattggaagtgtctctcatagtggaggttcctattacagtccgtctctcaagagtcgagtcaccatatctctggacacgtccagcaaatcagttttcccngaagatgagttctgtcgaccgccgctgacacggggtcttttatactgtgcgagagacggctattatgtagttttggagttggtttatttcgactacccgtagacgtcggacggggtctccgaccccgtggggccagggactacgtggtcaccgttcctcgttacgccctccgaccgacggcccagtccgtcccttccccgtgcccaccctccnccaagcgccc

SEQ ID NO: 138939 - DNA, 743 bp, Homo sapiens
  misc_feature: GYAE6OF01DRJS7.46.67.G01.1.454.CMB.1.raw
  modified_base (224)..(224): a, c, t, g, unknown or other
  misc_feature (224)..(224): n is a, c, g, or t
tcagactagcagtacacgaccggtgctcgatttagagtatacatattgggtttggggagtctcggtcaggacacagcatggacatgagggtccccgctcagctcctggggctcctgctactctggctccggaggtgccagatgtgacatcgagctgacccagtctccatcctccctgtctgacaaccggtgggagacagtgtcacctatcacttggcccggganaacggtcggaacattgacaccttaatttaaatggtatcaacatacggaccagggaccggccctaagcctactaatctatgctgactactccgtaggtttgacgaaggttcggggtaccctaagtccggtaggttcaggttggactaggtcggatcggtaggggtacaaggttactttccaaccttcgtaaccacctagttacctaaggttaattacgttcgaaaccgttaaggtaaggttaaatttagttttacggtaaacctttaacgttttaactttacgtacgttaaccgtaaactagttaaaacttttacgtaacggttttcgggtttaacccggaaccggttaaagggaaccttaacggtaaaccttaaaacgttaaaacgtttaaccggaagttacggtaccgggtacttacgggaccccttaaactacgtttacgtttaccgtttaccgtttaaccctaccgttttcccgttaaccccccggtactttaacgtaccggttattaaacccggg

SEQ ID NO: 138940 - DNA, 682 bp, Homo sapiens
  misc_feature: GYAE6OF01ALAJC.46.67.G01.1.454.CMB.1.raw
  modified_base (618)..(618): a, c, t, g, unknown or other
  misc_feature (618)..(618): n is a, c, g, or t
  modified_base (644)..(644): a, c, t, g, unknown or other
  misc_feature (644)..(644): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtgggagacgagtgtccacctaatcacgttcggccgggacaaaggtcggaaactacgtttacgaacctaaccttaatttaaaacttggtaactacaaacataacgaccgaaggggtaccgacccgtaaagcctaccttaaataccttaagtgactcgtactacgttaccgacggttttacggaactaaacgggttcggggtacccaagttcggtaagggttacgaagttcgggactaggtggtatcggtacgggaactagtattacctactacactaacctatacgtaagttaactctactaccgaaaggttcgtaaagttagtttacgaactttaaacttactttacggtacgtaactaaacgaagttaaacttataaacgtttcggttacgacggtaaggacctagaaactaataaagttaaccagtagnggtaccacgtaccacctgttaccgtnttacttctacctaccgtccactaacttcgaattaaccg

SEQ ID NO: 138941 - DNA, 567 bp, Homo sapiens
  misc_feature: GYAE6OF01CE9A5.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacgccctaagctctaatctatgctgcatccagtttgcaaagtgggtcccatcgagttcagtggcagtgatcgtgggacagactttcactctcacctatcagtaatctagcaacgtgaagtatttagactaacttattactgtacaacagtaattactaagttcgttttacggaccgtaagggacctaacgtaaccttaaactaaagtttaaaccgaacgttaggtaggtactacggacctaacctattacgttcgttaccttacgtacttcccgttccccgacctaacttccgtagttaacg

SEQ ID NO: 138942 - DNA, 733 bp, Homo sapiens
  misc_feature: GYAE6OF01CAWDT.46.67.G01.1.454.CMB.1.raw
  modified_base (172)..(172): a, c, t, g, unknown or other
  misc_feature (172)..(172): n is a, c, g, or t
  modified_base (444)..(444): a, c, t, g, unknown or other
  misc_feature (444)..(444): n is a, c, g, or t
tcagactagcagtacacgaccggtgctcgatttagagtatacatattgggtttgtcctcctgctggtggcagctcccagatgggtcctgtccctggtgcaactgcaggagtcgggccacgactggtgaggccttcgggacgaccctgtccctcacctgcgctgtctctggtncctccatcagtagtggtttctcgtgggctgggtccgcagctccgaggggaagggctaggaatacgagttagggaagttcgtcctctacgtaagttaaggtgggtaacggttttcctaagtttaaccgacggttccgtcttactccaaaaggtcgtcggacgttccaacctataacttcctcgtacgggaactaccggtccaagacctaaagttcccgttaacgtttttcccaggaaacgtattggtaacgtttcgtggcgaacccgcccgtntaggaacccgtacgggtctttttaagacgtggtacggacgtaacggacggtaacgtacttaagtttagtacgtttaagtttttagggaacgtttggtttactttcgaaccgtacctaggtacgtcggaccggggtctacccggtacccgtcggggaccgtaagggtaacgttacgtcggtacccgtaccgtccttaccgtacgtacccctccgaaccgaaccgggtccctacgtcccggttccctccccgtacggtacccctacccgtcccaccgtaagcccgtacccg

SEQ ID NO: 138943 - DNA, 695 bp, Homo sapiens
  misc_feature: GYAE6OF01B9L5X.46.67.G01.1.454.CMB.1.raw
  modified_base (171)..(171): a, c, t, g, unknown or other
  misc_feature (171)..(171): n is a, c, g, or t
  modified_base (349)..(349): a, c, t, g, unknown or other
  misc_feature (349)..(349): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtncctccatcagtagtggtttcttcgtggggctgggtccgcagcctcccgaggggaaggggctaggaatacagttggaagtgtctctcatagtggtagttcctattacagtccgttctctcgaagtgtcgagtcaccatatctctggaccacgtcagtcaatctacgtttcccagaagtntagagttctgtacgacccgccgtctacggaaccgtacgggttcgttttaacttacgtgtggacgtaggacggtacggtacttaatttagttagtttagtttttgggtagtttaggttttagtttaccggtaacctacccgtaaggtaccgttacgggaccggggtacctcccggtaacccggtcggggacccggtaagggtaacttaccggttacggtaccgtacccgttcccttccgttaccgtcccgtacccgaaccggtaaccgggtcccctacggttcccggttccccctttcccccggcggttacccccaccccgttcccaaccgtaacggccgtaccccg

SEQ ID NO: 138944 - DNA, 594 bp, Homo sapiens
  misc_feature: GYAE6OF01BT9DG.46.67.G01.1.454.CMB.1.raw
  modified_base (171)..(171): a, c, t, g, unknown or other
  misc_feature (171)..(171): n is a, c, g, or t
  modified_base (285)..(285): a, c, t, g, unknown or other
  misc_feature (285)..(285): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtncctccatcagtagtggtttctcgtgggctgggtccgcagctccgagggagggctggaatacagttggaagtgtctctcatagtggaggttcctattacagtccgtctctcaagngtcgagtcaccatatctctggacacgtccagcaatctacgttttccccagaacgtagtgagtttctgttgacccgccgcgtgaccgtacgggtcttttaacgtcgtaggtcgacgagacggacggtcttagttatgttattttggagttggttacttcgactaccgtagacgtcggacggggctacggacccgtggggacctagggaactacgtcgtacgaccgtcttccgtacgtccctacccgaaccgacggtcccagttcccggtacccttccccgcgtcccaccccgtccacccgagacgtcccg

SEQ ID NO: 138945 - DNA, 622 bp, Homo sapiens
  misc_feature: GYAE6OF01A20RZ.46.67.G01.1.454.CMB.1.raw
  modified_base (218)..(218): a, c, t, g, unknown or other
  misc_feature (218)..(218): n is a, c, g, or t
  modified_base (285)..(285): a, c, t, g, unknown or other
  misc_feature (285)..(285): n is a, c, g, or t
  modified_base (565)..(565): a, c, t, g, unknown or other
  misc_feature (565)..(565): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtcgtcacatcacttgccggganaagtcgaacatgactactatttaatgtatacaacatagaccgaggaccgcctaagctactatctagngctgcacttccgagtttgacgaaaggtcgggtacccagtcggtaggttcaggtcggactaggtaggacgtcgtaggggactaggttacttccacgtactacgaacctatacacgttaactccgtagaccgtaagttagtaaagttagttttagaaccttaactttaacgttaccttagtacctaaacgtaataaatttactaagttttacggttaccggaaccggtaaggacgtaaccgtaacttaaacgttaaacgttaaacgtacgttaggtaccgtnacccgactacctagttcttctcgttacacgttccctaccgactacttcgtggttaac

SEQ ID NO: 138946 - DNA, 717 bp, Homo sapiens
  misc_feature: GYAE6OF01CNXDA.46.67.G01.1.454.CMB.1.raw
  modified_base (215)..(215): a, c, t, g, unknown or other
  misc_feature (215)..(215): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtccgggcccacgactggtgaggccttcggagaccctgtccctcacctgccgctgtctcgtggtcncctccgtcagttagttggtttcttcgtggggctcgggtccggcagcctcccggagggagggcgtaggaatacgagttaggaagtgtctctacgtataggtggtacggtttaccttattacgtacgttcccgtcctccgtacgaagtacgtcgtacgtaccgtacctaactactccgtcgtaccggacgtaccgcctttttagacctaactccgttacgtttaccctagtaacgtattacgtacgttcgttcgtaccggacccgtaccgtacgtacgtaccgtacgggttctttaacgttacgtgtacggacgtagacggaccgtattagttagtgtttagttttaggtagtttagtttacgttaccgtaccgtaccgtagtacggtccgggtaccgggtcccgtaccggtaccccggtacgggacccggtacgggtaccttaccgggtacgttaccgtacccgttaccttacccgtttaccgtccccgtacccgtaacccgg

SEQ ID NO: 138947 - DNA, 1035 bp, Homo sapiens
  misc_feature: GYAE6OF01CHWHI.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtcctccatcctcctgtctgaccaaccggtgggagacagtcgtaccaccatactacgttcggcccggggacaacggttaccggaaactagtttcgaacctaaccgtttaatttttaaacgttggttaacttaccaaacgtaagttaaccggaacccggaacgggggtaaccccggtaccccgtaaaacggtccccttaccttaaacgttccttaacgtcggtaccttcggtacctaccgttacccgttaacgggtttttacggaaaccggttaaaacggggttccgggggttacccccgtaacggttaccgggttaacggggttttccgaacgggtttcggggaccgtaaggggttcgggtaacgttcggggttaacggggaacgttaacggtttaacttttacccgaacctttccccgttaaccgtaacccgttaaaccgtttaccgtaaacggtttaaccgttaccgttaacggttaaaccggttaaaccgggtttaagggtaaaacggttttaacgttttttaccggaaacccttttaaaacgtttttaaccgttttaaaccgggtttaaccgtttaaacccgtaaaacgttaaacgtttaaaaccgtttttaaaccgtttaaacggtttttaaccgggtttttaacccggaaacccgggttaaaccgggtaaacctaaacccgggttaaaactttaaaaacccggtttaaaaacggtttaaacccggtaaacggttaccggtaacgggtacccgttaccggtaaccctaaacccggtttaccgtttaacccggtttcgttaaccctttaccgtttaaccccgttcccctttaccccggtaaaccctttcgttaccgttaccggttaaaccg

SEQ ID NO: 138948 - DNA, 827 bp, Homo sapiens
  misc_feature: GYAE6OF01CUBN6.46.67.G01.1.454.CMB.1.raw
  modified_base (81)..(81): a, c, t, g, unknown or other
  misc_feature (81)..(81): n is a, c, g, or t
  modified_base (198)..(198): a, c, t, g, unknown or other
  misc_feature (198)..(198): n is a, c, g, or t
  modified_base (256)..(256): a, c, t, g, unknown or other
  misc_feature (256)..(256): n is a, c, g, or t
tcagactagcagtacacgaccggtgctcgatttagagtatacatattgggtttgggggacctcctgtgcaagaacatgaancacctgtggtttgtcctcctgctggtggcagctcccagatgggtcctgtccctggtgcaactgcgaggacgtccgggcccacgactgggtgaggtccttcggagaccctgtcccctnacctgcgctgtctcgtggcgcctcatcgagtagttgtttctcgtgggtctgggtccgnagccgtaccgaagggagggctaggaatacgtagttaggaagttgtacttcgtactaagttaggtagggtacggtttacctaagttaactacggttacccgtctactacgaaagtgttacggacgttaccaacctatacttcctacgtacggaacctacgttaccaaagtacctaaaacgtttcccgtttaaccgtttttacccgtaaaggaaaacgttaacgtaggtttacggtttacgttacgggttaccggaccccggtaccccgtcgtaacggtaaccgggtaacggggttactttttaacgttaccgtagggtccggtacggaacggtaacggtaacccggttaatttaagtttaggtttaagtttaaggttttttagggtaggttttaagggttttaaccttccgtaacccgtaacccgttaggtaaaccgggttacccgggaccgggggttaccctacccccgggtaacccgggggttaccgggaaccgggaaagggttaaaccttacccggtcggttaaccccgtacgttcccgtttaaccgttaccgtcccccgtaaacccgg

SEQ ID NO: 138949 - DNA, 863 bp, Homo sapiens
  misc_feature: GYAE6OF01DZN7N.46.67.G01.1.454.CMB.1.raw
  modified_base (222)..(222): a, c, t, g, unknown or other
  misc_feature (222)..(222): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactgggtgacggtccttacggacgaccccttgtcccctcacctgcgtctgtctcgtggtcncctcatcaggttgttcggtttctcggtcggggcgtcggggtccgacgacgccgtaccggaaggggacgggtcgtaggtaacgtacgtaggttagggtaacgttcgtcctctacgtaaggttagggtacgggttacggtttaccttaagttaccggtacgttcccgtcttaccgtacgtaacggtacgtacggtacgtaccaaacttagtacttcgtcggtacggaacctccgtacacgtaacctaacttaccgtttacccgttttacccgtaaaggtaacgtacgtttacggttacgtttaccgtacgggtaccccggacccggtaccgtaccggtacggtaacccgggttacgggtttaacgttttaacgtttacggtcgggttacggtaccgggtaaggtaaccgggttaccggtaattttaacggtttagttttaggttttaacggtttttaggggtaacggtttttacggtttaaccgtttaccggtaacccgttacccggtaagggtacccggttccgggggtaccgggtacccgtacccggggtacccgggtaggggtaaccggtaacgggtaccgttacggttacgttaccccgttaccgtttacccgttaccgttaccgccccgtaaacccgg

SEQ ID NO: 138950 - DNA, 700 bp, Homo sapiens
  misc_feature: GYAE6OF01BYVBJ.46.67.G01.1.454.CMB.1.raw
  modified_base (201)..(201): a, c, t, g, unknown or other
  misc_feature (201)..(201): n is a, c, g, or t
  modified_base (228)..(228): a, c, t, g, unknown or other
  misc_feature (228)..(228): n is a, c, g, or t
tcagactagcagtacacgaccggtgctcgatttagagtatacatattgggtttggggagtctcggtcaggacacagcatggacatgagggtccccgctcagcctccgtggggctcctgctactctggctccggaggtgccagatgtgacatcgagctcgacccagtcctccatccctccctgtcctgacaaccggtggganacagtgtcaccatcacgttgccggganaaggtcgaactattgactaccttaattaaatggtatacaacatacgaccgagggaccgacctaagctacctaatctatgctgcatctagtttgacaaggtcgggtacccagtcggtagttcgaggtggacgtagtggtactcgtagggacctaggtctttacacgttctaccactacgtctaagtactctaggacctaacgtagtaacttaattttagaaccttaacttaactttaactacgttaaactaaaccgtaagttaaactttaacgtaacggttttaacgggttttaccggaaacccggtaacgggtaaaccgtaaaccggtaaaccttaaaacgttaaaaaccgttaaacccggaaacgtttcgggtaacgtaccgtacggtaacctaaccgttacgttacgttacggtttccctaaccgttaccttaccccgttaccctaccgttaagttcccgtagttaaccg

SEQ ID NO: 138951 - DNA, 577 bp, Homo sapiens
  misc_feature: GYAE6OF01A0K2S.46.67.G01.1.454.CMB.1.raw
  modified_base (332)..(332): a, c, t, g, unknown or other
  misc_feature (332)..(332): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggcagctcccagggagggctggaatacattggaagtgtctctcatagtggaggttcctattacagtccgtctctcaagagtcgagtcaccatatctctggacacgtccagcaatcagttttccngaagatgagttctgtcgaccgcgctgacgacgggtcgtttatactgtgcgagagacggctattatgttatttggagttggtttatttcgactacccgtagacgtcggacggggcctccggacccgtcggggaccgagggtaactacgtcggtctaccgtctcccgttacgccctaccaccgtacggtcccacgtccgttacccttcccccgtcggccctacccctcctacccaaggccgtacccg

SEQ ID NO: 138952 - DNA, 835 bp, Homo sapiens
  misc_feature: GYAE6OF01AO8SW.46.67.G01.1.454.CMB.1.raw
tcagactagcagtacacgaccggtgctcgatttagagtatacatattgggtttggggagtctcggtcaggacacagaatggacatgagggtccccgctcagctcctggggctcctgctactctgactccgaggtgccagatgtgacatcgagctacgacccagtcctccactccctcctgtctcgaccgtaaccggtgggaacgactagtcgtaccaacctacttacctaccgttcgggacccgggtacgtaaacggtccgggaaactacgttacgaacctaaccgtttaaatttttaaaacgttggtaacttaccgaaactaagtaccggaacccggacggggacccggtaaccccgttaacggaccttaacctaattaccttaatcgtacgtcgtacctaccttaccgttaggtttacggaaccgtaaacgggtccgggtaccctaggttacggtaggttcgacgggtcggtacgtaggtagtacgttcgggaggtactaggttacttacctacttcctactacctagtacgtaacgttaacttacgtacggtacgttaacggtagttaaacgtttacgtttaactaacgtttaacttaccttacgttacgtaaacgaaacgtttaagtaaaccgtttacgtacgtttaacgggtttaacccggaacgggtaaaccggtaccgtaaccgttaaaacccgtttaaacgtaaaacggttaaacgtacgggttaccgtacggtacctaccggtaaccttaacgttccttaccggtactttacttacccggtatttcccctaccccgtattaaccgttcgttaacgtacccgttacg

SEQ ID NO: 138953 - DNA, 587 bp, Homo sapiens
  misc_feature: GYAE6OF01CK5DB.46.67.G01.1.454.CMB.1.raw
  modified_base (219)..(219): a, c, t, g, unknown or other
  misc_feature (219)..(219): n is a, c, g, or t
  modified_base (331)..(331): a, c, t, g, unknown or other
  misc_feature (331)..(331): n is a, c, g, or t
  modified_base (336)..(336): a, c, t, g, unknown or other
  misc_feature (336)..(336): n is a, c, g, or t
  modified_base (364)..(364): a, c, t, g, unknown or other
  misc_feature (364)..(364): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtggagacagtgtccaccatcacgttgccgggnaagtcgaacattgacactatttaatgtatcaacatagacagggaccgcccaagctcctaatcatgctgcatccagtttgactaaggtcgggtcccagtcgaggttcagtgcngtagngtcgtaggatagtattcgactctcaccntactagtaactctagacaaggtgaaagttattttacgaaccttaactttattacttagtaactaagaactaatttactaagttggtttccggaacgtaacgggacctaacgaacttaacgtaaaacttaacgaagttcgtagtaccgtcgtaacctaccgtaattccgtagttccgttaacctacgttaccccttcccggacctttaacctgttaccgtaacg

SEQ ID NO: 138954 - DNA, 717 bp, Homo sapiens
  misc_feature: GYAE6OF01DTC0A.46.67.G01.1.454.CMB.1.raw
  modified_base (258)..(258): a, c, t, g, unknown or other
  misc_feature (258)..(258): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtccgggcccagactggtgaggccctttcggacgaccctgtcccctcacctgcgctgtctctggtcgcctccatcagttagtggttttctcgtgggggcctgggtccgnagccgtccgagggagggctggaatacattggaagtgtctctcagttagtgggtacggttccttaagttaccgtacggttccgtctctacgaacgtacgtcgtacgtctaacctatactctcgtacggtaccaccggtccaacgactaacttctaccgtttttcccgaagtaagtagttagtacgtttcgttcggtacgaccccgcggtactacggaccgtacgggttacttttagttacgtggtcgacggtagacggacgtacgttatttagttcggtttagttttgggtacgggtttagtttacgttaccgtacctacccgttaggtacggtccgggaccggggtcccgttacccgggaccccgggtaggggtacccggtaacgggtaaccgttacccggttcggtacccgttacccggtttcccgtttaaccccgttaccgtccccgttaaccccgg

SEQ ID NO: 138955 - DNA, 704 bp, Homo sapiens
  misc_feature: GYAE6OF01CBX26.46.67.G01.1.454.CMB.1.raw
  modified_base (533)..(533): a, c, t, g, unknown or other
  misc_feature (533)..(533): n is a, c, g, or t
tcagactagcagtacacgaccggtgctcgatttagagtatacatattgggtttggggagtctcggtcaggacacagcatggacatgacgggtccccgctcagcctccgtggggctcctgctactctggctccggaggtgccagatgtgacatcgagctcgacccagtcctccactccctccctgtcctcgaccgaaccggtgggaagactaggtcgtaccacatcacgttcggaccgggacaaggtacggaacagttacgactaaccttaatttaacgttgtaacaacaagtaacgagaaccggacgggaccgtacccttaagccttacctaatacgtagtcgacctcactactaccgttagttacgaacgtaaagggtcgggtacctagtacgtaggttcgaggtgacgtaggtcgtaacttcggaggaactagtacttcgactctaaccacgtatactaagtactcctaagacctaaggtaagtaaggttactttacgaacttaacgttacttaacgtactaaaccgtaanaacgtttaaactaactttacggttacgtttacggaaccgtaacggaactaaacgtaacctaaaactaaaaccgttaacgacgttaaggttccgaacgtaacgactaccgtatttacggtaccttacgtacctaccttacccggttacccacgttacttacgtgttaaacgg

SEQ ID NO: 138956 - DNA, 805 bp, Homo sapiens
  misc_feature: GYAE6OF01DP2YJ.46.67.G01.1.454.CMB.1.raw
  modified_base (198)..(198): a, c, t, g, unknown or other
  misc_feature (198)..(198): n is a, c, g, or t
  modified_base (226)..(226): a, c, t, g, unknown or other
  misc_feature (226)..(226): n is a, c, g, or t
tcagactagcagtacacgaccggtgctcgatttagagtatacatattgggtttggggagtctcggtcaggacacagcatggacatgagggtccccgctcagctcctggggctcctgctactctggctccggaggtgccagatgtgacatcgagctcgacccagtcctccatcccgtccctgtctgcaaccggtggganacagtcgtccacatcacgttggaccggnaagtcgaatattcgactaccttaatttaaatggtaatacaactataacgaccgaacgggaccgtaccctaaagcctactaatctactacggcttcggactacgtaccgttagttttacggaacgttaaacgggtccgggtttacccagttccggtaggttcgagggtgacgtaggtaggcttacggttagggactaagttctttaccgtactaccctacaacctacttaacgtaacgttaattccgtagggtaacctaacggtttaacgttaaacggtttattttaccggtaaactttaaacttttaaccgttaacgtttaaccgaaaccgttaaacgtaaacggtttaacttaaacggtttaaacgtttacgggtttaaacccggaaccggtaaacccgggaaccgttaaaacgtaaacgttaaaaccttaaaaccggttaaaccggtaacgtagggtttaaccggacttaaacgggtaacccttaaaccgtaacgtttacgtttacccggttctttaaacccgttacctttaccccggtttaacccaacctttaccgttacgttaaggttaaccccg

SEQ ID NO: 138957 - DNA, 711 bp, Homo sapiens
  misc_feature: GYAE6OF01E33IK.46.67.G01.1.454.CMB.1.raw
  modified_base (193)..(193): a, c, t, g, unknown or other
  misc_feature (193)..(193): n is a, c, g, or t
  modified_base (628)..(628): a, c, t, g, unknown or other
  misc_feature (628)..(628): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtggganacagtctcaccatcacgtggccggcaagtcgaacattcgaactaccttaatttaaattggtactacaacatacggaccaggggaccgccctaagctacctaatctatgctagctactacgtgtttacgacgtaagggtcgggtccagtcggtagttgacggtggactaggtggtagtcggtaggaacctagtactttccactctactacctactactaagttactcgtaacgacgtaacgtagttaaagttacgtttacgtacttaaacttacgttactaactactaaaagttaccttaaagtttaccgttaacgtttacgggtttaccgggaaacccggtaaacgggtaacctaaaccggtaaaacctttaaaacgtaaaaaccgtttaaacggtaacgttacgggtacgtaccaaccggtactaaacccgttntttacccggttcgtttacccttaactttacccccgtttacccgtacccccgttaacccaacgttttcgtaagtttaacccggg

SEQ ID NO: 138958 - DNA, 775 bp, Homo sapiens
  misc_feature: GYAE6OF01CHUXK.46.67.G01.1.454.CMB.1.raw
  modified_base (205)..(205): a, c, t, g, unknown or other
  misc_feature (205)..(205): n is a, c, g, or t
  modified_base (239)..(239): a, c, t, g, unknown or other
  misc_feature (239)..(239): n is a, c, g, or t
tcagactagcagtacacgaccggtgctcgatttagagtatacatattgggtttggggagtctcggtcaggacacagcatggacatgacgggtccccgctcagcctccgtggggctcctgctactctggctccggaggtgccagatgtgacatcgagctcgacccagtcctaccactccctccctgtctgaccaaccggtgggaanactagtcgtacaccatcctacgttggaccggganaacggtaccggaactattacgaacctaactttaatttaaaagttggtaatacaaactagtacgaaccgaacgggaccgaccctaaagtcctaccttaaactcgtaatgtacgtcgactactaccgttagtttcgaacggtaaacggtccgggtacccaagttcggacgtttacgaaggttcggactagggtagtacgtacggtagggaaccttagttacgttaccacgttaccactaacctatacgtaatactcgtacgaacctaagttagtaaacgtttactttaacgaactttaaacgtttactaagttaaccgtaactaaaagtaacgttaaaacttacgttaaacgttttcgggtttaacccggaaccgtaaaggggtaaaccctaacgttaaaaccgtaaaattaaaaacgttaacgtaaacgttcgtaacgggtcctaaacgtaccttaaaccagtttacccggtaatttaccctttacgaaaccgttttccccgtaaccccgtactaaccgttacgttaaggtaaaccc

SEQ ID NO: 138959 - DNA, 854 bp, Homo sapiens
  misc_feature: GYAE6OF01DSJSF.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccactcctcctgtctgactaaccggtggagacagtcgtacaccatctacgttcggccgggactaaggtaccggaactacgttacgaacctaacctttaaattttaaaacgttggtaactaacaactacgtaacgaaccggaacgggacccgtaccctaagtccttacctaattctagtcgtctcgactacgtacgtagtttacgaacggtaaacggtccggggtaccctagttaccggtacggttacgaggtcggtacgtaggtaggtacgtcggtacgggtacgtaagttcttactaccgttacctacgacctaacgtacgtaacgttaacgtcgtaacggtaccgtaaacggttacggttaaatttacgttttacgtaaaccttttaaacgttttaacctaacgtttaaccgaaacgttaaaacgtaacgtttaaacttttaacgggtttaaccgtttttaccggggttaacccggtaaaccgggtaaaccgggtaaacccttaaacccggttaaaaccgtttaaaaaccgttaaaacggttaaaccggtaacggttcggggttaacctaccggttaaccgtaaacccctacgtttaccgttttaccggttacccgtttaccgtttaacccgtcccgtttaacccccggttacccttaacccgttacgtttccgtaacgggtttaacc

SEQ ID NO: 138960 - DNA, 728 bp, Homo sapiens
  misc_feature: GYAE6OF01BHZEU.46.67.G01.1.454.CMB.1.raw
  modified_base (250)..(250): a, c, t, g, unknown or other
  misc_feature (250)..(250): n is a, c, g, or t
  modified_base (332)..(332): a, c, t, g, unknown or other
  misc_feature (332)..(332): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtcccctcacctgcgctgtctctggtgcctccatcagtagtgtttcttcgtggggctgggtccgnagcctccgaggggagggctggaatacagttggaagtgtctcgtcatagtggtaggttcctattacgagtccgtctctcaagngtcgagtcaacctattactctacgtgacaccgtcagtcaaacttcgttacgtttttcccaggtaaacgtattggtaacgtttccgttggtaccggaaccccgtcccgtacgtacggaccgtacgggttcgtttttaacttacgtggttacgcggtacggtacggaccggtactttaagtttagttggtttaacttttttggggacgttttggttttaacgttttacccggaaccttaccccgttaagggtacgtccggggtacccgggggtaccgtaccccgggtacccccgggttgggggtaccccggtaagggggttaaaccttaccgggttaccgggttacccttaaccccgggttccctttaccccgtttaccggccccgttaacccccggg

SEQ ID NO: 138961 - DNA, 748 bp, Homo sapiens
  misc_feature: GYAE6OF01D1R2T.46.67.G01.1.454.CMB.1.raw
tcagactagcagtacacgaccggtgctcgatttagagtatacatattgggtttgggggagtctcggtcaggacacagcatggacatgagggtccccgctcagctcctggggctcctgctactctggctccggaggtgccagatgtgacatcgagctcgacccagtctccatccctccctgtctgaccgaaccggtgggaacactaggtcgtacaacctatccaacgttcgggaccgggtacaaacggttaccggaactacttacgaacctaaccgtttaaattttaaagttcggtaacttacaaactacgtaacggacccgtaacgggggaacccgtacccgtaaagccttactaacttctagtacgtctacgctacgttaccgtaggtttacgaacggtaaggtccgggtacctagttacggtacggttcgaggtacggtcgaggttacggtacgttccggtagggtaacctagttacgttacctacctctaaccaccgtacttacgtaagttacgtccgtaacgtacgtaacgttagtaaacgtttgtttaacgactttaaacgtttagttaacgtacgaactaaacgtagtaaacgtttacgtaagttttaccggttacggaaccgtaaggaacctaagtaaacctaaataaacggttaacgacgttggtaacgtccgtacacgtaaacgttctaggttaaccttacgtaaccttaccgtcctacttactccgttagaccttacg

SEQ ID NO: 138962 - DNA, 576 bp, Homo sapiens
  misc_feature: GYAE6OF01BBQSV.46.67.G01.1.454.CMB.1.raw
  modified_base (349)..(349): a, c, t, g, unknown or other
  misc_feature (349)..(349): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtgggagacagtgtcaccatcacttgccgggcaagtcggaacattgacaccttatttaatgtatcaacatagaccagggaccgccctaagctcctaatctatgctgcatcctagtttgacgtaaagtgggtacccagtcgaggttcagttggcaggtgatcgngggacagtattcactctcaccatactagtaatcgtagactaacggttagaagtacttttagactaactttattacttagtacaaactagtaactttacaagttcggttttacgaccgtaagggactaaccgtaactaaactaaattaaacgactaggtagtcgtacgacctaacctctacttcgttacccttctaccttcccttacccgacctaacttcgtgtaacg

SEQ ID NO: 138963 - DNA, 802 bp, Homo sapiens
  misc_feature: GYAE6OF01C7I5T.46.67.G01.1.454.CMB.1.raw
  modified_base (195)..(195): a, c, t, g, unknown or other
  misc_feature (195)..(195): n is a, c, g, or t
tcagactagcagtacacgaccggtgctcgatttagagtatacatatttgggtttggggagtctcggtcaggacacagcatggacatgagggtccccgctcagctccgtggggctcctgctactctggctccgaggtgccagatgtgacatcgagctgacccagtctcatcctcctgtctgaccaaccggtggganacagtcgtacaccatcacgttcggcccgggactaaggtcggaaactagtttacgaacctaacctttaattttaaagttggttactacaaactaagtaacgaaccggaacggggacccggtacccctaaagccttaacctaaacttccttaagtcgtacgttacgacctacgttcccgttaggttttacgaccggtaaaacgggttccggggttacccctaaggtcggtaacggtttaccgaggtcgggtactaaggtacgggtactcggtacgggaacttaaggtaacttttacacccgttactaccgtaaacctataccgtaagttaaacttccgaagtacgtaaacgtagtaaacgtttattttacgaaacttaactttaacgttaacgttaacgtaaaccgtaaacttaaggttaaactttaacgttaacgtttacggggtttaaccggaaaccgtaaagggtaaccctaaacggttaaactaaaacgtttaaaacgtttaaaccgacgtttaacgggtacgtacgttaccaaccgttaacccgtagttaaccttacgtaccctttcgaacctttccccgtaccctaccgtatcgttacgtaac

SEQ ID NO: 138964 - DNA, 855 bp, Homo sapiens
  misc_feature: GYAE6OF01A11PN.46.67.G01.1.454.CMB.1.raw
  modified_base (428)..(428): a, c, t, g, unknown or other
  misc_feature (428)..(428): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagttggtttcttcgtggggctcggggtccgcagcctccgagggagggctaggatacgattggaagtgtctctacagtacggtggtagttcctaagttacgacgttccgtcttctaccgaaggtacgtccgtaagtccaacctattactcctcgtacggacctaccggtccaacggtactaacttaccgttaccgtttttaccccaggtaacgtatacggttagttccgtaggtccgaacccgtccncgtacgaaccggtacggggttccttttaaagttacgtggtacgaccggaggacgtaccggtacttagttacgttagttaggttttagggtagtttacggtttacgtttaccgtaaccgttacccgttaaggaaccggttccggggtaacggggtccgtacccggtccccggttacggggaccggtaaacggggtaacttaccgggtaccgggttacccgtaccggttaccccgttcccggtttaccccgtaccccggttaaccccgaacccgggttaaaccccggggtacccccgttacccggtttacccccggggttttacccccccgtttcccccccgggttacccggggttaaccccccctttaacccccccggtcccccgttttaaccccggaaaaccggttcccccggttaaaccccccggg

SEQ ID NO: 138965 - DNA, 612 bp, Homo sapiens
  misc_feature: GYAE6OF01AFHN9.46.67.G01.1.454.CMB.1.raw
  modified_base (456)..(456): a, c, t, g, unknown or other
  misc_feature (456)..(456): n is a, c, g, or t
  modified_base (584)..(584): a, c, t, g, unknown or other
  misc_feature (584)..(584): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctcgacccagtcctcatcctccctgtctgcaaccggtgggacacagtcgtcaccatccacgttcggccgggacaacggtcggaactatttacggaacctaaccgtttaattttaaagtcggtaactcaactatacgaccgagggaccggtccctaagcctacgtaactctatcgctagctactctagttagacgtaaggtccgggtaccagtacggtaggttacaggttcggactaggtcggacgttgtacgggactagttacttacgactcgtacacgtactgacgtaatcgtagacctagtntaagttattcaacttaacttatacgtgtaactacataacttcacgtttacggttaccgagaacggtactacgacttaaacgtaataacgtaacgtgaacgtactacgactactgtcttactcgttaanccttccgttacccattctcgttaggtac

SEQ ID NO: 138966 - DNA, 658 bp, Homo sapiens
  misc_feature: GYAE6OF01COW8M.46.67.G01.1.454.CMB.1.raw
  modified_base (218)..(218): a, c, t, g, unknown or other
  misc_feature (218)..(218): n is a, c, g, or t
  modified_base (257)..(258): a, c, t, g, unknown or other
  misc_feature (257)..(258): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcagggagtcgggcccagactgggtgaggcccttgggacgaccctgtcccctcacctgcgctgtcctctgggtcnccctcatcagttagttgtttctcgtggggctgggtccgnngcctccgagggagggcgtggaatacgagttggagtgtctctcatgtggtacgttacctattacacgtccgtctctacaagcgtcgagtcacatatctcgtcgacacgtccagcaattctacgttttacccaggacgtagtgtacgttcgtgtacgaccgtcgacgtggaccgtacgggttctttaagttcgtggtcggtacgaggtacgtacggtacttaagtttacgttaggtttagttttaggtaggtttggttttacttccgtaaccgtaccgtaggtacggttcggggtacccggggtcctacccggtcccggggttaggggacccggtacgggtaaccgttcgttacgggtaccccgtaccgtttaccgttaccccgtcggtacccctaacccgg

SEQ ID NO: 138967 - DNA, 797 bp, Homo sapiens
  misc_feature: GYAE6OF01A5WT4.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactgggtgaggccttcgggagaccctgtccctcacctgcgctgtctctggtgcctcatcagtgtggtttctcgtgggctgggtccgcagcctccgaggggacgggctaggaatacgagttggaagtgtctctcataggtggtaggttcctattacagtcccgtctctacaagtacgttcgagttccaaccgtattacttccgttacgtcgggaacctaccggttacccaaggacctaaaacgttcctttaaccggttttttacccctaggtaaacgtacgtaggttaacgtttcgtcggttaccgacccggtcccgatcggaaccgtacgggtactttttacgtacgttgtcggacgaggtacgtacggtacttagtttagttacgttagtttttaggaggtttaggtttacgtttccgaaccgttacccgtaggtacgttccgggggaccgggtcccgttacccgggaaccccgggtacgggggacccgtaaacggggttaaccttaccggttacgggtaccctaccgggttaccttcccgttacccggacccttacccgaacccggtaaccgggtcccctaacggttccccggttcccccgtttcccccccggtagggtaccccccttaaccccttaccccgtaaccccggaaacgggttcccgtaacccccgg

SEQ ID NO: 138968 - DNA, 674 bp, Homo sapiens
  misc_feature: GYAE6OF01ER77A.46.67.G01.1.454.CMB.1.raw
  modified_base (217)..(217): a, c, t, g, unknown or other
  misc_feature (217)..(217): n is a, c, g, or t
tcagactagcagtacacgaccggtgctcgatttagagtatacatattgggtttggggggacctcctgtgcaagaacatgaagcacctggtggtttcgtcctcctgctggtggcagctcccagatgggtcctgtccctggtgcaactgcaggagtcgggccacgactggtgaggccttcggagaccctgtccctctacctgccgcgtgtctctggtcncctccatcgagttagttggtttacttcgtggggtctggggtccgcagcctcccgaagggaacgggctaggaatacgagttggaacgtcgtcctctcagttaggtggtacggttcctattaccgacggtccgtctactacgaagtcgtaccgagtaccgacctaagtacgtcgtcgtacgggaacgtacgtccgaacgtactaacttcctacgttttccccaggaaacgtagttacgtagtttcgtagtaccggaccgtccgtcgtagaacgtacgggttctttacttacgtgttcgacgtagacggtacgtacttagttagtggttaggtttacggaggtttacgtttacgtttccgactaccgtagtacggtacgggacgggtctaccggaccggttagggaccgtagggtaactacggtcgtaccgtaccgttccttaccgttcgccctaacccg

SEQ ID NO: 138969 - DNA, 617 bp, Homo sapiens
  misc_feature: GYAE6OF01BNX02.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtgggagacagtgtcaccatcacttgccgggcaagtcgaacatgacactattaaattgtatcaacatagaccagggaccgccctaagctcctaatctatgctgcatcctagtttcgacaaaggtcggggtaccccagtcggtaggttcaggtggacaggtggatcgtagggactagtactttcacttctacacctatctaagtaactctacgactaacgtagtaagttaattttgaacttaacgtttaattacgttacgtactaaactagtaaatttaactaagtttcggtttaaccggtaaccgtaacgggtaacctaaccggtaaacttaaacgtaaaactttaaacgaacgttggtacggtactacgaccacctattaccttcggttacttactaccgttcccttacccgtacctacttcgtagtaac

SEQ ID NO: 138970 - DNA, 753 bp, Homo sapiens
  misc_feature: GYAE6OF01CAFLM.46.67.G01.1.454.CMB.1.raw
  modified_base (193)..(193): a, c, t, g, unknown or other
  misc_feature (193)..(193): n is a, c, g, or t
  modified_base (196)..(196): a, c, t, g, unknown or other
  misc_feature (196)..(196): n is a, c, g, or t
  modified_base (217)..(217): a, c, t, g, unknown or other
  misc_feature (217)..(217): n is a, c, g, or t
  modified_base (226)..(226): a, c, t, g, unknown or other
  misc_feature (226)..(226): n is a, c, g, or t
  modified_base (228)..(228): a, c, t, g, unknown or other
  misc_feature (228)..(228): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtcctccatcctccctgtctgcaccggtggganacngtgtcaccatcacttgccggnaagtcgacntnacactattaatgtatcaacatagaccagggaccgccctaagctacctaatctatgctgactattcccgtagtttacgacgtaaaacgggttcggggtacccctagttaccggtagggtttccgtaagggttcggtacgtaaggttaggggtaacgttaccggttacggggtaacctaaggttaaccgttttcctaacccgtttcctaaccgtaaacccctaagttacccgtaaagttaaaccgttccgttaacggtaaccgtaaacggtttagggttaaaacggtttacgttttttaacgggaaacccttttaaaactttacgtttaaaccgtttacgttaaacccgtaaaacgttaagtttaaaacctttacggttaaacgtttttacgggtttaccggaaaccggtaacgggtaaccctaaacggtaacttaaaacgtaaacgttaaaccgaccgttgtacggtactacgacctacgagttcctgttaccttctacgttcccgtaccacctagtctagtaccg

SEQ ID NO: 138971 - DNA, 638 bp, Homo sapiens
  misc_feature: GYAE6OF01AI116.46.67.G01.1.454.CMB.1.raw
  modified_base (352)..(352): a, c, t, g, unknown or other
  misc_feature (352)..(352): n is a, c, g, or t
tcagactagcagtacacgaccggtgctcgatttagagtatacatatttgggtttgggggacctcctgtgcaagaacatgaagcacctgtggtttgtcctcctgctggtggcagctcccagatgggtcctgtccctggtgcaactgcaggagtccgggcccacgactggtgaggtccttcggagaccctgtcccctcacctgcgctgtctcgtggtcgccctccatcgaggttagttggttttccttcgtggggcttggggtccgcacgcctcccgaggggaacggggctggaatacattggaagtgtctctcagtagtggtacggttcctattacagtccgtctctcgaagngtcgacgtcaccatatctcgtggacacgtccagactaatcgtacgttttccccagtaacgagttgtacgtttcgtcggtcgaaccccgccgtcgtacggaaccgtacggggttcgtttttataccgttggtcggacgagacggacggtatacgtttagtaagtttagtttttgggtagtttcggtttactttccgaccgtacccgtagacgtcgggaccggggctacccggacccggtgggaccgagggtactcgtcgtccgaccgtcctccttcgccctaccccg

SEQ ID NO: 138972 - DNA, 620 bp, Homo sapiens
  misc_feature: GYAE6OF01BUPD8.46.67.G01.1.454.CMB.1.raw
  modified_base (218)..(218): a, c, t, g, unknown or other
  misc_feature (218)..(218): n is a, c, g, or t
  modified_base (251)..(251): a, c, t, g, unknown or other
  misc_feature (251)..(251): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtgggagacagtgtcacatcacttgccggganaagtcgaacatgacacttattaaatgtatcaanatagaccagggacgccctaagctcctaatctatgctgcatccagtttgactaaggtcgggtcccagtcggaggttcaggtcggcaggtgatcgtagggactagtacttcactctacacctatcagtactctgactaacgtagtaagttatttacgacttaactttattacttacgtaactaactaagtaactttaataacgtttcggttttaccggaacgtaacgggaactaaccgtaacttaaacgtaaaacgtttaaaccgaacgttcggtacgtaccgtacgtaccgtaacctacttacggttccgttacctttaccgtaccttttaccccttaccccggtactaacctttcgttaaccggttaac

SEQ ID NO: 138973 - DNA, 600 bp, Homo sapiens
  misc_feature: GYAE6OF01DNSZM.46.67.G01.1.454.CMB.1.raw
  modified_base (172)..(172): a, c, t, g, unknown or other
  misc_feature (172)..(172): n is a, c, g, or t
  modified_base (292)..(292): a, c, t, g, unknown or other
  misc_feature (292)..(292): n is a, c, g, or t
  modified_base (588)..(588): a, c, t, g, unknown or other
  misc_feature (588)..(588): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtcncctccatcagtagtggtttctcgtggggctgggtccgcagcctccgaggggagggctaggaatacagttggaagtgtctctcagtagtggaggttcctattacagtccgtctctacaagngtcgagtcacatatctctggacacgtccagctaatctagttttcccagaagtatgtagttcgtgtcgaccgccgcgtagacgacgggtcgttttatacgtgtgacgagacggacgtactatttagttagttagttttggagtttggttactttcgactaccgtagtacgtcgggacggggcctaccggacccgtgggccgaagggtaactacgttcggtacctaccgtctaccgtacgccctaccgaccgacggacccacgttcccggtcccttccccgtcgtccctaccctaccnccagcgtacccg

SEQ ID NO: 138974 - DNA, 807 bp, Homo sapiens
  misc_feature: GYAE6OF01CTY9I.46.67.G01.1.454.CMB.1.raw
  modified_base (220)..(220): a, c, t, g, unknown or other
  misc_feature (220)..(220): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaaccgtgggagacagtgtcaccatcacgttcggccggganaacggtcggaaacatttcgaactaccttattttaaagtggtaatacaacagtacgaccgaggaccggaccctagctacctatactatcgtctagctacgtcctagtttcgacgtaaacggtcgggtaccctagtcggtaacggtttcaagggtcggtacgtaggttacgggtacgttccggtagggaacctaggtacttttaccacctttcctacctaaccttataccgtaagttaacttaccggtacgtaaccgtaaccggttaaggtaaacgtttagttttaacgaaacctttaactttaacgtttaaaccgttacggttaaacctaaacgttaaacggtttaaactttaaccgtttaaacggttttacgggtttttaacccgggaacccgggtaaaacgggtaaacctaaccgggttaaaaccttaaaccgttaaaaacgtttaaaccggtaaccgtttacggttaaccgggtcctaccgggtaacctaaacccgttaatttacccggttaccgtttaccctttaaccgttacctttacccccgttttaccccggacctttaacgtcccgttacgttaaacccg

SEQ ID NO: 138975 - DNA, 752 bp, Homo sapiens
  misc_feature: GYAE6OF01DS5OB.46.67.G01.1.454.CMB.1.raw
  modified_base (215)..(215): a, c, t, g, unknown or other
  misc_feature (215)..(215): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtcccctcacctgccgctgtcctctggtcncctccatcgagtagttgtttcttcgtggggtctcgggtccgcgagtccgtaccggaggggaacggggctaggaattacgagttgggaagttgtcctctacagttaggtggtacgttccttaagtaccgacggttccgtcttcgtacaaggtacgttcgacgtacctaaccgtaattactccgtacgtacgggaacctacggtaccaacgacctaaattccgttaacgttttcccgaaggtaacgtagttgtaacgttcgtgtacgtacccgccgtcgtacggaccgtacgggttactttacttacgtgtacggtacgtagtacggtacggtactttaagttacgtttaggtttaggttttaggacggttttacgtttaccgttaccgtaacccgttaaccggttaaggtaccggttaccggggtaccggggtccctacccgggtaccccggtaggggaccccgttaaagggaaccttaccgggttcggttacccgtacccggttccttacccggttacccgtccccgtaaaccccgg

SEQ ID NO: 138976 - DNA, 881 bp, Homo sapiens
  misc_feature: GYAE6OF01DQ6XD.46.67.G01.1.454.CMB.1.raw
  modified_base (817)..(817): a, c, t, g, unknown or other
  misc_feature (817)..(817): n is a, c, g, or t
tcagactagcagtacacgaccggtgctcgatttagagtatacatattgggtttggggagtctcggtcaggacacagcatggacatgagggtccccgctcagctcctggggctcctgctactctggctccggaggtgccagatgtgacatcgagctcgaccctagtcctccactccctcctgtctgacgacggtggagacagtctccaccatccgacgttcggacccggataacggtacgaactagttacgaccttaactttaattttaagtagtaactaccgaaaactacgtaaccggacccggaaccggggaccccgtaacccttaagtaccccttaacgttaaacttcgttaacgtacggtaccgtacggttaccctaacgttaccggtttaaacggttaccgggaaccggttaacggggttaccgggtaacccttaaaggttccgggttaaacggttcggtaagggttacggtacggtaagggttacgggttacgtacgggtaacggttaacgttaacgtttacccttttaccaacccgttaccctaacccgtaaaccttggtaaaccgttaacggttaacccttcggtaaacggttaaaaccgttaagggttttaaaaccgtttaacgttttaacgtttaaaccttaactttacttttaacggtaccttaacgtaaacgtaaacggtttaactttaaacggttacgtttaacgggtttccggtaaaccggtaacggaaacgttacctaaaacttaacgtaaacttaacgtacgacggttacggtactacgtaccttccgtaattacccgtttntacctttaacccgtcccgtttaaccccgtccgttaaacctcctttagccggttaacttaacggg

SEQ ID NO: 138977 - DNA, 720 bp, Homo sapiens
  misc_feature: GYAE6OF01DX3JA.46.67.G01.1.454.CMB.1.raw
  modified_base (214)..(214): a, c, t, g, unknown or other
  misc_feature (214)..(214): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggacgaccctgtccctcacctgcgctgtctcgtggtcncctccatcagttagttggtttcttcgtggggctcggggtccggcacgccgtaccggaggggtaacgggtctaggtaatacgtagttaggaagtcgtctctactagttaggtgggtacggtttaccttattaaccgtcggttccgtctcctacgaagtacgtacgtacgtacgacctatactctcgtagacacgtcacgtactaactcgttacgtttacctaggaaacgtgttagtcgtttacgttcggtacggaccccggtccgtaccgtacggaaccggttacggggttacttttaacgtttacgtgggttacggacgggtagacggtacggttacttaagttagttggttttaaggtttggtacggtttaggtttactttccgtaacctaccgtaggtacggtcggggtaccgggtccggtacccggacccgggtgggaccggtagggtaaccttacgggtccggtacctaccggtccctttcccgtacgtcccgtaaccccgg

SEQ ID NO: 138978 - DNA, 863 bp, Homo sapiens
  misc_feature: GYAE6OF01D7QO2.46.67.G01.1.454.CMB.1.raw
tcagactagcagtacacgaccggtgctcgatttagagtatacatattggggtttgggggagtctcggtcaggacacagcatggacatggacgggtccccgctcagcctccgtggggctcctgctactctggctccggaggtgccagatgtgacagtcgagcgtcgaccctagtcctacctactccccttcccttgtccgtacggaccgtaaccgggtagggacgtaccgtaggttaccgtaccaacctacgttccgtaccggttcgggacccgggtaacgtaacggtaccggtaactacgtaccgtaaccttaacctttaaacgttttaagttacgttaactaactaaactaacgtaaccgggaaccggaaccgggggtacccggtaaccctaacggttaccccttaaccgttaatacctacgtcgccgtcgtactaccgttcgttaaggttacgaacggttacgggtccgggtactaggtacggtaaggttcgaggttaccggatacggttacggtagttcgggtaacggcttaacggttactcctaacgtcctacaacctaagtaccgttaacttaacgtcgtaacggaacgttaacggtaactttaaggttacctttacgtaactttacttttacgttacgtaacttaaaccgttattaaaccgtttaatttaaccgggtttaaccttcggggttaaacccggaacccggtaaaggttaaccgtaaacccgttaaaccgttaaagttaaaccggtaaccgttaggttcggtacgacccgtaagttacccctaagtttacgttccgtttacttaaccgtcccttaccgtaccccgtttacacgtttacgtcctaaggtacc

SEQ ID NO: 138979 - DNA, 671 bp, Homo sapiens
  misc_feature: GYAE6OF01BC3DA.46.67.G01.1.454.CMB.1.raw
  modified_base (236)..(236): a, c, t, g, unknown or other
  misc_feature (236)..(236): n is a, c, g, or t
  modified_base (250)..(250): a, c, t, g, unknown or other
  misc_feature (250)..(250): n is a, c, g, or t
  modified_base (319)..(319): a, c, t, g, unknown or other
  misc_feature (319)..(319): n is a, c, g, or t
  modified_base (493)..(493): a, c, t, g, unknown or other
  misc_feature (493)..(493): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcagggagtcgggcccacgactgggtgaggcccttcggagacccctgtccctcacctgcgctgtctctggtcgcctcatcagtgtgtttctgnggggctgggtccgnagctccgagggagggctaggatacgagttggaagtgtctctcagtagtggagttcctatacagtccgtntctcgaagagtcgagttcgaaccattactactcgtaggaacctacgtccagactaactcgttacgtttacccctagaaacgtagtacgtacgttcgtgtacgacccgtccgtcgtcgtaaccggtacgggtttaccgttttaagttaccgtggttgacgaggtacggtacggtnttaacgtttagtgtttaagttttgggtaaggttttggtttacgtttaccggtaacctacccgttaaggtacgtacccggggtacggggtccgtacccgggaccccgttgggggacccggtaagggtactacggtacggtaccctaccggtacttacccgttagtccccgtaaccccgg

SEQ ID NO: 138980 - DNA, 808 bp, Homo sapiens
  misc_feature: GYAE6OF01BXC0G.46.67.G01.1.454.CMB.1.raw
  modified_base (319)..(319): a, c, t, g, unknown or other
  misc_feature (319)..(319): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtcgcctccatcagtagttggtttctcgtgggctgggtccgcagcctccgaggggagggctaggaatacgagttaggaagtgtcctctacgagtaggtggtacggttccttattacgacgttccgtctctacaagacgtcgagtccacatntcctcgtacggacctacgtccacgtactaacttccgttacgttttcccgagtaacgtagttagtacgtttcgtcggtaccggacccgccgtcgtacggtaaccgtaccggggtttacgttttaacgttacggtcggtacggacgggtaggtaacgggtaccggttactttaacgtttagtttacggtttaaggtttttacgggtaaggttttacggttttacgtttaccggtaacccgttacccgttaacggtacggttacccggggtaccggggtcccgtacccgggtaccccgggtcggggacccgtaagggtaaccgttaccggttccggtacccttacccggttcccgttacccgttacccgtaccccgtaacccgaacccggtaacccgggtacccctaccgggtttcccccgttaccccgttacccccggtccgtaccccccttaccccgttacccgtaacccggaacgtcccgtacccccgg

SEQ ID NO: 138981 - DNA, 932 bp, Homo sapiens
  misc_feature: GYAE6OF01D4TUR.46.67.G01.1.454.CMB.1.raw
  modified_base (920)..(920): a, c, t, g, unknown or other
  misc_feature (920)..(920): n is a, c, g, or t
tcagactagcagtacacgaccggtgctcgatttagagtatacatattgggtttggggagtctcggtcaggacacagcatggacatggacgggtccccgctcagctccgtggggctcctgctactctggctcggaggtcgcagatgtgacagtcgagctcgacccagtcctccacttccctccctgtactcgaccgaaccgggtgggacacgtaggtcgtaccaccatcctacgttcgggacccgggactaaacgggtccggaaactagttacgaaccttaaaccttttaaagttttaaaacgttcggtaaacttaccaaaacgaacgttaaccggaacccggtaacgggggaccccggtaacccctaacggtacccttaacccctaagttacctaaggttacgtccgttacggtaccttaacgttacccggttaaggttttaaccggaacggttaaaacggggttcccggggttaaccctaaggttaccgggttagggttaccgaagggtccggtaacgtagggtacggttacgtacggtacggggaaacttacgtacctttaacacccgtacttaaccaacctagttaacgaacgttaacgttcgtaaaccgtacgtaaacgtttacgggtaaatttacgttttaacgaacctttaaactttaagttaccgtagttaaacgaaacttaagttaaacgtttaacgttacgggttttaacgggttccccggggaaaacgtaaaccgggtaaccttaaaacggtaaacctttaaaaacgttaaaaacggttaaaccgtacggttacgggttaaccggtacctaaacccggtaacgttaaccccgttagtttcccgttaaacggtttcccgttaaacccttacccggtttaccccctacccgttaaccctacgtttacccggntttaaaccccgg

SEQ ID NO: 138982 - DNA, 667 bp, Homo sapiens
  misc_feature: GYAE6OF01CVTT2.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccggaggtgccagatgtgacatcgagctgacccagtctccatccctccctgtctgccaaccggtgggagacagtgtcaccatcacttggccgggacaaggtcggaactattgactacttatttaatggtatcaacatagaccaggggaccgaccctaagcctactaatctatgctgcacttccgagtttacgacgtaaaggtcggggtacccagtcggaggttcaggtcggcgtaggtggtatcgtagggaactaggtactttcacttctacaaccgtactactagtaacttctacgtaccgtaacgtagtaaagtttagttttacgtaaccttaaacgttttacttaaccgttagtaaccaaacgtaagttaaactttaactaacggtttcggttttacggaacccggtaaagggtaacctaaccggtaaacttaaactaaaacgttaacgaacgttaggtacggtactacgaccgtaacctattacttacggtttaccttactaccttcccgttaccccacttacgtcttagtaaccg

SEQ ID NO: 138983 - DNA, 761 bp, Homo sapiens
  misc_feature: GYAE6OF01AWZH1.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagttgtttcttcgtggggctgggtccgcagctccgagggagggctggaatacagttggaagtgtctctcataggtggtaggttcctattacagttccgtctctcaagtgtcgagtcaaccatactctcgtggacctaccggtcagactaatctacgtttccccttagaagtaagttgtacgtttacttcggtaggtacccggccgtaccgtcggtaacggtaccgggttaccggttttaagttttaccgtggttacggccggtaaggacgggtaccgggtaccgttaagttttaacggttgtttaaggttttttacgggttacgggttagggttttttacgtttaaacccggtacccgtaacccgttacgggttaacgttacccggggtacggggggttaccccggtccccgggttaacccccgggtacggggggttaccccggtaaaggggttaaacccggtaaccgttttacggggtcccggttaaccccgtttacccgtttaccccggtttaaccgtacccccggttaccccccgg

SEQ ID NO: 138984 - DNA, 744 bp, Homo sapiens
  misc_feature: GYAE6OF01C9MAP.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgccaaccggtgggagacagtcgtccaccatcacttggcccgggacaaggtcggaactattggacctaaccttaatttaaatggttaatcaaactagtaacgaaccgaacggggaccggaccctaagcctctaaatctatcgctgctactccgtagtttgacaaggttcggggtacccagtccggtaggttcaggtcggctaggtgggtaactcgtagggactaggtactttcacttctccaacgtactacgtagtaacttcgtacgtaactaaccggtagtaaacgtttagttttacgtaaccttaacttttacttaacgttcgtaaacaaacgttaagttaaacttaaccgttaaagtttccggttttaccggaacccggtaacgggtaaaccctaaccgtaaacttaaaccgttaaaaacgtttaaaccggtaaacgttacggttaccggaccgttacgtaacccgtaacccgtaacttttccgtttacgtttacctttaacccgttaaccgttttaccccgttttacccccggacctttaacctccgtttaaccgttaaaccg

SEQ ID NO: 138985 - DNA, 773 bp, Homo sapiens
  misc_feature: GYAE6OF01DFKL6.46.67.G01.1.454.CMB.1.raw
  modified_base (197)..(197): a, c, t, g, unknown or other
  misc_feature (197)..(197): n is a, c, g, or t
tcagactagcagtacacgaccggtgctcgatttagagtatacatattgggtttggggagtctcggtcaggacacagcatggacatgacgggtccccgctcagctcctggggctcctgctactctggctcgaggtgccagatgtgacatcgagctgacccagtctccactccctccctgtctgaccaaccggtggganacgagtcgtaccaaccaattcacgtttcggacccgggactaagtaccgggaaactacgtttagaaccctaacctttaattttaaacgttggttaactaccaaaacacgtaacgaaccggaacggggaaccggtacccctaagtacctaacctaattacctaatggtacctcgacctacttaccgtaaggtttcgaaccgtaaagggttccgggtaccctaagtcggtaaggtttccaaggtcgggactaggtaggtacgtacggtacggggtaactaaggttaccttttacgaccgtttcccaaccgtaaccgaaactttaacctaagttaaaccgtcgtaacggtaaaccaacgggtttaagtaaacggtttacttttacgaaactttaaactttattaaccgttataaccaaacttaagttaaacttaagttacgtttacggtttacgaacgtaacggaactaacggtaaaccttaaactaaaacgttaaacgtattaggtacgactaccggataaacccgttagttccgtattccttactaccgtttcctaccccgaactacttacagttacc

SEQ ID NO: 138986 - DNA, 777 bp, Homo sapiens
  misc_feature: GYAE6OF01CWYML.46.67.G01.1.454.CMB.1.raw
tcagactagcagtacacgaccggtgctcgatttagagtatacatattggggtttggggagtctcggtcaggacacagcatggacatgagggtccccgctcagctccgtggggctcctgctactctggctcggaggtgccagatgtgacatcgagctcgacccagtcctccacttccctccctgtctcgaccgaaccggtgggagacagtcgtcaccgtatcctacgttggccgggacaacggtacggaactacgttacgaacctaacctttaattttaaagttaggtaactacaaactagtaacgaccgacggggtacccgtaccctaagaccttacctaatcgtatcgctcgctacttcctaggttacgaacgtaacgggtccgggtaccaagtcgtacggttcgaggtcggacgtacggtggtacgtcggtaggaacgtagtactttccacgttctaccaactacgtacgtacgttaatccgtacgtaaccgtaacgttaaggtaacgtttacgtttacgaactttaaactttccgtaacttacgtaaactaaacgtatttaaacgtttacttaaggttttccggtttaaccggaacccggtaaaggtaccctaacggtaaacctttaaactaaaacgtttaacccggaagtttacgggtaacgtcccgtacgtaacccgtacccgtttaagttcccgtttaccgtttacccctttaaccgttaccgtttaacccccgttcccccgaacctttacttaccgttcggttaaacccg

SEQ ID NO: 138987 - DNA, 598 bp, Homo sapiens
  misc_feature: GYAE6OF01A9D2G.46.67.G01.1.454.CMB.1.raw
  modified_base (339)..(339): a, c, t, g, unknown or other
  misc_feature (339)..(339): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtgggggctgggtccggcagcctcccgaggggaaggggctggaatacattggaagtgtctctcatagtggaggttcctattacagtccgtctctcaagagtcgagtcaccatatctctggacacgtccagcaatcagttttcccngaagatgagttctgtgaccgccgctgacgacgggtcgttttattcgtgtgcgagagacgctattatgtagttttggagttggttatttcgactacccgtagtactcggacggggctcggaccccgttggggccgaggggaacttacgttggtccgtaccgtctcccgttacgtccctacccgaaccgaccgggcccctacggtcccggttcccttcccccgttcggcccctacccctcccgtcccaacgtacgtacccg

SEQ ID NO: 138988 - DNA, 829 bp, Homo sapiens
  misc_feature: GYAE6OF01DC3HJ.46.67.G01.1.454.CMB.1.raw
  modified_base (173)..(173): a, c, t, g, unknown or other
  misc_feature (173)..(173): n is a, c, g, or t
  modified_base (176)..(176): a, c, t, g, unknown or other
  misc_feature (176)..(176): n is a, c, g, or t
  modified_base (190)..(190): a, c, t, g, unknown or other
  misc_feature (190)..(190): n is a, c, g, or t
  modified_base (258)..(258): a, c, t, g, unknown or other
  misc_feature (258)..(258): n is a, c, g, or t
tcagactagcagtacacgaccggtgctcgatttagagtatacatattgggtttggggagtctcggtcaggacacagcatggacatgagggtccccgctcagctcctggggctcctgctactctggctccgagtgccagatgtgacatcgagctgaccagtcctcatcctcctntcngcaaccggtggganacagtgtacacatcacgttcgccggacagtacggaacattacgactaaccttaatttaacgttggtanactaacatacggacgacggaccgcctagctactatctatcgctgactactaccgtagtttacgaactaaacggttacgggtaccctaagtcggtaaggttccgaggttggacgtaaggtacggtacgtacggtagggtaacgtaacgtacttttacgactttaccgacgtaacctaacggtaccttaagaaccgtttttacgacggtaaacccgttaagggttaaacgttaaacggtttacgttttaaccgggtaaaacctttttaaacgtttaaacggttttaacccgtaaacggtttaaaccgtaaaacgtttaaaacccggtttaaagtttaaacccgttttaaacgggttttcccgggtttttaaaaccccgggaaccgggtaaaacccgggtaacctaaaaacccgggtttaaaaccttaaaaaaccgttttaaaacggttaaacccgtaaccggttaggttaaccgggtacctaacggtaaccaaaccgtttacctacggtttccctttaactaccgttacccttccccggtaaccacgttttaaacgtcgttaggttaaacccg

SEQ ID NO: 138989 - DNA, 906 bp, Homo sapiens
  misc_feature: GYAE6OF01B0XBZ.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctcgtgtcgcctcatctagtgttcgtttctcggtgggtcgtcgggtccggcgacgccgtaccggaggggaacgggtcgtaaggaatacgtagttagggagttcgtcctctcgtagtggtggtacggttcctacttacgacgtccgtctctacgaaggtacgtcgacgtaccacctattactccttacgtacggaccgaccgtacgacgacgtaacttacgtttaccgttttcccaaggtaacgtacgtaggtaacgttcttagggtacccgtacccggtcccgtcgtacggtaccggtacgggtttacgtttttaacgttaccgttaggtcggtacggtaaggaacgggtaccgggttaactttaacgtttagttaggtttttacggtttttaaggggttacggttttacgggttttaaccgtttaacccggtaaccccgttaaacccggttacgggttaccgggtaacccgggggttacccggggggtaccccgttaccccggggtacccccggggtacgggggtaaccccgggtaacgggttaaaccggttccgggtttaccgggttaccctaccccggtttaccgttccccggttaacccgtcccccgtacccggaaacccggtacccgggtaccccgttaacccgggtttccccggttccccccgttacccccggttccgggtaaccccctccccccgtttaaccccgtcccggtaaaccggcccgttaaacccccggg

SEQ ID NO: 138990 - DNA, 683 bp, Homo sapiens
  misc_feature: GYAE6OF01BBS3T.46.67.G01.1.454.CMB.1.raw
  modified_base (201)..(201): a, c, t, g, unknown or other
  misc_feature (201)..(201): n is a, c, g, or t
tcagactagcagtacacgaccggtgctcgatttagagtatacatattgggtttggggagtctcggtcaggacacagcatggacatgagggtccccgctcagctcctgggggctcctgctactctggctccggaggtgccagatgtgacatcgagctgacccagtcctccacttccctccctgtctgccgaaccggtggganacagtgtaccaccatcacttcggccggcaaggtccggaactattcgaacctacttaatttaaagttggtataccaacatacgacgacgggaccgaccctaagcctacctaagtctagtcgctcgactacgtaccgtaggtttacggaacgtaagggtccggggtaccctagtcggtaggttcgaaggtcggacgtaggtggacttcgagggtactagttacttcgtactcgtacctaacgtactataagttactcgtagacgtaacgttaggtaatttacgtttcgtaacttaacgtttactaaccgttagtaacctaaagtaacttaactttaactaggtttacggtttaccgaacggtaacggaacctaacgtaacgttaaactaaacgttaaccgaagttcgcggttacctacggtacaaccttattcgtaccgttaccttaccaccttcccgttacccattacgttacctgttaaccg

SEQ ID NO: 138991 - DNA, 876 bp, Homo sapiens
  misc_feature: GYAE6OF01E4VUK.46.67.G01.1.454.CMB.1.raw
  modified_base (98)..(98): a, c, t, g, unknown or other
  misc_feature (98)..(98): n is a, c, g, or t
  modified_base (774)..(774): a, c, t, g, unknown or other
  misc_feature (774)..(774): n is a, c, g, or t
tcagactagcagtacacgaccggtgctcgatttagagtatacatattgggtttggggagtctcggtcaggacacagcatggacatgacgggtccccgntcagctccgtggggctcctgctactctggctaccgaggtgccagatgtgacatcgagctgacccagtctccatccctccctgtctcgacctaaccggtgggacgactaggtcgtaccacctatcctacgttcgggacccggaactaacggtaccggaacctagtttacgaccttaaccgtttaaagttttaaaacgttggtaactacgaaacgtagttaaccggacccgacggggtacccgtaccctaaaggtccttaacctaacgttctaacgttacggaccgttacggtacctacttacccggtttaggtttacggtaacggtaaaccgggtttccggggtaccctaggttaccgggtacgggttacgacgggttcggtacgtaagggtacggtacgtcggtaacgggaactaggttaccttaccgtaccgtaacctaccgaaccgtagttaaccgtaaacgtttacgtccggtaaacggacccgttaaaggttagttaaacggtttacgttttaccggaacttttaaaccggttacgtttaacgtaacgtaaaccgtaaaaccgttaagtaaacgttttaaaccgtcgggtttaacccgggtttaaccgggaaccggtaaacggttaaccgtaaaccgttaaaccttaaaacggttaaacgttaaacccgggngtttcggtaacgtaccgtaccgaaccttacggtactttaccggttcgttaaccttccggttaacccttcccggttacaccctagtttcccgtagtttaaccg

SEQ ID NO: 138992 - DNA, 859 bp, Homo sapiens
  misc_feature: GYAE6OF01CWVZZ.46.67.G01.1.454.CMB.1.raw
  modified_base (195)..(195): a, c, t, g, unknown or other
  misc_feature (195)..(195): n is a, c, g, or t
tcagactagcagtacacgaccggtgctcgatttagagtatacatattgggtttggggagtctcggtcaggacacagcatggacatgagggtccccgctcagctcctggggctcctgctactctggctccggaggtgccagatgtgacatcgagctgacccagtctccactcctccctgtctgccaacggtggganacagtcgtccaccatccacgtttcggcccggggactaacggtaccggaaactactttacggaacctaacctttaatttttaaaacgttggttaaacttaccaaaacctaagttaacggaaccccgaacggggggtaaccccgggaccccccttaaaaggtccttaacccgttaaattccccttaaagttcgggacctttacggacctaacgtttaccccgtaaggtttttacggaaccggttaaaacggggttccggggggtttaccccaaggtttccggtaacggggttttacccgaagggtttccggggaccgttaaagggttggggtaaacgttccggttacgggggaacccttaagggtaactttttacccaactttccctaccgtaaccctagttaacctagtttaaacttccgtacggtaacctaaacggtaggttaaacgttagtttttaacggaacttaaacttttacttaccgttacgttaaacaacgtaactaaactttaaccttaagtttccggttttaaccggaaccgtaaagggaaccgtaaccgttaacttaaaccgtaaacgttaacgtaacttaggtcgactccgactaacctattaccttgttaccttaccaaccgttcccttacccgcctaacttcgttactaacg

SEQ ID NO: 138993 - DNA, 692 bp, Homo sapiens
  misc_feature: GYAE6OF01ANR7E.46.67.G01.1.454.CMB.1.raw
  modified_base (330)..(330): a, c, t, g, unknown or other
  misc_feature (330)..(330): n is a, c, g, or t
  modified_base (391)..(391): a, c, t, g, unknown or other
  misc_feature (391)..(391): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctcatcagtagtggtttctcgtggggctggggtccgcagcctccgaggggaagggctaggaactacagttggaagtgtctctcatagtggaggttcctattacacggtccgtctctanaagtgtcgagtcacctatactctcgtaggacacgtccagcaatctacgttttcccagtaanatagtacgttctcgtcggaccgcccgtcgtacgtaccgtacgggtactttttaacgttaccgttggttcggaccggtaaggtacggtacgggtcttaaagttttacgttgtttaagtttttttcgggaaggtttgggtttttaatttacccggtaactaccccgttaaggacggttccggggaccgggggttcccgtacccgggtaccccccgggtagggggacccggtaacgggtaaaccttaccgggttacggtcccgttaacccgttcccttacccgttacgccccgttaacccccgg

SEQ ID NO: 138994 - DNA, 632 bp, Homo sapiens
  misc_feature: GYAE6OF01EXFDW.46.67.G01.1.454.CMB.1.raw
  modified_base (208)..(208): a, c, t, g, unknown or other
  misc_feature (208)..(208): n is a, c, g, or t
  modified_base (300)..(300): a, c, t, g, unknown or other
  misc_feature (300)..(300): n is a, c, g, or t
  modified_base (327)..(327): a, c, t, g, unknown or other
  misc_feature (327)..(327): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactgggtgaggccttcggagaccctgtccctcacctgcgctgtctctggtgcctccatcagtagtggtttctctgggctgggtccgnagctccgagggagggctggaatacattggagtgtctctcagtagtgaggttcctattacagtccgtctctacaagagtcgagtcacatatcnctggacacgtcagcaatctagtttccngaagatgagttctgtcgaccgtccgcgtgacgtacgggtactttagtacgtgtgacgagacgacgtctagttattaggttagttttaggtagtttaggtttagtttcgtactaccgtagtacgtcggtacggggtcctacggtaccccggtggggaccgagggtaacgtacgttcggtaccgtacccgttccgtaccgttaccgtaccctacccgaaccggtaaccgggtacccgtacggttcccggttcccgttacccccgtccggtaccctacccctacccctacccgtaacggccgtacccg

SEQ ID NO: 138995 - DNA, 757 bp, Homo sapiens
  misc_feature: GYAE6OF01AB1T9.46.67.G01.1.454.CMB.1.raw
  modified_base (212)..(212): a, c, t, g, unknown or other
  misc_feature (212)..(212): n is a, c, g, or t
tcagactagcagtacacgaccggtgctcgatttagagtatacatattgggtttgggggacctcctgtgcaagaacatgaagcacctgtggtttgtcctcctgctggtggcagcctcccagatgggtcctgtccctggtgcaactgcaggacgtcgggcccagctggtgaggcccttggacgccctgtccctcacctgcgctgtctctggtcncctcatcgagttggttgtttctcgtggggtcctgggtaccgcagcctacccggaggggacggggctagggaactacagtttagggaagtcgtctctacaagttaggtcggtacggttaccttagttaaccgtacggtcccggttactccttacgaacggtcgtacgacggttccaacctatcttccgttcgtacggaaccctcggtaccaaggtacctaagttccttaaccggtttttcccgaagtaaacgtgttaggtacgttttactggtacccggaccggtccgtcgttacggaaccgtacggggttacctttttaagtccgttgtacggtacgacgacggtacggtacctttaagttacttcggtttaagttttcggggacgttttcggtttaactttaccggaccgttaaccgttggtaacggtcggggtaaccccggggctttacccggggtaccccggtagggtccggaaaggttcccggttaagttccgggttaccccgtacgtttaccccggttcctttacggccccgttacccgg

SEQ ID NO: 138996 - DNA, 586 bp, Homo sapiens
  misc_feature: GYAE6OF01EC692.46.67.G01.1.454.CMB.1.raw
  modified_base (401)..(401): a, c, t, g, unknown or other
  misc_feature (401)..(401): n is a, c, g, or t
  modified_base (552)..(552): a, c, t, g, unknown or other
  misc_feature (552)..(552): n is a, c, g, or t
tcagactagcagtacacgaccggtgctcgatttagagtatacatattgggtttgtcctcctgctggtggcagctcccagatgggtcctgtccctggtgcaactgcaggagtccgggcccacgactggtgaggccttcggagaccctgtccctcacctgcgctgtctctggtcgcctccatcagtagtggtttcttcgtggggctgggtccgcagctcccgagggagggctaggaatacagttggaagtgtctctacataggtggtaggttcctattacagtccgtctctacaagagtcgagtcaccatatctctggacacgtccagcaatctacgttttcccagaagtatgagttctgtcgaccgcgctgacgcgggtctttatactgtgacgagagacgntatttagtgttagttttggagttggtttattccgacacctagacgtcgggacgggctccggacccggtgggaccgagggtaactacgtggtccgtaccgtcttacctcgccctaccgaccgtacggccctacggtccgtcccttcccccgnggtccccaccccttacccgaccaagccgtacccg

SEQ ID NO: 138997 - DNA, 594 bp, Homo sapiens
  misc_feature: GYAE6OF01E11KC.46.67.G01.1.454.CMB.1.raw
  modified_base (364)..(364): a, c, t, g, unknown or other
  misc_feature (364)..(364): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagttggtttcttcgtggggctgggtccggcagcctcccgaggggaaggggctagggaatacgagttgggaagttcgtcttctactagtaggtgggaggtttccctaattaccagtccgtctctcaagagtcgagtcaccatatctctggacacgtccagctaatctagttttcccagaacgnttgagttctgtcgaccgcgctgacgtacgggtcttttaatcgtgtgacgagagacggtctattagtgttagttttggagttgtttattcgactaccgtagcgtcgggacgggtctccggacccgtgggaccgagggtaactcgtcgtcctaccgtctcttacgccctaccgaccgtacggcctacgttcccgtccttccccgcgtcccaccctcctaccaagcgtacccg

SEQ ID NO: 138998 - DNA, 622 bp, Homo sapiens
  misc_feature: GYAE6OF01D6COP.46.67.G01.1.454.CMB.1.raw
  modified_base (237)..(237): a, c, t, g, unknown or other
  misc_feature (237)..(237): n is a, c, g, or t
  modified_base (318)..(318): a, c, t, g, unknown or other
  misc_feature (318)..(318): n is a, c, g, or t
tcagactagcagtacacgaccggtgctcgatttagagtatacatattgggtttggggggacctcctgtgcaagaaccatgaagcacctgtggtttgtcctcctgctggtggcagctcccagatgggtcctgtccctggtgcaactgcaggagtcgggcccagactgatgaggccttcggagacccctgtccctcacctgcgctgtctctggtcgcctcatcagttgtgtttcttcgngggctgggtccgcagcctccgagggaagggctaggaatacagttggaagtgtctctctatgtggtacggttcctattacgngtccgtctctacgaagagtcgtagtcactatactctctgacacgtccagactactacgtacgttttcccagagtatagtagtttctcgtacgtaccgccgtctacgacgtaccgggtacttttattacgtggtcgacgagtacgtacggtacttaagttagttagtttaggttttgggtaagttggtttacttacgtacctaccgttaggtacgtccgggtaccgggtcccgtacccggacccggtcgggaccgaacgggtacttacggtcggtaccctaaccgttcctccgtaccgtaccccg

SEQ ID NO: 138999 - DNA, 959 bp, Homo sapiens
  misc_feature: GYAE6OF01D96XH.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtcccgtggtcgcctccatcagtagttggtttcttcgtggggctgggtccgcagcctccgagggagggctggaatacagttggaagtcgtctctctagtaggtggtacggttcctaattacacgtccgtctcttacgaagtagtacgtacgtccaaccgtatacttccttacgttacggacctaaccgttccaacggacctaaaacgttccgttaccggttttttccccgtaaggtaacggtaacttcgggttaacggtttaccgttgggttacccgggaaccccggtcccggttaccgtacgggtaacccgggtaacgggggttttacgtttttaaacgttaccggtttaggttacgggtaccggtaagggtaacggtaccgggttacttttaaacgtttagtttacggttttaagggtttttttacgggtaagggttttcgggtttttaaaccgttttaccggtaaacccccggttaacccggtttaacggtaacggttaccccggggggttaaccggggggtaccccttaccccggggtaaccccccgggttacgggggggtaaccccgtaaagggggtaaccttaacccgggtttcgggtacccccgttaacccggtttcccgtttacccgttacccgttacccccgttaaccccggaacccgggtaacccggggttacccccgtacggtttccccgggtttacccccctttcccccccgggtcggtacccccctaaccccccgtttccccgtaaacccgaaacggtccccgtaacccggtttaacccccgggg

SEQ ID NO: 139000 - DNA, 925 bp, Homo sapiens
  misc_feature: GYAE6OF01EXY1Z.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtccgggcccacgactggtgaggtcccttcggacgacccctgtcccctcacctgccgctgtctcgtggtcgccctccatcagtagttggtttctcggtgggtctggggtccgcagtcctaccggaggggaacgggtctaggaacttacaggttagggaacgttcgtccgtctacgtaagttacggtgggtaccggtttccttaagttaccgtacgttccgtctactacgaagtacggtacgacgtacctaccattacgtcctacgtcggaacccaccggttccaacgtactaaacgttccgtttaaccggttttccccaaggtaacgtagttacggtaacgtttcgtaggtacccgtaacccggtcccggtaccgtacggtaaaccgggtaccgggttttaccgttttaaacgttaccgttacggggtacgtaccgggtaacggtaaccgggtaccggtttaaccgttaaggttttacgttacgggttttaagtttttaggggtaaggttttacgggttttaaccgtttaacccgaacccggttaaacccgttagggtacggtttaccccgggggaacccggggtcccgtaacccgggtacccccggggtaagggggaacccggtaaaggggttaacccgttaacgggttcccggtaacccggtacccgtttacccgtaccgttaacccggcccccgtaaacccgtaaaccccgggaccggttacccctaccgggttcccggtttaccccccgtaccccggtcccgtaacccccgttacccctacccgtacccggtaaccggcgttaacccccggg

SEQ ID NO: 139001 - DNA, 850 bp, Homo sapiens
  misc_feature: GYAE6OF01CWIN6.46.67.G01.1.454.CMB.1.raw
  modified_base (175)..(175): a, c, t, g, unknown or other
  misc_feature (175)..(175): n is a, c, g, or t
tcagactagcagtacacgaccggtgctcgatttagagtatacatattgggtttgtcctcctgctggtggcagctcccagatgggtcctgtccctggtgcaactgcaggagtccgggcccagactgggtgaggcccttcggacgaccctgtccctcacctgcgctgtctctggtcncctcatcagtagttcgtttctcgtggggctgggccgcagcctccgaggggagggctaggaatacgagttggatgtactctgagtagtggtacgttcttaatacgtacgtccgtctctacgaagtacgtgacgtacaacctattactccgtcgtacggacctaccgtacacgactaactcgtacgttttccgagtaaagtgttaggtacgttccgtcgtccggaacccgcccggtctacggaaccggtaccgggtttacgttttaataaccggttggtacgcggtaagggacggaccggttattaagtttagtttaggttttagtttttacggggttaaggttttacggttttaacgttttaccggaacccttaaacccggttaggtaccggttacccggggtaccgggggttcccgttaccccgggtaaccccgggttacgggggtacccggtaaacgggggttaaacttcccggttacccgggttaccgtacccggtttacccttacccgttaccggtaccccccgttaacccggtaaacccgggtaacccggggttaccccttacccggtttcccccgggtttccccccgtttacccccccgggttcggtacccccccccgttaaccccgttccccgtaaaccccggtaaccggtaacccggttccccccggg

SEQ ID NO: 139002 - DNA, 773 bp, Homo sapiens
  misc_feature: GYAE6OF01C9T0T.46.67.G01.1.454.CMB.1.raw
  modified_base (203)..(203): a, c, t, g, unknown or other
  misc_feature (203)..(203): n is a, c, g, or t
tcagactagcagtacacgaccggtgctcgatttagagtatacatatttgggtttgggggagtctcggtcaggacacagcatggacatggagggtccccgctcagctccgtggggctcctgctactctggctccggaggtgccagatgtgacatcgagctcgacccagtcctccactccctccctgtctgacaaccggtggganactagtcgtacaccatcctacgttcggacccggggactaaggtaccggaactacttacgaacctaacccttttaaagttttaaaagttcggttaattaaccaaaacgtaacttaacggaacccggaacgggggtaacccgggtaccccgttaaaacggtaccttaacccctttaaaacggttacctttaacgtcgggtaccgttcgaccgtacctttacccgtaggttttaaccggaacgtaaaaacggggttcggggttaccccaaggttaccggtacggtttacgacggttggacgaggtaggacgttcgtagggaactagtactttcactaccgtacaacctactacgtaacttaatcgttacacgtaagtacgtaaaggttatttacgacttaaactttcttaatacgtaactaagtaataacttaactagttacggtttacgaacgtacgggtaaccctaaagtaacctaaacttaaaagtaacggtaaccgttggagtcgacgtacctaactacgttacttcgttacctactacgtttccccaccgtacctactcgtgttaacc

SEQ ID NO: 139003 - DNA, 1025 bp, Homo sapiens
  misc_feature: GYAE6OF01DM97A.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtcctggtgcaactgcgaggacgtccgggcccacgacgtgggtggacggtccgttacggacgaccccgttcggtcccctccgaccgtcgccgtcgttcgttctcgtggtccgtccctacaatcgtaaggttggttcggttttccttcggtcgggggtccgttcgggggtcccgcgtacggtcccgtaccgggaagggggtaacggggtccgttagggtaaagttaaccgtaaggtttaggggtaacggtttcgttccgttcgttacgttaaggtttaacgggttacgggggttaccggttttaacccgtttaacgttttaaccggtaaccggtttccccgtttaccgtttaccgttaacggtaaagggtaccggttaccgggttaacggtaccctaaacccttaaagtttaaccgttcccgttaccggttaccgggtaaacccgtaccccggttaccgaaacgtaacccgttaaaccgtttacccggttttaacccgtttttaccccggaaggtaaacgggtttacgtttacgggttaacgttttccggtaccggttaccgggtacccccgtaccgggttccgttaaacgggtaacccgggtttacgggttttaccgtttttaacgttaccgggttcggtaacggtaacgggtacggttaaccggtacgtttaagttacggtttacgtttaggttttacgggtttaggtttacgggtttacgtttaaccgttacccggtaaccgttacggttaaccgggttccggggacggggttacccgggtacccggttccccgggtaacgggtcggggtaaaccgggttacggtaccggttaccggttccggttaaccccggttccgttacccgtttacccgtcccggtcccgtaaccccgggg

SEQ ID NO: 139004 - DNA, 586 bp, Homo sapiens
  misc_feature: GYAE6OF01EEL7J.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcgggagaccctgtccctcacctgcgctgtctctggtgcctccatcagtagttggtttcttcgtggggctggggtccggcagctcccgaggggaaggggctgggaatacagttggaagtgtctctcagtagtggaggttcctattacagtccgtctctcaagagtcgagtcaccattatctctggacacgtccagcaatcagtttttccctgaagatgagttctgttgaccgcccgctcgacgacggggcgttttaattactggtgcgagagacggctattattgtattttggagttggtttatttcgactaccctagagtcggacggggtcctcggaccccgtggggccaggggaattacgtggtccaccgtctccttacgccctccaccgaacggcccagtccggtcccttcccccgtcggccctacccctccctaccgagccgtacccg

SEQ ID NO: 139005 - DNA, 598 bp, Homo sapiens
  misc_feature: GYAE6OF01BNPLU.46.67.G01.1.454.CMB.1.raw
  modified_base (193)..(193): a, c, t, g, unknown or other
  misc_feature (193)..(193): n is a, c, g, or t
  modified_base (297)..(297): a, c, t, g, unknown or other
  misc_feature (297)..(297): n is a, c, g, or t
tcagactagcagtacacgaccggtgctcgatttagagtatacatattgggtttgggggagtctcggtcaggacacagcatggacatgagggtccccgctcagctcctggggctcctgctactctggctccgaggtgccagatgtgacatcgagctgacccagtctccatcctccctgtctgcaaccgtgggancagtgtccaccatcacttgccgggcaagtcggaacattgacaccttatttaaattggtatcaacatagaccagggaccgccctaagctacctaatctatcgctncatcctagtttgacaaaggtcgggtcccagtcgaggttcaggtgactagtgatcgtagggactagtatttcactctacaccatcaagtatctacacaacgtagtaagtatttcgacttaaacttattaacgtgtacaacgtaataattaactaatttacggtttaccgaaccgtaacgggtaacctaacggtaaccttaaacgtaaaacttaaaccgtaacgttcggtaggtacctacgaccgtaactacgttacttcgtaccttactacgttcccttaccccgactactccgtagtaacc

SEQ ID NO: 139006 - DNA, 745 bp, Homo sapiens
  misc_feature: GYAE6OF01COSXK.46.67.G01.1.454.CMB.1.raw
  modified_base (174)..(174): a, c, t, g, unknown or other
  misc_feature (174)..(174): n is a, c, g, or t
  modified_base (293)..(293): a, c, t, g, unknown or other
  misc_feature (293)..(293): n is a, c, g, or t
  modified_base (348)..(348): a, c, t, g, unknown or other
  misc_feature (348)..(348): n is a, c, g, or t
tcagactagcagtacacgaccggtgctcgatttagagtatacatattgggtttgtcctcctgctggtggcagctcccagatgggtcctgtccctggtgcaactgcaggagtcgggcccagactggtgaggccttcgggagacccctgtcccctcacctgcgctgtctctggtcnccctccatcagtagtggtttctcgtggggctgggtccgcagcctccgaggggaagggctggaatacagttggaatgtctctcagtagtggaggttcctattacagtccgtctctcaagngtcgagtcactatatctctaggactcgtccagcaatctacgttttcccagaagtntgtagttctgtacgaccgccgctagaccgacggggttctttaacttacgttggtagacgtaaggacgtaccggtacttaactttagtaggtttaagtttttagggtaaggtttggttttacgtttaccggaacccgtaacccgttaaggtacgttacccggggacccgggggtccgtaccccgggtaacccccgggttacgggggaccccgtaaacgggggtaaccgttacggttaccggtaccgtacccgttccgttacccgttaccgtcccccttacccgaacccggtaaccgggaccccttacgggttcccccggttaccccgtttccccccccggtcggtacccccttaccccccgttacccgtaaccccgtaaccgccggttaaccccccgg

SEQ ID NO: 139007 - DNA, 643 bp, Homo sapiens
  misc_feature: GYAE6OF01DMUL8.46.67.G01.1.454.CMB.1.raw
  modified_base (229)..(229): a, c, t, g, unknown or other
  misc_feature (229)..(229): n is a, c, g, or t
tcagactagcagtacacgaccggtgctcgatttagagtatacatattgggtttggggagtctcggtcaggacacagcatggacatgagggtccccgctcagctcctggggctcctgctactctggctcgaggtgccagatgtgacatcgagctgacccagtctccatcctccctgtctgcaaccggtggagacagtcgtcaccatcacgttggccggacaagtcggaanattagacctaaccttatttaaattggtatacaacatacgaaccgagggaccgacccctaagtcctacctaatctatcgactgctactccgtagtttcgacgtaaggtcgggtaccctagtcggtaggttcgaggtcggcgtaggtaggtatcggtacgggataggtatttccgacttcctaccacctatacgtaagtaatcgtacgacctaagtacgtaagttatttacgacttaacttacgttaactgtaactaataagttaaattactaagtttacggtttacggaccgtaaggtaaccacgtaactaaactaaaacttaacgtacgttagtacgtactacgaacctaccgttattacgttacgtttaccttaccttaccttcccttacccgtacttctcgttacgtaaccg

SEQ ID NO: 139008 - DNA, 688 bp, Homo sapiens
  misc_feature: GYAE6OF01D596I.46.67.G01.1.454.CMB.1.raw
  modified_base (175)..(175): a, c, t, g, unknown or other
  misc_feature (175)..(175): n is a, c, g, or t
  modified_base (286)..(286): a, c, t, g, unknown or other
  misc_feature (286)..(286): n is a, c, g, or t
  modified_base (295)..(295): a, c, t, g, unknown or other
  misc_feature (295)..(295): n is a, c, g, or t
  modified_base (340)..(340): a, c, t, g, unknown or other
  misc_feature (340)..(340): n is a, c, g, or t
  modified_base (344)..(344): a, c, t, g, unknown or other
  misc_feature (344)..(344): n is a, c, g, or t
tcagactagcagtacacgaccggtgctcgatttagagtatacatattgggtttgtcctcctgctggtggcagctcccagatgggtcctgtccctggtgcaactgcaggagtccgggcccacgactgggtgaggtccttcgggagaccctgtccctcacctgcgctgtctctggtncctcatcagtagtggtttctcgtgggctgggtccgcagctccgaggggagggctaggaactacagttggaatgtctctcagtagtggtaaggttcctattacaggttcctntctacaagngtcgagtcacatatctacgtggacacgtcagcaatctagtttccngtanatgtattcgtgtacgaccgtcgctacggtacgtacgggtcttttaacgttaccgtggtacggccggtaaggtacggtaacggtcgttaagtttagttagttagtttttagggaggtttacggtttaacgttttccgaaccgtacccgtagtacggtccgggtaacggggtcctacccgggtacccggtacgggtacccggaaaggggtaccgttacggttccgggtacctacccggttcgttacccttacggaccccttaccgaaccggtaacgggtcccctacggttacccgttcccttcccccggaggtcccctacccgttcccaccgtaagccgtaccccg

SEQ ID NO: 139009 - DNA, 883 bp, Homo sapiens
  misc_feature: GYAE6OF01C4NB0.46.67.G01.1.454.CMB.1.raw
  modified_base (172)..(172): a, c, t, g, unknown or other
  misc_feature (172)..(172): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtcncctcatcagtagttggtttcttcgtggggtctcgggtccgcagtcctcccgaggggaaggggctaggaatacgagttgggaagtgtctcgtcagttaggtggtacggttaccttattaccgtagtcccgtctctacaagagtacgacgtacacctatacttctcgtggaccacgtccagacaatcgtacgttttcccagaagtatgtacgttcgtcgttacggacccgccgtcgtacggtaaccggtaccggggtttacgttttaacgttaccgttggttcggtacggtaagggtaacggtaccgggttactttaattttaacggttggttttaacggtttttaagggttacggttttaagggtttttaactttaccccggaacccgttaaacccccggttagttaccgggttacccggggacccggggggttacccttaccccggggtaacccccgggttacgggggaacccgtaagggggttaaccttaccgggttaccgggttaccccgttacccggtttacccttaacccggttaacccggtcccccgtaacccccgggtaaaacccgggtaacccggggttacccccctaaacgggttttccccccggtttaacccccgtttcccccccggtaacccggttcccccccttaaccccccggttaccccctaaacccgggtaacccggtaccggttaacccccccggg

SEQ ID NO: 139010 - DNA, 578 bp, Homo sapiens
  misc_feature: GYAE6OF01ADN75.46.67.G01.1.454.CMB.1.raw
  modified_base (217)..(217): a, c, t, g, unknown or other
  misc_feature (217)..(217): n is a, c, g, or t
  modified_base (291)..(291): a, c, t, g, unknown or other
  misc_feature (291)..(291): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggnaagtcggaacattgacaccttatttaaattggtatcaacatagaccagggaccggccctaagctcctaatctangctgcatccagtttgacaaaggtcgggtccagtcgtaggttcagtggcagtgatcgtaggacagtatttcactctcacatacagtaatctagactaacgtgtaaagtattttcgacttaacttattacgtagtacaacgataaattacaattcggtttaccggaccgtaaacgggacctaaccgtaacttaactaaaagttaaacgtaacgtacgtcggactcgaccgtaactattactagttcctttacacttacccgttacccgtaacctattccgtagtaaccg

SEQ ID NO: 139011 - DNA, 653 bp, Homo sapiens
  misc_feature: GYAE6OF01DK8B1.46.67.G01.1.454.CMB.1.raw
  modified_base (253)..(253): a, c, t, g, unknown or other
  misc_feature (253)..(253): n is a, c, g, or t
  modified_base (311)..(311): a, c, t, g, unknown or other
  misc_feature (311)..(311): n is a, c, g, or t
  modified_base (365)..(365): a, c, t, g, unknown or other
  misc_feature (365)..(365): n is a, c, g, or t
tcagactagcagtacacgaccggtgctcgatttagagtatacatattgggtttgtcctcctgctggtggcagctcccagatgggtcctgtccctggtgcaactgcaggagtccgggccccacgactggtgaggcccttcggagaccctgtccctcacctgcgctgtctctggtgcctccatcagtagtggttttcttcgtggggctgggtccgcagctccgagggaagggctggaatacattggaagtgtctntcatagtggaggttcctattacagtccgtctctacaagagtcgagtcaccagtatctntaggacagtccagcaatcagtttttcccagaacgatgagttctagtcgaccgcnctagacctacgggtcgtttaattactggtgcgagagacgacttattagtgttatttttaggaagttggtttaactttcggtaacctacccgttaagactttcgggaacggggccttaccggaaccccggttcggggacccgaaggggtacttaccgtgggtaccctaccggttcttcccgtttaacggcccttacccgaacccggaaaccggtcccctaacgtcccgggttccccttcccccgtacgggtaccctaaccccctcccgttaccgaaagtccgaaacccg

SEQ ID NO: 139012 - DNA, 703 bp, Homo sapiens
  misc_feature: GYAE6OF01ED06N.46.67.G01.1.454.CMB.1.raw
  modified_base (204)..(204): a, c, t, g, unknown or other
  misc_feature (204)..(204): n is a, c, g, or t
  modified_base (252)..(252): a, c, t, g, unknown or other
  misc_feature (252)..(252): n is a, c, g, or t
  modified_base (278)..(278): a, c, t, g, unknown or other
  misc_feature (278)..(278): n is a, c, g, or t
  modified_base (294)..(294): a, c, t, g, unknown or other
  misc_feature (294)..(294): n is a, c, g, or t
  modified_base (339)..(339): a, c, t, g, unknown or other
  misc_feature (339)..(339): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccntcattcgccggcagtcgactattgacacttaattaattgtatacaacngtacgaccgagggccgacccgtaaanctacctaactctagtncgtcgctactcctaggtttcgaacgtaagggtcgggtacccctanaccgggttacggtacgtacggtacggacggtaggtaggtacgttacggtacggtaacgtaacgttacttacctaccttacctaacctaacctaacgtactaacgttaacgttacgtacgtaacgtaacgttaagtaaagtttacgtttacgtaaccgttaactttaacgttaacttacgtaactaacgtaacgttaaacttaacgttaacgtttacggtttaaccggtaaccggtaaacggtaaccgaaaccgttaaacttaaacttaaaacgttaaaacgtaacgtacggtacgtacgtacgtaccgtaactacttcgttacgttacttactaccttaccctaccctaccttacgtacgtacg

SEQ ID NO: 139013 - DNA, 578 bp, Homo sapiens
  misc_feature: GYAE6OF01DYGYG.46.67.G01.1.454.CMB.1.raw
  modified_base (218)..(218): a, c, t, g, unknown or other
  misc_feature (218)..(218): n is a, c, g, or t
  modified_base (406)..(406): a, c, t, g, unknown or other
  misc_feature (406)..(406): n is a, c, g, or t
  modified_base (516)..(516): a, c, t, g, unknown or other
  misc_feature (516)..(516): n is a, c, g, or t
tcagactagcagtacacgaccggtgctcgatttagagtatacatattggggtttggggagtctcggtcaggacacagcatggacatgagggtccccgctcagctcctggggctcctgctactctggctccgaggtgccagatgtgacatcgagctgacccagtctccatcctcctgtctgcaaccgtgggagacagtgtcaccatcacttgccggganaagtcgaacattgacacttatttaatgtatcaacatagaccgagggaccgaccctaagctactaatctatgctgctatcctagtttgacgtaaaggtcgggtccagtcgtaggtcaggtggcaggtgatcgtggactagtatttcacttctacactatacagtaatctagactaacgttagaagtttnttacgtactaactttattaactgtacaaatagttaaactacttaagtttcggtttaaccgacggaacggtactaacgtaaacttaaataaacgttaacgacttggagtcncgtacaccttagtacttccgttattccgtacctttcctaccccgtacttacgtcttagtaac

SEQ ID NO: 139014 - DNA, 599 bp, Homo sapiens
  misc_feature: GYAE6OF01BH69L.46.67.G01.1.454.CMB.1.raw
  modified_base (211)..(211): a, c, t, g, unknown or other
  misc_feature (211)..(211): n is a, c, g, or t
  modified_base (248)..(248): a, c, t, g, unknown or other
  misc_feature (248)..(248): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtncctcatcagtagtgtttctcgtggggctgggtccggnagcctccgagggaaggggctaggaatactagttggaagtgtactctctagtagtggtaggttcctagttacagttccgtctctacaagtagtcgagtcacctatatctcgtgacacgtccagacaatcgtagttttcccagtaagtatgtagttctggtcgacccgcgtctcgaacgtacgggtactttattacgtggtgcggtaagcgtacggtcttaagttatgttagttttagggagtttggtttactttcgaacttaccgtagtactcgggacggggtcctaccggtacccggtggggccgaagggtatacgtcggttacacccgttcttacctgtcccgtaacccg

SEQ ID NO: 139015 - DNA, 590 bp, Homo sapiens
  misc_feature: GYAE6OF01ETSM5.46.67.G01.1.454.CMB.1.raw
tcagactagcagtacacgaccggtgctcgatttagagtatacatattgggtttgggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttggccgggcaagtcggaacatgacaccttattaaattgtatcaacatagaccagggaccgccctaagctcctaatctatgctgctactcctagtttgactaaaggtcgggtcccagtcgtaggttcaggtgcgagtggatcgtagggactaggtatttcactctacacctagtacagttactctagcaaggttagaagttatttgacttaacttattactgtactaacagtaacttactattggtttaccgaccgtaaggacctaacgtaactaacgtaaaacgttaaaccgattacgggtcgtacctaggtaccctaacgtattcgtacgttaccttactaccttccccgttacccctaccttacttcgttagtaaccg

SEQ ID NO: 139016 - DNA, 772 bp, Homo sapiens
  misc_feature: GYAE6OF01EAGMM.46.67.G01.1.454.CMB.1.raw
  modified_base (174)..(174): a, c, t, g, unknown or other
  misc_feature (174)..(174): n is a, c, g, or t
tcagactagcagtacacgaccggtgctcgatttagagtatacatattgggtttgtcctcctgctggtggcagctcccagatgggtcctgtccctggtgcaactgcaggagtccgggcccacgactggtgaggccttcggacgaccctgtccctcacctgcgctgtctctggtcncctcatcagttagttgtttctcgtgggctcgggtccgcacgcctaccggaggggaacgggtctaggaactacgtagttaggaagtcgtcttctactagttaggttggtacggtttccttagttacgtacgttccgttctctacgaagtacgtcgacgtaccacctattactccgtcgtacggacctaccgtccagtactaacttcgttaccgttttccgagaagtatcgtacgtttcgtcggtacgacccgtcgtacgtcggtaacggtacggttacgttttatacggtgtcggtaacggtacggacggtaccgtactttaagtttagtttacggtttaggtttttagggacgttttaggtttactttacccggtaaccctaacccgtaggtaccggtcccggggtaccggggtcccgttacccggtcccgggtagggggtacccgtaaggggtaaccttacggtccggttacccgtaccgttccgttacccgttaccgtccccaacccgtaacccggtaccggtcccttaccggttccccgttaccccgttcccccggcgtacccctcccccgttacaccgtacgcccgtaccccgg

SEQ ID NO: 139017 - DNA, 690 bp, Homo sapiens
  misc_feature: GYAE6OF01EVZ5X.46.67.G01.1.454.CMB.1.raw
  modified_base (211)..(211): a, c, t, g, unknown or other
  misc_feature (211)..(211): n is a, c, g, or t
  modified_base (350)..(350): a, c, t, g, unknown or other
  misc_feature (350)..(350): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggnagctccgaggggaaggggctaggaatacagttggaagtgtctctcatagtggagttcctattacagtccgtctctacaagcgtcgagtcaccatatctcgtggacacgtccagcaactcttacgttttcccagtaaagnttaggtagtttctaggtcgaccgccgtacgtacgaacgtacgggtacttttaacgtacgtggtacgacggtagacgtacggtacttaatttacgtagtttagtttttagggagtttcggtttagtttaccgaacctacccgttaggacttcgggaccgggggtccttaccggaccccggtggggaccgtaagggtaacttaccggttcggtacccgtaccgttaccttaccgttaccgtcccctacccgaacccggaccggtaccctacgttcccggttccccttacccccgtcggtacccctacccccgttacccctaccgaaacggtccgtaccccgg

SEQ ID NO: 139018 - DNA, 665 bp, Homo sapiens
  misc_feature: GYAE6OF01AZ5AI.46.67.G01.1.454.CMB.1.raw
  modified_base (189)..(189): a, c, t, g, unknown or other
  misc_feature (189)..(189): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcacgtggganacagtgtcaccatcacgttggccgggacaaggtcggaaactatttcgaacctaaccttaattttaaagttcggtaatacaaactataacggaccaacggggaccgaccctaagcttacctaatcgtatcgctagcacttccgtagtttcgagtaacggtcggtaccagttcggaggttcaggtggactaggtggaatcggacgggactaacgttacttacactctaccgactaactccgtaagttactccgaaggactaacggttaataggtttactttcgaacttaaacgtttacttaactcggtaactaaacgtactaaatttacttaacgtttggttaccggaacgttaacgggaacctaacggtaattaaacgtaaacgttaaccgagttggtacggtaaactccgaaccgtacctggttaacctcgtttacctacctaccgttacccgttcccaaagttctcgttgtaacg

SEQ ID NO: 139019 - DNA, 872 bp, Homo sapiens
  misc_feature: GYAE6OF01B20Q7.46.67.G01.1.454.CMB.1.raw
  modified_base (233)..(233): a, c, t, g, unknown or other
  misc_feature (233)..(233): n is a, c, g, or t
tcagactagcagtacacgaccggtgctcgatttagagtatacatattgggtttggggacctcctgtgcaagaacatgaagcacctgtggtttgtcctctgctggtggcagcctcccagatgggtcctgtccctggtgcaactgcgaggacgtccgggcccacgacgtgggtcggacggtccgttacggacgtaccccttcgtcccctctacctgccgtctcgtctcgtggtcncctccatcgtaggttacgttcggttttcgttcggtcggggtccgttcggggtaccggaacgtccgtacccgggaaggggggaacgggtcgtaagggtaaacttaccgtaaggttacggtaacggttcgttaccttacgtacgtaaggttaggggttacgggttaacggttttacccttaagtttaacccggtaccggtttccccgttaccttaccgtaaccggtaaacgggttacgggttaaccggtaaccgtaccctaaaccttaactttactcccggttacggtacggtaaaccctaccgttaaccgaacgtaaccttaacgtttccgttttaacccggttttacccgaagggtaaagttacggttcggttacggtttcgtaccgggttacccggaaccccggtccgttacggtaccggtaaccggttaccgggtttacttttacgtacggtcggtacggacggtaagtacggtaccgttatttaagttagtttagtttcggttttaggtagtttcgtttaactaccgtaccgtacgtaggaccggtccggggtacggtcccgtacccgggaccggtgggaccgtaggtaccgtcggtccgtacctccgttctaaccgtccgtaccctcccgaacgg

SEQ ID NO: 139020 - DNA, 592 bp, Homo sapiens
  misc_feature: GYAE6OF01CAZJ1.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaacgtgggagacagtgtcaccatcacttgccggcaagtcggaacattgacactatttaaatgtatcaacatagaccgaggacgccctaagctacctaatctatcgctcgcactcctagtttcgactaaaggtcgggtacccagttcggaggttcaggtcggacgtaggtggatcgtagggactaggtatttcactctcactatctagtaactctgactaacgtgaaagttcttttagaaccttaagttacttacgtagtactaaacgtagtaaacttacgtaaagtttcggtttaccggaccgttaagggaacctaaccgtaactaaacgtaaaacttaacgaacttaggtcgacgtcgaccgtactagttctcgttcttacgacttcccttaccgactaactcgtagtacg

SEQ ID NO: 139021 - DNA, 823 bp, Homo sapiens
  misc_feature: GYAE6OF01CDO19.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggccccacgactggtgaggccttcggagaccctgtcccctcacctgcgctgtctctggtgcctccatcagtagtggtttctcgtgggctgggtccgcagctcccgaggggaacgggctaggaatacagttggaagtgtctctcagtagtggaggttcctattacagttcccgtctcctcgaagagtcgagtcaaccatatctctggacaccggtccagcaatccgtagttttccctagaagacttgagtttctggtacgacccgtccgctacggaaccgtaccggggtcgttttaacgttaccgtggttacggacggtacggacggtaccgggtacgttaactttaagttacgtttaaggttttttagggtaaggttttacgggttttaacgttttaccggtaaccccgttaaccccgttaaggtaaccggtttacccggggtaacgggggggttacccgtacccgggtaaccccccgggttcgggggggtaccccggtaaacgggggtaacctttaccgggttcggtacccgtacccggttccccgtttaacccgttaccggtccccgtacccggtaacccccggtaaaccggggtacccccgtaacggttccccgggtttacccccgttccccccccggttacgggtaccccccttaccccccgttaccccctaaccccgtaaacccgggacccggttaaccccccgg

SEQ ID NO: 139022 - DNA, 786 bp, Homo sapiens
  misc_feature: GYAE6OF01ALZ2F.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtcctccatccctcctgtctgaccgaaccggtgggagactagtcgtaccaccatccgacgttcggccgggacaacggtcggaactagttacgaacctaacctttaatttaaagttggtaatacaactatacgaccgagggacccgaccctaacgccttacctaatctagtcgtctgctactcgtagtttacgacgtaacgggtccgggtaccctagtacggtaggttcgaggtcggactaggtcggtagtcggtaggactagttactttaccaccgttcctacgaacctacgtactaaggttactaccgtagtaacgtaacggttacgttaagtttacgtttacgtaacctttaacgtttacgttaaccgttacgtaaacccttaaagtaaccgtttaaaactttaacgttaaacggttttccggttaaccgggtaacccggtaaaacggttacccgtaaacccggttaaaccttaaaacgttaaaacccgttaaacgttaaccgggttacgtaccggtaccgttaaccgtacccgttaaccttaccgtttacggttccttttaccccgttaacttaccccgtttaccccggttaccctaaccgttaccgttactcggttaaaccc

SEQ ID NO: 139023 - DNA, 622 bp, Homo sapiens
  misc_feature: GYAE6OF01CVBSQ.46.67.G01.1.454.CMB.1.raw
  modified_base (338)..(338): a, c, t, g, unknown or other
  misc_feature (338)..(338): n is a, c, g, or t
tcagactagcagtacacgaccggtgctcgatttagagtatacatattgggtttgtcctcctgctggtggcagctcccagatgggtcctgtccctggtgcaactgcaggagtcgggcccagactggtgaggccttcggagaccctgtccctcacctgcgctgtctctggtgcctccatcagtagtggtttctcgtggggctggggtccggcagtcctcccgaggggaacggggctagggaaatacgagttgggaagttcgtctctcaagtaggtggacggttcctaattaccagttcccgtctctcaaggtagtcgagtccaccgatatctctggaccncgtccagcaaatctacgttttcccagaagtatgtagttctagtcgaccgccgtctggaaccgacgggttactttactacgtggtcgacggagacggtacggtcttaattacgtgtttagttttgggaggtttaggtttacttcgactaccgtagacgtcgggacgggtctccgacccggtgggaccgtagggtactcgtacggtcaccgtctaccgtcgaccctcaccgacgccctagtccgtcccgttaccctcggacccaccctcccaccgagccgtacccg

SEQ ID NO: 139024 - DNA, 741 bp, Homo sapiens
  misc_feature: GYAE6OF01B0C4O.46.67.G01.1.454.CMB.1.raw
  modified_base (731)..(731): a, c, t, g, unknown or other
  misc_feature (731)..(731): n is a, c, g, or t
tcagactagcagtacacgaccggtgctcgatttagagtatacatattgggtttggggagtctcggtcaggacacagcatggacatgagggtccccgctcagctccgtggggctcctgctactctggctcggaggtgccagatgtagacatcgagctcgacccagtcctccactccctccctgtctacgaccgtaaccggtgggacgacgtaggttcgaccaccattccgtacgttcgggaccggggtactaacggtccggaaactacgttacgaaccttaacctttaagttttaaacgtggttaactacaacgtagtacggaaccggacgggaccgtaccctaagtccttacctaactctagtacggctacgactacgtaccgttaggttacgaaccgtaaagggtcccgggtaccctaggttaccggtaacggttacgagggttcggacgtaagggtcggtacgtacggtacgggtacgtaagtttacttaccgaacttccgtaaccgaaccttacgttacgtaacgttacgtacgtacggtaaccgtaacgtacgttaagtttactttacggaaacctttaagttactacgtagtaacctaacgtaagtaacttaacgtaacgtttacggttacgaaccgtaggaactaacgtaaacttaactaaagttaaccgagtacgtgaccgtagacctacgtctcgttctacgttctacttccctacaccgttntacgtctacg

SEQ ID NO: 139025 - DNA, 622 bp, Homo sapiens
  misc_feature: GYAE6OF01CG6NF.46.67.G01.1.454.CMB.1.raw
  modified_base (307)..(307): a, c, t, g, unknown or other
  misc_feature (307)..(307): n is a, c, g, or t
  modified_base (326)..(326): a, c, t, g, unknown or other
  misc_feature (326)..(326): n is a, c, g, or t
  modified_base (331)..(331): a, c, t, g, unknown or other
  misc_feature (331)..(331): n is a, c, g, or t
  modified_base (357)..(357): a, c, t, g, unknown or other
  misc_feature (357)..(357): n is a, c, g, or t
  modified_base (483)..(483): a, c, t, g, unknown or other
  misc_feature (483)..(483): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctcgtggggctgggtccgcagcctcccgaggggaacgggctggaatacgtagttgggaagttgtctcgtcagttaggtggtaggtttcctaagttaccgagttcccgtctctcaagngtcgagtcaccatatctcnggacncgtcagcaatctacgtttccagaatntgtagttctgtcgaccgccgctagacgtcgggtcgtttattacgtgtgcgagacggtacggtactagttagtagttagttttggagtttggtttattcgactacccgtagacgtcggacgggtccnccggtacccgtacgggccgaagggtacttaccggtcgtaccgtaccgttccgtacctacgccctaccgaccgtaaccggccctacgttcccggtcccttccccgtcggtacccacccgtaccctaccaacgcctacccg

SEQ ID NO: 139026 - DNA, 668 bp, Homo sapiens
  misc_feature: GYAE6OF01AK8WY.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctcgacccagtctccatccctcctgtctcgcaacggtgggacacgagtcgtacaccatccacgttcggcccgggacaacggtccggaactagttcgaacctaccttaatttaaacgttggtaactaccaacgacttacggaccgacgggaccgtaccctaagcctacctaatctagtcgctagcctactccgtagtttacgacgtaaaggtccgggtcccagtcggtaggttcagtcggactaggtcgatcggtaggactacgtacttaccacctacacctactacgtacgtaactcgtagacgtaacgtagtacttacgtttacgacttaactttatacgttacgtaacaacgtaacgtaattaacgtacgttacggtttccggaacgtaacggactaaccgtaacttaacctaaacgttaaacgacgttacggtgtcctaacgtacctaacgtcttacgttaccgttccttaccgtaacgttcccgttacccgctaacgttctcgtacttaccg

SEQ ID NO: 139027 - DNA, 680 bp, Homo sapiens
  misc_feature: GYAE6OF01DE48B.46.67.G01.1.454.CMB.1.raw
  modified_base (193)..(193): a, c, t, g, unknown or other
  misc_feature (193)..(193): n is a, c, g, or t
  modified_base (220)..(220): a, c, t, g, unknown or other
  misc_feature (220)..(220): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtggganacagtgtcaccatcacgttgccggganagtcggaactattgactactatttaaatgtatcaacatagaccgagggaccgccctaagctactaatctatgctgcatcctagtttgactaaggtcgggtccagtcgaggttcaggtggctaggtggatcgtaggggactagtatttacgacttcctacaccctatacgtaagttaactctgtaaccgtaacgtagtaagttagttttacgacttaacgtttatttaccgtagttaccaaactaagttaaactttaacgttaagtttacggtttttaccggaaccgtaaacgggtaacctaacggtaaacttaaaccgtaaaacgtttaaacgtaacgtttacggtaggtacccgtacgtacccgtaaccgtaactttccgtttacggtttaccctttaaccgttaccgtttacccccgttttacccccggtaccttacgttaccgttacggttaaaccc

SEQ ID NO: 139028 - DNA, 747 bp, Homo sapiens
  misc_feature: GYAE6OF01CVY6T.46.67.G01.1.454.CMB.1.raw
  modified_base (256)..(256): a, c, t, g, unknown or other
  misc_feature (256)..(256): n is a, c, g, or t
  modified_base (409)..(409): a, c, t, g, unknown or other
  misc_feature (409)..(409): n is a, c, g, or t
  modified_base (422)..(422): a, c, t, g, unknown or other
  misc_feature (422)..(422): n is a, c, g, or t
  modified_base (430)..(430): a, c, t, g, unknown or other
  misc_feature (430)..(430): n is a, c, g, or t
  modified_base (437)..(437): a, c, t, g, unknown or other
  misc_feature (437)..(437): n is a, c, g, or t
  modified_base (503)..(503): a, c, t, g, unknown or other
  misc_feature (503)..(503): n is a, c, g, or t
tcagactagcagtacacgaccggtgctcgatttagagtatacatagttgggtttggggagtctcggtcaggacacagcatggacatggacggtccccgctcagcctccgtgggctcctgctactctggctccggaggtgaccagtatgtgacagtcgaagctacgacctagtctaccactccttccctgtctcgacgaaccggtgggaacacgaggtctacaaccatcgtacgttggccggataagtacggaactnttacgaacttaacgttaaattttaagtgtaaactacaaacgtagtaacgaaccggaaacgggtacccgtaccctaaaggtcctaacttaactacgtatcggacttcggactacgttcgtaacgttagaacggtaacgggttccgggacctagnggttacgttacgnggtacggngtacggngtaacttcgggaggaactacgtttatttaccgacttccgtacaaacgtataccgtaagtattacgngtaacgtaagtaagtacgttattaacgtaacttaactttaagtacgttaagaactaacgtaacttaaacgtttaacctaggttttaccggttaccggaactaaacgggttaaaccaaccgtaaaacggttaaaacttaaaacgttaacgtacgtaccggtaggtaccgttaacgactaaacgtacgtttacgtacgtttacctacgttacctttacccggaactcctaagttcgtaagtaaccg

SEQ ID NO: 139029 - DNA, 656 bp, Homo sapiens
  misc_feature: GYAE6OF01CBQS4.46.67.G01.1.454.CMB.1.raw
  modified_base (217)..(217): a, c, t, g, unknown or other
  misc_feature (217)..(217): n is a, c, g, or t
  modified_base (363)..(363): a, c, t, g, unknown or other
  misc_feature (363)..(363): n is a, c, g, or t
  modified_base (382)..(382): a, c, t, g, unknown or other
  misc_feature (382)..(382): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaaccggtggagacagtgtcaccatcacttcgccgggnaagtcggaactattgactacttatttaaattggtatacaacagtaacgaccgagggaccgccctaagcctacctaatcgtatgctgtactactccgtagtttgacgtaaggtcgggtacccagtcgtaagttcgagtggactaggngtatcggtaggaactagtntttaccacttctacacatacgaagttatccgtagactaacggtagtacgttaagtttcgacttaactttagttacctaggtaactaacgtagtaaacttataacgtttcggttaaccggaacgtaacgggacctaacgtaactaaacgtaaacttaaccgaagttcggtacggtccgtaacgtcctaaacccgttatttacccggtactttaccccgttaacttcccgtttacccccgtaaccccggttacttacggttcccgttaggtaaccc

SEQ ID NO: 139030 - DNA, 685 bp, Homo sapiens
  misc_feature: GYAE6OF01DXXG2.46.67.G01.1.454.CMB.1.raw
  modified_base (254)..(254): a, c, t, g, unknown or other
  misc_feature (254)..(254): n is a, c, g, or t
  modified_base (275)..(275): a, c, t, g, unknown or other
  misc_feature (275)..(275): n is a, c, g, or t
  modified_base (292)..(292): a, c, t, g, unknown or other
  misc_feature (292)..(292): n is a, c, g, or t
  modified_base (343)..(343): a, c, t, g, unknown or other
  misc_feature (343)..(343): n is a, c, g, or t
tcagactagcagtacacgaccggtgctcgatttagagtatacatattgggtttgtcctcctgctggtggcagctcccagatgggtcctgtccctggtgcaactgcaggagtccgggcccacgactggtgaggccttcggacgaccctgtccctcacctgcgctgtctctggtcgcctccatcagtagtgtttctcgtgggctgggtccgcagcctccgaggggacgggctggaatacagttggaagtgtctctnatgtggtacgttcctattacncgtccgtctctacaagngtcgagtcacatatctgtgacacgtcagacaatcttacgtttccagtaatntgtacgttcgtggtacgccgtccgcgtacgaacggtaccgggttacgttttacgttacgtggtacgacgaaggacggtacggtactttattaggttgttagttttaggtacggtttggtttactttaccggacctaacccgtagtacggttacgggaccggggtacctacccggacccggtcggggaacggtaacgggtagttaccggttcggacccttacccggttccttccgttacgccccgttaaccgaacccgggtaccggtcccctacggttccccggtttacccctccccggtacggtcccctacccccgtacccgttacccgaagtcccgtcccg

SEQ ID NO: 139031 - DNA, 980 bp, Homo sapiens
  misc_feature: GYAE6OF01EHTJP.46.67.G01.1.454.CMB.1.raw
  modified_base (198)..(198): a, c, t, g, unknown or other
  misc_feature (198)..(198): n is a, c, g, or t
  modified_base (234)..(234): a, c, t, g, unknown or other
  misc_feature (234)..(234): n is a, c, g, or t
tcagactagcagtacacgaccggtgctcgatttagagtatacatattgggtttggggagtctcggtcaggacacagcatggacatggagggtccccgctcagctccgtggggctcctgctactctggctccgaggtgccagatgtgacatcgagctcgacccagtcctccactcctccctgtctgacaacggtggganacagttcgacacctatctacgttcggacccgggtanaacggtacggaactagttacgaacctaaccttttaatttaaaacgttggtaactaacctaaacgtacgttaaccggaacccggaacggggtaccccggtaaccccttaaacggtaccctttaacccttaaacgttaccgttaacggttcggtaccgttacggtacctttaaccggtaccccgttttaaggtttaccggaaaccggttaaaacggggtttcccggggtaccccttaaggtaccgggttaacggtttaccggtagggtaccggtacggtaagggttacgggaacgttcgggtaggggaaaccttaggtttaaccttacccgtaaccgtttaccaaccggtaacctttaacgttaaccgtaaaggtttacctacccggttagggtaaacccgtaaagggtttaacggttaaacgtttttaacgttttacccggtaaactttaaaaccgtttttaacgtttccggtaaaccgttaaaccgttaaaagttaacgtttaaaaccgtttacggtttaacgtttttacccgggggttaaacccggaaaaccggaagggttaaacccctaaaccgtttaaaacgttaaaaaccggtttaaaaaccgttaaacgggtccgttaaacggggtcccgttaacccgttaagaaccccttaccgtttaaccttacccggttttataacccccgggtttacacccccgttttacccggttaacccactttaccgtaaggttcgttaacccg

SEQ ID NO: 139032 - DNA, 593 bp, Homo sapiens
  misc_feature: GYAE6OF01EDVXK.46.67.G01.1.454.CMB.1.raw
  modified_base (177)..(177): a, c, t, g, unknown or other
  misc_feature (177)..(177): n is a, c, g, or t
  modified_base (348)..(348): a, c, t, g, unknown or other
  misc_feature (348)..(348): n is a, c, g, or t
  modified_base (352)..(352): a, c, t, g, unknown or other
  misc_feature (352)..(352): n is a, c, g, or t
  modified_base (361)..(361): a, c, t, g, unknown or other
  misc_feature (361)..(361): n is a, c, g, or t
  modified_base (370)..(370): a, c, t, g, unknown or other
  misc_feature (370)..(370): n is a, c, g, or t
tcagactagcagtacacgaccggtgctcgatttagagtatacatattgggtttgtcctcctgctggtggcagctcccagatgggtcctgtccctggtgcaactgcaggagtccgggcccacgactgggtgaggcctttcgggagacccctgtccctcacctgcgctgtctctggtcncctccatcagttagtggtttcttcgtggggctgggtccgcagctccgaggggagggctaggaatacagttggagtgtctctcagtaggtggtaggttcctattacacgttccgtctctacaagacgtcgagtcaccatactctctggacacgtccagcaatctagtttccngaanatgagttcngtcaccgcnctgacgtacggtctttatacgtgtgcgagagacgtacttattagtgttagttttggagttaggtttattccgactaccgtagacgtcgggacggggtcctccggacccgtgggaccgagggtaactcgtcggtaccaccgttctaccgttcgccctaccgacgaccggtcctacgttcccgtcccttccccgtcgtccctaccctcccgtacacgcgtacccg

SEQ ID NO: 139033 - DNA, 785 bp, Homo sapiens
  misc_feature: GYAE6OF01DBLH0.46.67.G01.1.454.CMB.1.raw
  modified_base (199)..(199): a, c, t, g, unknown or other
  misc_feature (199)..(199): n is a, c, g, or t
  modified_base (229)..(229): a, c, t, g, unknown or other
  misc_feature (229)..(229): n is a, c, g, or t
tcagactagcagtacacgaccggtgctcgatttagagtatacatattgggtttggggagtctcggtcaggacacagcatggacatgagggtccccgctcagctccgtggggctcctgctactctggctccggaggtgccagatgtgacatcgagctgaccctagtcctccatccctccctgtctgacaaccggtggganacagtgtacaccatctacgttggcccgganaaggtcgaactagttcgaacctaacttatttaaagttggtactacaacagtacgaccgaggggaccgtaccctaagtcctaccgtaatctaacgtcgtctacgtactactaccgttaggttttacgaacgtaaacgggttccggggtaccctaggttaccggtaaggtttaccgaaggttcggtacgtaggtacggtacgtcggtacgggaactaaggttactttacaccttactacctacctaagttacgtaacgtttaactcgttacggaaccgttaacggttagtaaacgtttacgttttaacggaacctttaaacgtttaacgttaccgttaacgtaaccgtaaacttaacggttaactttaacgttaacggtttccgggttttaaccggaaccggtaaaccgggtactaaaccgttaaccgttaaacttaaacggttaaaccggtaacgttagtaccgggtacctacgtaacccgtaacgtagttaccgttccggttacctttaaccgtacctttacccgttaccccgacttaacttccgtaagtaacccg

SEQ ID NO: 139034 - DNA, 765 bp, Homo sapiens
  misc_feature: GYAE6OF01CFP22.46.67.G01.1.454.CMB.1.raw
  modified_base (189)..(189): a, c, t, g, unknown or other
  misc_feature (189)..(189): n is a, c, g, or t
  modified_base (196)..(196): a, c, t, g, unknown or other
  misc_feature (196)..(196): n is a, c, g, or t
  modified_base (299)..(299): a, c, t, g, unknown or other
  misc_feature (299)..(299): n is a, c, g, or t
tcagactagcagtacacgaccggtgctcgatttagagtatacatattgggtttggggagtctcggtcaggacacagcatggacatgagggtccccgctcagctccgtggggctcctgctactctggctcgaggtgccagatgtgacatcgagctgacccagtctccatcctcctgtctgcacggtgganacgagtntcacatcacgttggccgggacaaggtcggaactattcgactacttatttaaaagtgtatacaacatagaccgagggacccgacctaagctacctaatcagtcncgtgtacactccgtagtttacgacgtaaaggtccgggtaccctagttacggtacggtttacgaagggttcggaccgtaaggtcgggtaagttcggttacgggaacgtagtacgttttacaccgttctaccgtacaacttactaacgttaactcgtacgacgtaacggtagtaagttaacttttacggacctttaaagtttacttaacgtttacgtaaaccgtaaagtaacggtttaaacttaacgtaaacgttttcgggtttaaccggaaccgtaaaacgggtaccctaaaaccggttaaactaaaaccgtaaaaacgtttaaacgggaacctttacggggaaacgttcccgtaaagggtacccctttaaaccgaccgttttacgttccggttttaaccttaacccgtttaacccgtttaccccgttaaccccgtaaccgtttcttaaccggttaacttaacccgg

SEQ ID NO: 139035 - DNA, 755 bp, Homo sapiens
  misc_feature: GYAE6OF01EYFBK.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggacgtccgggcccacgactggtgaggccttcggagaccctgtccctcacctgcgtctgtctctggtcgcctccatcagttagtgtttcttcgtggggtctgggtccgcagctccggaaggggaagggctaggaatcgtattaggaagtcgtctctcgtagtaggttggacgttccttattacacgtccgttctctacgaagacgtcgacgtcacctatactctcgtggacctaccgtaccagactaattcttacgttttcccgtagaagtatagtagttactgtcgaccgtcgctcgacgtacgggttactttactacgtgtcgacgtagacgtacgtacttattagttagtttagttttaggtaggtttacggttttacttaccgtaacccgtaccgtaacggtacggtacggggtacccggggttaccggtaccccggtaaccccgggttcgggggaacccggtaaggggttaaccgttacggttacccgggttacccgtacccggtttcccgttaacccgttacccggtacccctaacccggtaacccgggttaacccgggacccttaaccggtttccccggttaccccgttcccccgtaccgtccccgtacccgttacccctacggtacgaaccccgtacccgg

SEQ ID NO: 139036 - DNA, 834 bp, Homo sapiens
  misc_feature: GYAE6OF01EZ5DV.46.67.G01.1.454.CMB.1.raw
  modified_base (206)..(206): a, c, t, g, unknown or other
  misc_feature (206)..(206): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgtgctgtctctggtcgcctcatcagtagtgttctcgtgggctgggtccgnagctcccgaggggacgggctaggaactcagttggatgtctctcagtaggtggacggttcctagttacacgtccgtctctacgaagtacgtcgagtcccaacctattaactcctcgtggtaacccaccggttcccaaggtccaaacgttccctaacgtttttaccccagtaagacgttcgtaacgttctacggtccggacccgccgtacgtacggtaacgttacccggggtattttttaacaccggttcgtacgggaccggtacggaacgtaccggtacttaagttacgtttaggtttaagtttttcgggtaggttttacggttacgtttaccggtaacccgtaaccccgttaggtaccggtaccgggttaccggggtcccgtacccgggtacccccggtacgggggtaaccccgtaaggggttaaaccttacccggttacgggttacccgttacccggttaccctttacccggttacccgttaccccgtaaccccggaacccggttacccgggtaccccccgttaaccggtttcccccggtttaacccccgttcccccccggttaccggtaccccccgttaaccccccgttaaccccgtacccggtaaaccgtacccggtacccccgg

SEQ ID NO: 139037 - DNA, 558 bp, Homo sapiens
  misc_feature: GYAE6OF01CSQZ4.46.67.G01.1.454.CMB.1.raw
  modified_base (227)..(227): a, c, t, g, unknown or other
  misc_feature (227)..(227): n is a, c, g, or t
  modified_base (240)..(240): a, c, t, g, unknown or other
  misc_feature (240)..(240): n is a, c, g, or t
  modified_base (334)..(334): a, c, t, g, unknown or other
  misc_feature (334)..(334): n is a, c, g, or t
  modified_base (374)..(374): a, c, t, g, unknown or other
  misc_feature (374)..(374): n is a, c, g, or t
  modified_base (380)..(380): a, c, t, g, unknown or other
  misc_feature (380)..(380): n is a, c, g, or t
  modified_base (401)..(401): a, c, t, g, unknown or other
  misc_feature (401)..(401): n is a, c, g, or t
  modified_base (427)..(427): a, c, t, g, unknown or other
  misc_feature (427)..(427): n is a, c, g, or t
  modified_base (434)..(434): a, c, t, g, unknown or other
  misc_feature (434)..(434): n is a, c, g, or t
  modified_base (504)..(504): a, c, t, g, unknown or other
  misc_feature (504)..(504): n is a, c, g, or t
  modified_base (513)..(513): a, c, t, g, unknown or other
  misc_feature (513)..(513): n is a, c, g, or t
  modified_base (547)..(547): a, c, t, g, unknown or other
  misc_feature (547)..(547): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccactccctccctgtctgaccaaccggtgggagactagtctaccacatcacttggacccgggnaagtcgaatgtanaccacttatttaagtgtaatacaatatagaccgaggaccgaccctagctactatctatgactgacacttcgtagttcgacgaaggtcggtaccngtcggaggttcaggtgctaggtgtatcggtaggactagtntttacnctctacacatagattaatcanaactagtagtattacttgacttattntaacgtntaacaagtataattctagtttgttaccgaacgaggtaactacgtaaactaactaaacgtagactgcgtancgactaacnttctcgtacttaccgtctacccttcccgaccttntccgtagtaac

SEQ ID NO: 139038 - DNA, 724 bp, Homo sapiens
  misc_feature: GYAE6OF01C0K7K.46.67.G01.1.454.CMB.1.raw
  modified_base (260)..(260): a, c, t, g, unknown or other
  misc_feature (260)..(260): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgacggccttcggacgaccctgtcccctcacctgccgctgtctcgtggtcgcctcatcagttagttcggtttctcgtggggctgggtccggacngccgtccgaggggacgggctaggatacagttggagtgtctctcataggtggtagttcctattacgacgtccgtctctacaagtcgtcgacgtacacctatactctcgtacggactaccgtcacgactaacttcctacggtttttcccaggtaacgtagtagttacgttcgtgttaccgggaccgtccgtacgttacggaaccggtaccggggttacgttttacgttacgttacggtgacggtaacgtaacggtacggtactttaagtttacgttagtttagtttttaagggtagtttaggttttctttaaccggtaacctacccggttaaggtaccggttaccgggggtaacccggggtcctaccccggggtaccccgggttacggggaccggtaacgggtaacttaccggtcggttaccccgtaccggttccctttacccggtccgtccccgttaaacccggg

SEQ ID NO: 139039 - DNA, 769 bp, Homo sapiens
  misc_feature: GYAE6OF01DNDOB.46.67.G01.1.454.CMB.1.raw
  modified_base (228)..(228): a, c, t, g, unknown or other
  misc_feature (228)..(228): n is a, c, g, or t
  modified_base (724)..(724): a, c, t, g, unknown or other
  misc_feature (724)..(724): n is a, c, g, or t
  modified_base (733)..(733): a, c, t, g, unknown or other
  misc_feature (733)..(733): n is a, c, g, or t
  modified_base (764)..(764): a, c, t, g, unknown or other
  misc_feature (764)..(764): n is a, c, g, or t
tcagactagcagtacacgaccggtgctcgatttagagtatacatattgggtttggggagtctcggtcaggacacagcatggacatgagggtccccgctcagctcctggggctcctgctactctggctcggaggtgccagatgtgacatcgagctcgacccagtctccatcctccctgtctgcgaaccggtgggacacaggtcgtcacctatctacgttggcccggganaacggtacggaactacgttacgactaaccgttaatttttaaacgttggttaactaccaaacgtacgtaacggtaacccgaacgggggtacccggtacccctaaggtacccttacctaaagttccgtttaactcggtacctcggtacctacgttacccgtaggtttttacggaaccgttaaaggggttcccggggttacccctaaggtttcgggtacggtttaccgagggtcgggaccgtaaggtggtacgtcggtacgggaactaggtttaacttaccgtaccgttcctaacccgtactaaccgtacgttaagttaccgttcgtacggtaacgtaacggttagttaacgtttactttacggtaacctttaaacggttttactaccgttacgtaaaccttaagtaaccttaaacgttacttacggtttacggtacccggaacgtaaacgggaccttaacgtaacctaaacgttaaacgtacgtactaggtactacgngtacccatntcgtctctacctctaccctcgtactagttcngtccg

SEQ ID NO: 139040 - DNA, 640 bp, Homo sapiens
  misc_feature: GYAE6OF01EHCWR.46.67.G01.1.454.CMB.1.raw
  modified_base (220)..(220): a, c, t, g, unknown or other
  misc_feature (220)..(220): n is a, c, g, or t
  modified_base (233)..(233): a, c, t, g, unknown or other
  misc_feature (233)..(233): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatccctccctgtctgcaacggtggagacagtgtcaccatcacgttcggccgganaaggtcggaactnttagactaacttatttaaacgttggtatacaacatacgaccgagggaccgaccctagcctactaatctatgctcgctacgtcctagtttagacgaaggttcgggtacctagtcggtagttcaggtcggacgagtacggattacggtaggacgtaacgtacttcgactcgtaccaactatactagttaactcgtcgtaacgtacgttagtaacgttatttacgaacttaactttagttacttactaacgtaactaagttaacttaacgttagtttacgttaccggaacgtaacggacctaacgtaaactaaacgttaaacgtaacgtacgtaggtacgtactacggacctacgttatacgttcttaccttccaaccttcccgttacccacttacctgtacggttaacc

SEQ ID NO: 139041 - DNA, 776 bp, Homo sapiens
  misc_feature: GYAE6OF01C3G7Y.46.67.G01.1.454.CMB.1.raw
  modified_base (191)..(191): a, c, t, g, unknown or other
  misc_feature (191)..(191): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaaccggtgganacagtgtccaccatcacgttggcccgggacaaggtcggaactattacgaacctaaccttattttaaatggtaatcaaactagtacgaccgagggaccgaccctaagcctactaatctatgctagcatccgtagtttacgacgtaaaggttcggggtacccctagttaccggtaggtttccaaggttcggacgtaggtaggacgttcggtagggaactaggtacttttccacgttcctaccaccctaataccgtaagttaaacttccgtacgaaccgtaacggttaggtaaaacgtttacgtttttagaaaccctttaaacttttacgtttaaccgttaccgttaaccaaaaccgttaagttaaaactttaaccggtaaacgttttaccgggttttaaccggacccgtaaaacggggtacctaaaccggtaaacttaaaaccgttaaaaacgtttaaacgtaaccgtttagggtaacggtaccgttaacgtaacccgtaaccgttagtttaccgtttacggttaaccctttacctaccgtttaccccggttaccccgaccgtttaaactccgttaagttaaacccg

SEQ ID NO: 139042 - DNA, 627 bp, Homo sapiens
  misc_feature: GYAE6OF01BD7J9.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctctggggctgggtccgcagctcccgaggggagggctggaatacagttggaagtgtctctcatagtggaggttcctattacagtccgtctctcaagagtcgagtcaccatatctctggacacgtccagcaatctacgttttcccagaacgtagtgtagttctggtcgacccggtccgtctgacgtacgggtcgttttatacgtgtcgcgaggagacggtcttattatgttagttttggagttggtttattcgacctaccgtagcgtcgggaccggggtccgtccgaccccggtggggacccgaagggtaacttacggtcggtaccgtacccgttcgttccgttaccgccccttacccgaacccggtacgggcccctacgttcccggttcccttcccccgtcggtaccctaccccttcccaccgaacgccgtaccccg

SEQ ID NO: 139043 - DNA, 650 bp, Homo sapiens
  misc_feature: GYAE6OF01A5L6T.46.67.G01.1.454.CMB.1.raw
  modified_base (192)..(192): a, c, t, g, unknown or other
  misc_feature (192)..(192): n is a, c, g, or t
  modified_base (217)..(217): a, c, t, g, unknown or other
  misc_feature (217)..(217): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccgggnaagtcggaactattgacaccttatttaaattggtatacaacatagaccgagggaccgccctaagcctacctaatctatgctgctatccagtttacgacgtaaggttcgggtaccctagtcggtaggttcaggtcggacaggtgagtcgtagggacagtactttcactacttaccacctactactaacgttaatacgtacgtacctaacggtagtaagttacgtttacgtaacctaaactttacttaacgttacttaacgtaaactaacgtaaactttaactaagtttacgttttaccggaaccgtaaggaacgtaaccgtaaacttaaacgtaaacttaaaccgtaacgtacggttacggtactacggactaacttactacgttccgtacgttacttaccttacgttaccgttaccccaccttcgttcgtacg

SEQ ID NO: 139044 - DNA, 689 bp, Homo sapiens
  misc_feature: GYAE6OF01D1JMP.46.67.G01.1.454.CMB.1.raw
  modified_base (222)..(222): a, c, t, g, unknown or other
  misc_feature (222)..(222): n is a, c, g, or t
  modified_base (244)..(244): a, c, t, g, unknown or other
  misc_feature (244)..(244): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaaccgtggagacagtgtcaccatcacttgcggcaagtcgacntgacacttattaatgtatcaanatacgacaggaccgccctaagcctctaatctatgactgctacgtcctagtttgacgtaaaggttcgggtacccagtccggtaggtttcgaagtggtctaggtggactcgtaggggaactaggtatttaccgacttacctaccacctaattaccgtaagttaactacgttacgaacgttaacggtaagttaagttattttacgaccgttaaactttagtttacctagtaacctaaataacgtttaatttaacctaagttttcggttttaaccggaaccggtaaacgggtaaccctaacggtaaaaccttaaaccgttaaaaacgttaaaccggtaacgttcggttaggtaccgttaaccggtacctaaacccggttattccggttacgttacctttacccgtaactttcccccttaccccgtaccttaacgttccgttgtaaaccg

SEQ ID NO: 139045 - DNA, 644 bp, Homo sapiens
  misc_feature: GYAE6OF01B2169.46.67.G01.1.454.CMB.1.raw
  modified_base (194)..(194): a, c, t, g, unknown or other
  misc_feature (194)..(194): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgccaaccggtggganacagtgtcacatcacttgccgggacaagtcgaacattgactactatttaaatgtatcaacatagaccgaggaccggaccctaagcctcctaatctatgctgcactcctagtttgacgtaaggtcgggtacccagtacggtaggtttacaggtggacgtaggtggtacttcggtagggaactaggtacttttaccgacttactaccaacctataccgtaagttaactcgtacgtacgtaacgtagtaagtattttacgacttaaactttattaccgttagtactaaacgtagttaaacttactaagtttacggttttaccggaaccgtaaaggaacctaccggtaaacttaaacgtaaacgttaaacgaacgttaggtacgtccgtacgacctaacctattacgttcgttaccttactaccgttcccttaccccacctcttacgtgtaacc

SEQ ID NO: 139046 - DNA, 657 bp, Homo sapiens
  misc_feature: GYAE6OF01BVBY3.46.67.G01.1.454.CMB.1.raw
  modified_base (208)..(208): a, c, t, g, unknown or other
  misc_feature (208)..(208): n is a, c, g, or t
tcagactagcagtacacgaccggtgctcgatttagagtatacatattgggtttgtcctcctgctggtggcagctcccagatgggtcctgtccctggtgcaactgcaggagtccgggcccacgactggtgaggccttggagaccctgtccctcacctgcgctgtctctggtgcctcatcagtagttggtttctcgtgggctgggtccgnagcctccgaggggaacgggctggaatacagttaggaagttgtctctacagtagtggtacgttccttattacgagtccgtctctacaagtacgtcgagtcacctatactctctggacacgtcagcaatctacgtttccagaacgtagtgtagttcgtgtacgacccgccgtctacgacgtacgggttctttagttacgtgtgacggagacggtacggtcttaagtttagttgtttaagtttttggtaggtttacggtttacgtttcgaaccgtaccgtaaggtacgtaccggggacgggtcctccggacccggtcggggaccgtagggtaacttacggtacgtccgtaccgtctccgttcacccgtacccgtaacgaccggtaccctacgttcccgggttacccttccccgtccgaccctaccccgttacccaccgaacgcgtaccccgg

SEQ ID NO: 139047 - DNA, 713 bp, Homo sapiens
  misc_feature: GYAE6OF01CJDI1.46.67.G01.1.454.CMB.1.raw
  modified_base (264)..(264): a, c, t, g, unknown or other
  misc_feature (264)..(264): n is a, c, g, or t
  modified_base (384)..(384): a, c, t, g, unknown or other
  misc_feature (384)..(384): n is a, c, g, or t
tcagactagcagtacacgaccggtgctcgatttagagtatacatattgggtttgtcctcctgctggtggcagctcccagatgggtcctgtccctggtgcaactgcaggagtccgggcccacgactggtgagggcccttcggacgaccctgtcccctcacctgcgctgtctctggtgcctccatcagtagttggtttcttcgtggggctgggtccggcagctcccgaggggaagggctggaactacagttggaagttgtctcgtnattaggtggtaggttcctattacgagtccgtctctacaagagtcgagtcacctatatctctgacacgtcagcaattctacgttttcccagaacgtagtgtacgttctggtcgaccgccgngtcgacgacgggttcgtttaattcgtggtgacggagacgacggtcttaagttagttgtttagttttggtaggtttaggtttacgtttacgtaaccgttacccgtaagtaccgttacgggaccggggtccgttacccggaccccggttacggggaccgtaacggggtaacttaccggttcggttaccgtacccgttccgttacccgttaccgaccccgttaacccgaaccccggtaaccgggtaccccgtaaccggttcccggttccccctttaccccccggtcggtaccccctaccccgttacccttaacccgaaggcccgtaccccgg

SEQ ID NO: 139048 - DNA, 604 bp, Homo sapiens
  misc_feature: GYAE6OF01EEWDA.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtgggctgggtccggcagcctcccgagggaagggctaggaatacagttggaagtgtctctcagtagtggaggttcctattacagtccgtctctcaagagtcgagtcaccatatctctggacacgtccagcaatctacgtttccagaacgagtgtgttctgtcgaccgcgcgtcgacgtacgggtcgtttattacgtgtgacgagacggacggtctagttatgttagttttcggagttggttacttcggacctaccgtagtcgtcggacggggtctccggacccgtgggaccgagggtactacggtcgtactccgttcgtccttacgccctcccgaaccgaacgggtcccctaacgtcccggttacccttcccccgtacggccctaccccgtacctaccgaagcgtacccg

SEQ ID NO: 139049 - DNA, 621 bp, Homo sapiens
  misc_feature: GYAE6OF01CLKGA.46.67.G01.1.454.CMB.1.raw
  modified_base (160)..(160): a, c, t, g, unknown or other
  misc_feature (160)..(160): n is a, c, g, or t
  modified_base (194)..(194): a, c, t, g, unknown or other
  misc_feature (194)..(194): n is a, c, g, or t
  modified_base (314)..(314): a, c, t, g, unknown or other
  misc_feature (314)..(314): n is a, c, g, or t
  modified_base (354)..(354): a, c, t, g, unknown or other
  misc_feature (354)..(354): n is a, c, g, or t
  modified_base (610)..(610): a, c, t, g, unknown or other
  misc_feature (610)..(610): n is a, c, g, or t
  modified_base (618)..(618): a, c, t, g, unknown or other
  misc_feature (618)..(618): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccngtctccatcctccctgtctgcaaccgtgggaacncagtgtccaccatccacgttcggccggctaagtcggaactattagacacgttattttaaagtggtatacaatatacgaaccgagggaccgaccctaagtcctactaactcaatcgcttcnctacgtctagtcgaacgacggtcggacctagtcgtagtcnggtgtactacggtagcgtacgtaggtactgtacttacgactactacgactacgtcgtaagtactcgtacgacgtaacgtagtaacgttacgtttacgacgttaacttacgttacgttactaacctaacgtaacgtaagttaacgttacgtttaacgttaaccggtaacgtaacggtaacgtaacgtaactaacgtaaacgtacgtaacgtagtactacgtacgacgtacgtatactctactctaccgtctacctanacttcgtntac

SEQ ID NO: 139050 - DNA, 649 bp, Homo sapiens
  misc_feature: GYAE6OF01A5E0C.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtccgggcccacgactggtgaggccttcgggagacccctgtccctcacctgcgctgtctctggtcgcctccatcagtgttggtttctcgtggggctgggtccgcagcctacccgaggggaacggggctaggaatacgagttgggaagtgtctctcagtagtggagttcctattacagtccgtctctcaagacgtcgagtcaccatatctctggacacgtccagcaatctacgttttcccagaacgtatcgagtttctggtcgacccgccgctacggacgtaccgggtcgttttaacttacgtgtcgacgaggaggacggtcttagtttagtgtttagttttgggtagtttggttactttcgacctacccgtagtacgtcgggaccggggctaccggacccggtcggggacccgtaagggtaactacggttcggtaccaccgttcctcccgttacggtcccctaccgacccgaacgggtcccctaggttcccggttccccttcccgccgtccctaccccctccctaccgaacgcgtacccg

SEQ ID NO: 139051 - DNA, 646 bp, Homo sapiens
  misc_feature: GYAE6OF01D79EJ.46.67.G01.1.454.CMB.1.raw
  modified_base (196)..(196): a, c, t, g, unknown or other
  misc_feature (196)..(196): n is a, c, g, or t
  modified_base (435)..(435): a, c, t, g, unknown or other
  misc_feature (435)..(435): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctcgacccagtctccatccctccctgtctgacaaccggtggganacaggtcgtccacctatcacgttcggccgggacaacggtcggaactattcgactacttaatttaagtgtatacaacatacgacgaggaccgacctaagctactaatctatcgctgctactcctagtttcgaacgtaacgggtcgggtaccctagtacggtaggtcaggtggcgtaggtacggactcggtagggacgtaagttaccttacgaccgtcttacacttactactaagtaactntacgactaggtagtagttagtttacgactaaactttctactacgtaactaactacgtaactttaacgacgtttacggttaccggaagttaacggaaccttaacggaaccttaaacggtaaacgttaaaccgtaacgttaggaccgtacgagtacctaccgttatcgttcgttaccttgtacctttcccgtccgtaactctagtcggtaacc

SEQ ID NO: 139052 - DNA, 596 bp, Homo sapiens
  misc_feature: GYAE6OF01AUDSR.46.67.G01.1.454.CMB.1.raw
  modified_base (296)..(296): a, c, t, g, unknown or other
  misc_feature (296)..(296): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcgggagaccctgtcccctcacctgcgctgtctctggtgcctccatcagtagtggttttctcgtggggctgggtccggcagcctcccgaggggaaggggctggaatacagttggaagtgtctctcataggtggaggttcctattacagtccgtctctcaagngtcgagtccaccatatctctggacacgtccagcaatcagttttcccctgaacgatgagttctgtcgaccgccgctgacgacgggtcgttttatactgtgcgagagacggctattatgtacgtttttggagtttggtttatttcgacctacccgtagtactcggacggggccgttccgaccccgtcggggccgagggtaactacgtggtaccaccgtcctccttacgtccctaccaccgaacggccctagtcccggttcccttcccccgtcgccctacccctccctcccaacgcgtacccg

SEQ ID NO: 139053 - DNA, 860 bp, Homo sapiens
  misc_feature: GYAE6OF01DN8JB.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggacgaccctgtccctcacctgcgctgtctcgtggtcgcctccatcagttagttggtttcttcggtggggtcgtcggggtccggcgacgtccgtaccggaagggggacgggtctaggtaatacgtagttagggaagtcgtctctacgagttaggttaggtacgttacttattacgtacgtcgttcctctacgaagtacgtacgtacgtaccactacgtacttccgtacgtacggaaccgtacgtaccacggtaacctaacttaccgttaccgtttttcccgaaggtaaacgtacgttacgttaacgttccgttacggtaccggaacccggtcccgtacgttaccggaaccgggttaccgggttaccgtttttaacgtaccggttcgggtacgggtaccgtaagggtccggtaacggtactttaagttacgttagtttaggttttaggtagtttacgtttacgttaccgtacctaaccggtagtaccggtcggggtaaccgggtccgtaaccgggtcccgggttaacggggaccgtaaggggttaccgttaccgggttacggttacccgtaccggttacccgttacccgttaccggaccccgttaacccggtaacccggtaacccgggtacccgttaacggtttcccccggttaccccgttccccccgggtaccgtacccccgttaccccttaaccccggtaccggaacggtccccgtacccggg

SEQ ID NO: 139054 - DNA, 868 bp, Homo sapiens
  misc_feature: GYAE6OF01CVSKR.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctcgaggtgccagatgtgacatcgagctgacccagtctccatccctccctgtctcgaccgaaccggtgggacgactaggtcgtaccacctataccgtacgttcggacccggggactaacgggtacgggtaaacctacgtttaccggaaaccttaaccgtttaagttttaaaaacgttgggtaacttaccgaaactacgttaacggaacccggaagggaacccggtaccccgtaaaggtccttacccgtaaagttccgttaacgttcggccttacggtaccttaacgttcccggtaaggttttacggtaaccgtaaaacggggtttccggggttaacccctacggttaccgggttaacgggtttaccgaacgggttcggggtaaccgtaggggttacggttaaccgtacggttacgggggaacccttaaggttaccgttttaccgtaaccgtttaccctaacccgtaacccgttaaacgttaccgtaaacgtttaaccgttaccgtacggggttaaacctacccggttaaagtaagggttttaccttttaacgaacccgtttaacttaacgtttaaccggttactaaacgtaacttaacggttaaacttaacgttacggttcggtttaaccgaacgtaacgggtactaaccgtaaactaacttaaacgtacgagtctacggcctagacctacgtaattcttcgtaccttacaaccgttccctaacgtctacttcgtcgttaacg

SEQ ID NO: 139055 - DNA, 603 bp, Homo sapiens
  misc_feature: GYAE6OF01B7C1I.46.67.G01.1.454.CMB.1.raw
  modified_base (341)..(341): a, c, t, g, unknown or other
  misc_feature (341)..(341): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccgcagctccgagggaggggctggaatacattggaagtgtctctcataggtggaggttcctattacagtccgtctctcaagagtcgagtcaccatatctctggacacgtccagcaatctacgttttcccagaagntgagttctgtcgaccgccgctcgacgacgggtctttacttacgtggtcgcgagagacggtcttattagtgttattttggagtttgttacttcgactacctagacgtcggacggggtcctccgaccgtcgggccgaagggtaactacgtggtcctaccgtccttccgtacgccctaccgaaccgaccgggcccacggttcccggttaccccttcccccgcgggtcccctacccccgttaccctaccctaacgccgtaccccgg

SEQ ID NO: 139056 - DNA, 556 bp, Homo sapiens
  misc_feature: GYAE6OF01A1J58.46.67.G01.1.454.CMB.1.raw
  modified_base (550)..(550): a, c, t, g, unknown or other
  misc_feature (550)..(550): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcacatcacttgccgggcaagtcggaacattgacacctatttaaattggtatacaacatagaccagggacgccctaagctcctatctatgctgcatccagtttgcgtaaaggtcgggtccagtcgtaggttcagtggctagtggatcgtgggacagtattcactctcacatcagtatctgactagtagtaagtatttacgacttaactttattactgtactaaataagtaatttactaagtttggtttaccgacgtaaggactaacgtactaaacaaagttaacgagtacgtcgtactcgtaacgtacctattccgttgtacccttcaccttcccttacccaccttattcgngttaac

SEQ ID NO: 139057 - DNA, 614 bp, Homo sapiens
  misc_feature: GYAE6OF01BLS1P.46.67.G01.1.454.CMB.1.raw
  modified_base (193)..(193): a, c, t, g, unknown or other
  misc_feature (193)..(193): n is a, c, g, or t
tcagactagcagtacacgaccggtgctcgatttagagtatacatattgggtttgggggagtctcggtcaggacacagaatggacatgagggtccccgctcagctcctggggctcctgctactctggctccgaggtgccagatgtgacatcgagctgacccagtctccatcctccctgtctgcaaccgtggganacagtgtcaccatcacttgccgggcaaggtcggaacattgacacctatttaaatggtatcaacatagaccgagggacggccctaagctctaatctatgctgcatcctagtttgactaaaggtggggtacccagtcggtaggttcaggtcggcgtagtggatcgtagggacagtatttcactctcacctatcaagttactcgtagacaacgtgtaaagttatttcgacttaactttattacctagtacaaacgtaagtaattaactaagtttggtttacggaaccaagggtactaaccgaaccttaaacgtaaaacttaaacggtaacttaggtacggtactacggtaccaaccgtaacgttccttacggttcccttactaccgttacccttaccccgactaattcgtaccgtattaacccg

SEQ ID NO: 139058 - DNA, 671 bp, Homo sapiens
  misc_feature: GYAE6OF01ESGUO.46.67.G01.1.454.CMB.1.raw
  modified_base (194)..(194): a, c, t, g, unknown or other
  misc_feature (194)..(194): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatccctccctgtctgcaaccggtggganacagtgtcaccatcacgttgccgggcaagtcggaactattcgactacctatttaaagtggtatcaacatacgaccagggaccgccctaagctcctaatctatgctgctactcctagtttcgactaaaggtcggggtcccatcggtaggttcagtggcgagtggatcgaggacaggtatttcaactctacactatcaagtactcgtacgactaacgtagaatacgtttgaacttaactttagttacctgtaccaaacgtagtaacttaacctaagttttacggtttccgggaaccgtaaacggggtaacctaacccggttaactaaaacctaaaacgtttaaaaccggaacgtttacgggtacggttaccgtacgggaaccctaaacccgttaacttaccgttaccggtttaccctttaacccgtaactttccccctttacccccggtaccccttaacgttcccttacgggttaaacc

SEQ ID NO: 139059 - DNA, 645 bp, Homo sapiens
  misc_feature: GYAE6OF01C0EVC.46.67.G01.1.454.CMB.1.raw
  modified_base (412)..(412): a, c, t, g, unknown or other
  misc_feature (412)..(412): n is a, c, g, or t
  modified_base (422)..(422): a, c, t, g, unknown or other
  misc_feature (422)..(422): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtccgggcccacgactggtgaggccttcggagaccctgtccctcacctgccgctgtctctggtcgcctccatcagttagttggtttcttcgtggggctgggtccggtagccgtccggaggggaagggcgtaggaatacagttggaagttgtctctcagttaggtggtacggtttacctattaccgacgttccgtctctacgaagtagtcgacgtcacctatatctcgtaggacacgtcagactaatctacgtttccagaagtntgtacgttcngccgaccgccgtcgtacgaccgtacgggttacgtttacgtacgtggtcgacgagacggtacgtcttaattagttgtttaagttttgggtagtttagtttacttaccgacctaccgtagtaccgtcgggtaccgggtcctacccggtacccggtcggggaccgtaagggtaactcggtcggtacctacccgtaccttaccgttaccgtcccgtaccgaacccgg

SEQ ID NO: 139060 - DNA, 751 bp, Homo sapiens
  misc_feature: GYAE6OF01CRSB0.46.67.G01.1.454.CMB.1.raw
  modified_base (195)..(195): a, c, t, g, unknown or other
  misc_feature (195)..(195): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgaccaaccggtgggaanactagtcgtcaccatcacgttcggacccggggacaaaggtcggaaactatttacgaacctaaccttaattttaaaagttggtaattaccaaaacaattaacggaaccgaaggggtaaccgaccccgtaaagaccttaccttaatcctaatggtctagctaacttccaaggtttcgacgaaggttcggggttaccccaagttcggtaagggttcaaggtgggactaggtaggtagtccgtaggggactaggtatttccacttcgtacacctaatactagtaactctacgtactaaacgtagaaacgtttattttaacggtaaacttttacttaacttacggtaactaaacgaagttaaactttaaactaaagttttccggttttaacggaaccgtaaacggggaaacctaaacggttaaaacgttaaacctaaaaacgttttaaaaccgtacgttaggtacgggtacctacgaacccgtaaccgtaactttaccgtagtttaccttacgttacttaccccgttacccggaaccctagttaaccgtgttattaaccgg

SEQ ID NO: 139061 - DNA, 768 bp, Homo sapiens
  misc_feature: GYAE6OF01B00IJ.46.67.G01.1.454.CMB.1.raw
  modified_base (194)..(194): a, c, t, g, unknown or other
  misc_feature (194)..(194): n is a, c, g, or t
  modified_base (441)..(441): a, c, t, g, unknown or other
  misc_feature (441)..(441): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccactcctccctgtctgcaaccggtggganacagtgtccaccatcacttcggccggggactaaggtacggaactagttcgactaaccttaatttaaagttgtatacaaacagtacgaccgagggaccgaccctaagccttacctaatactagtcgctcgctactccgtagttagacgtaaacggttcgggtacctagtacggtagttacgagtcggacgtaggtgtactcgtagggactagtacttacactctacaacctataccgtaagttaactntacggtaccgtaaacgttaggtaaagtttacttttacggaaacctttaaaacgttttcgttaaaccgttacgtaaacccgtaaaagttaagtttaaacctttaaacgtttaaccggttttacggttttaaaccggggaaacccgggttaaagggtaaacccgtaaaccggttaaaactttaaaaccgttaaaaccggtttaaaacgaaccggtttaggtaccggttcctaaccggaaccgtacccgttatttacccgttacggtttcccttaacgttacccgtttacccgttaacccccgctttaaaccttcgtaacggtttaaccg

SEQ ID NO: 139062 - DNA, 891 bp, Homo sapiens
  misc_feature: GYAE6OF01B8YYG.46.67.G01.1.454.CMB.1.raw
  modified_base (283)..(283): a, c, t, g, unknown or other
  misc_feature (283)..(283): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcagggacgtccgggcccacgacgtgggtggacggtcccttcgggacgacccctgtcccctcacccgtgcgtctgtctcgtggtcgcctccatcgaggttagttggttttccttcggtgggggtcgttcggggtcccggnacggtccgtacccgggagggggtaaggggtccgtaggtaatacgtagttagggtaagttcgtcctctacgtagttagggtggttaaccggttccttaacttacgtccggttcccgttcttacctacgaacggtcgttaccggtactacccgaaccttaacgttactccgttacggtacggtaacccgtacccgttacccgaacgtaacctaacgtttacccgttaccggtttttaccaggtaaacgtaggttacggttacgtttacgtacggtaccgtaccccggtccgtacgttacggtaccggttacggggttactttttacgttacggtcggttaacggacggtaacgggtacggtaccgttatttaacggttttcggtttaagttttagggttttacgggttaggttttaaccgggtttaccttaaccggttaacccgttaccgttacggtaaccgggttccggggtacccggggtacccgttccccgggtacccgggttaacggggggtaacccgttagggggaacccttaccgggttacccgggttacccgtaccccgttacccggttttaccccttacccgggaccccgttaaacccccgg

SEQ ID NO: 139063 - DNA, 694 bp, Homo sapiens
  misc_feature: GYAE6OF01BJ64X.46.67.G01.1.454.CMB.1.raw
  modified_base (218)..(218): a, c, t, g, unknown or other
  misc_feature (218)..(218): n is a, c, g, or t
  modified_base (432)..(432): a, c, t, g, unknown or other
  misc_feature (432)..(432): n is a, c, g, or t
tcagactagcagtacacgaccggtgctcgatttagagtatacatattgggtttggggagtctcggtcaggacacagaatggacatgagggtccccgctcagctcctggggctcctgctactctggctccgaggtgccagatgtgacatcgagctgacccagtctccatcctccctgtctgcaaccgtgggagacagtgtcaccatcacttggccgggnaagtcggaacattgactaccttatttaaattggtatcaacatagaccagggacggcccctaagctacctaatctatgactgcatccagtttcgactaaaggtcggggtacccagtcggtaggtttcaggtcggctaaggtgggactcgtagggactaggtatttcgactcgtacaaccctatcaagtaactctcgactaacggtagtaacggtnttttacgaaccttaaacttttacttaccgttagtaaaccgtaaactaaggttaaactttaactaaggtttaccgggtttttaccgggaaacccgttaaacggggaacctaaaccgtaaaccgttaaaaccgttaaaaacgtttaaacccggaacgtttaacggtacgggtacgttaccggacctaaacccggtctttaccgttagtaccctttacgtaacttaccccgtttacccgactacttaccgtgtaactttacccgg

SEQ ID NO: 139064 - DNA, 737 bp, Homo sapiens
  misc_feature: GYAE6OF01CK7RZ.46.67.G01.1.454.CMB.1.raw
tcagactagcagtacacgaccggtgctcgatttagagtatacatattggggtttggggagtctcggtcaggacacagcatggacatgagggtccccgctcagctcctggggctcctgctactctggctccggaggtgccagatgtgacatcgagctgacccagtctccatcctccctgtctgcaaccggtgggagacagtgtccaccatcacgttcggccgggactaaggtacggaactattacgaacctaacctttaattttaaagttggtaacttaccaaactaataacggaaccgaacggggaacccggaccctaacgacctaccttaatctatcgtctgactacttccgtagtttgacgtaacggtcggggtaccctagtacggtaggttacgaggttcggacgtaggtacggtagttacggtagggtaactacgtaactttccgacttcctacctaacctagttacgtaagttaactcgtacggaaccgtaacggtaaggtaaagttacgttttacgaacctttaaactttactttacgtacgttaactaaacgtaagttaaactttaactaacggtttacggtttaccggaacgtaaacgggaacctaacgtaaaccttaaacgtaaaacgttaacgtaacgtaggtacggtactaacgtacctaaccgttattacgttcgttaccttaccgtaccttccccgttacccgtacttacttcgtagttaaccg

SEQ ID NO: 139065 - DNA, 771 bp, Homo sapiens
  misc_feature: GYAE6OF01BB6C5.46.67.G01.1.454.CMB.1.raw
  modified_base (208)..(208): a, c, t, g, unknown or other
  misc_feature (208)..(208): n is a, c, g, or t
  modified_base (276)..(276): a, c, t, g, unknown or other
  misc_feature (276)..(276): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctcgtgggctgggtccgnagcctccgaggggaggctaggaatacagttggagtgtctctacagtagtggtacggttcctattacgngtaccgttctactacgaagtcgtcgagtccaccatactctcgtacggacacgtccagactaattcctacgttttcccagaacgtgtagtacgttcgtgtcgacccgcgtctacggacgtacgggtattttactacgtcggtgacggtagacggtacgtacttaagttacgttaggtttagtttttagggtagtttacgggttttaactttaccggtaacccgtaacccgtaggtaacggtccgggggtaacccgggggtacccgttacccgggtacccccgggtgggggtaaccccgtaaggggttaaccgttacggttaccgggttaccccgtacccggttacccgttaccgttaacccggttccccgttaacccggaaacccgggtacccgggtaccccgttacccggttccccgggtttacccccttccccccggttacggtcccccttaacccccgttccgtaacccgtaaaccggacccggtacccccgg

SEQ ID NO: 139066 - DNA, 584 bp, Homo sapiens
  misc_feature: GYAE6OF01BKL9L.46.67.G01.1.454.CMB.1.raw
  modified_base (171)..(171): a, c, t, g, unknown or other
  misc_feature (171)..(171): n is a, c, g, or t
  modified_base (207)..(207): a, c, t, g, unknown or other
  misc_feature (207)..(207): n is a, c, g, or t
  modified_base (330)..(330): a, c, t, g, unknown or other
  misc_feature (330)..(330): n is a, c, g, or t
  modified_base (398)..(398): a, c, t, g, unknown or other
  misc_feature (398)..(398): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtncctcatcagtagtggtttctcgtgggctgggtccgnagctccgagggagggctggaatacattggaagtgtctctcagtagtggaggttcctattacagtccgtctctcaagagtcgagtcaccatatctctggacacgtccagcatctacgttttccngtaacgatgagtttctgtcgaccgccgtcgtcgacgtacgggtctttatacgtgtgacgagagacgtnttattagtgttagtttggagttggttattcgacctacctagagtcggcggggtctccggacccggtggggaccagggtaactacgtcggtcctccgttctccgttacgccctaccgaccggacggaccctacgtcccggttcccttccccgtcgtccctacccctcctacccgagtcccgtacccg

SEQ ID NO: 139067 - DNA, 651 bp, Homo sapiens
  misc_feature: GYAE6OF01AZCDF.46.67.G01.1.454.CMB.1.raw
  modified_base (193)..(193): a, c, t, g, unknown or other
  misc_feature (193)..(193): n is a, c, g, or t
  modified_base (422)..(422): a, c, t, g, unknown or other
  misc_feature (422)..(422): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtcctccatcctcctgtctgacaaccggtgganacagtcgtacacatcacgttcgccgggactaagtcggaactgttcgacctaccttaagtttaaagtggtatacgaacatagaccgaggaccgacctagctactatctatgctgcactccgagtttcgacgtaaaggtcgggtacccagtacggtagttcgaagtggactaggtgatcgtagggacagttacttccaactcctactaacctagttcgtaagtaaccgttntacggtaaccgtaagttagtaaacgtttatttcgtaacttaacttattaaccgttagtaccaaagtagttaaacttacgtaagtttcggttacgaaccgtaacggacctaaacgtaacttaaacgttaaaggtaaaccgtacgtacgggtatacccgtagtaccctacgtacttccgttacgttccttacgtaccctttcccgtacccctatacttccgtagttaaccc

SEQ ID NO: 139068 - DNA, 559 bp, Homo sapiens
  misc_feature: GYAE6OF01A6N4H.46.67.G01.1.454.CMB.1.raw
  modified_base (374)..(374): a, c, t, g, unknown or other
  misc_feature (374)..(374): n is a, c, g, or t
  modified_base (380)..(380): a, c, t, g, unknown or other
  misc_feature (380)..(380): n is a, c, g, or t
  modified_base (433)..(433): a, c, t, g, unknown or other
  misc_feature (433)..(433): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctcgtggggctgggtccgcagctcccgagggaagggctggaatacattggaagtgtcgtctcatagtggaggttcctattacagtccgtctctcagagtcgagtcaccatatctctggacacgtccagcaatctagttttcccngtaagntgagtttctgtcgaccgcgctgacgtacgggtcgtttatactgtgacgagcgngtactatgtgtttagttgtagttgttcgtacgtacctacgtagtcgacgggtccggtccgtacccggtccgggtcggacggacgtacgtcgtacgtcctacgtccttcgtccgtcccgtaacccgg

SEQ ID NO: 139069 - DNA, 677 bp, Homo sapiens
  misc_feature: GYAE6OF01A5F1E.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctcgtggggctgggtccgcagcctcccgagggagggctggaatacagttggaagtgtctctcagtagtggaggttcctattacagtccgtctctcaagacgtcgagtcaccgatatctctgacacgtcagcatctacgttttccagaagatgtagttcgtgtcgaccgccgctgacgacgggtcgttttactacgtgtgacgaggagtacggtactagttatgttagttttagggtagttaggtttacttccgacctaccgtagtacgtcgggtaccgggggtcctaccccggtacccggtcggggacccgtaaggggtacttaaccggtcggttaacccgtaccgttccgttcccgttagtcccccgtaccgtaaccccggtaccggggtaccccccttaggttcccccggtttacccccgttccccccgttacgggtcccccctaccccccgttacccgtaaccccgaaacggtcccgtaccccg

SEQ ID NO: 139070 - DNA, 943 bp, Homo sapiens
  misc_feature: GYAE6OF01EAW51.46.67.G01.1.454.CMB.1.raw
  modified_base (177)..(177): a, c, t, g, unknown or other
  misc_feature (177)..(177): n is a, c, g, or t
tcagactagcagtacacgaccggtgctcgatttagagtatacatattgggtttggggagtctcggtcaggacacagcatggacatgagggtcccgctcagctcctggggctcctgctactctggctccgaggtgccagatgtgacatcgagctgacccagtcctccatcccctcgtntcgtcgaccgtaccgggtaggacgacgtaggtctaccaacctactaccgtacgtccgggccggaacgtaacggtaaccgaacgttgtaacaccttaactttaaatttaaggtgtactaaccaagtaacgtaaccgaccgggaaccgggtacccgtaacctacgtacccttaaaccgtacttacttacgcgtaccggtctaaccttacccgttacggtttaacggtttacccggaaaacggggttaaccgggggtttccccgggttaaccgttaaccgggttaccgggttttaacgggtaccgttaacggggtccgggtaacggtaaggggttacgttacccggttaggggtaaacccgggtaaactttaaccggtttttaaaccgtttccccgtaacctttacccgaaacccctaaaaccggtttactaaaccccgggttttaaagttaacccgttaccggttaaccgttaaaccgggttaaaacgggttaacggtttaaagtttttaaccggtttaccctttaaacggtttaaacctttttaaacgttaaccggttactaaaacccgtaaagtttaacgttaaaacgtttaacgtttaccgggtttacggtttaacccgaaacgggtaacgaaaccgttaacgttaaaaccgtaaacgttaaaacgtaacgttacgtaggtacttacgaccgtaacgtacttaccgttagttcccgtacgttactaccccgttaccgtcccctaagtactttccgagttaacccg

SEQ ID NO: 139071 - DNA, 762 bp, Homo sapiens
  misc_feature: GYAE6OF01BL2IN.46.67.G01.1.454.CMB.1.raw
  modified_base (174)..(174): a, c, t, g, unknown or other
  misc_feature (174)..(174): n is a, c, g, or t
  modified_base (254)..(254): a, c, t, g, unknown or other
  misc_feature (254)..(254): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactgggtgaggccctttcggagaccctgtccctcacctgcgctgtctctggtncctccatcagtagttggtttctcgtgggctggggtccgcagctccgaggggaagggctggaatacagttggatgtctctnatgtggtagttctattacagtccgtctctacaagacgtcgagtcaccatactctcgtaggaccacgtccagtactaactcttacgttttcccagtaagtacgttgtaagtttctggtacgacccggtccgtacgttacggaaccgtacggggttacgttttaacgttacgtgggttacggacggaaggtacggtaacggttacttaagttaacgtttgtttaaggtttttgggtaaggtttaggttttactttaccggtaacctaccgttaaggtacggtaccggggtacggggtcccgttacccggtaaccccgggttcggggaaccggtaacggggttaaacttaccggttacgggtaccttacccggtaccttccgttaaacccgtccccgttaacccgtaaccggtaaccggggtacccctaacggttccccggtttaccccgttcccccggttaccgtaccccgtacccccgttaccctaacccgaacgtcccgttaaccccg

SEQ ID NO: 139072 - DNA, 704 bp, Homo sapiens
  misc_feature: GYAE6OF01AVB6D.46.67.G01.1.454.CMB.1.raw
tcagactagcagtacacgaccggtgctcgatttagagtatacatattgggtttggggagtctcggtcagggacacagcatggacatgagggtccccgctcagctcctgggggctcctgctactctggctccgaggtgccagatgtgacatcgagctgacccagtctccatcctccctgtctgcaaccggtgggagacagtgtcaccatcacttcggccgggcaaggtcggaactattcgaacctaaccttaattttaaattggtaatacaacagtacgaccgaggggaccgccctaagctacctaatctatcgctgctactccgtagtttcgacgtaacggtcgggtacccagtcggtaggttcaggtggacgtaggtacggtatccggtagggaactacgtattttaccactctacaacctataccgaagttactcgtacgtactaacggttagtaaagtttacgttttagaaaccgtttaacgtttaacttaaccgttagtaaacctaaacgtaagttaaacgtttaacgtaacgttttacgggtttaccggaaccgtaaacggggacctaaaccgtaaattaaaacctaaacggtttaaacgacgttagggtacggtactaccgaccttaaccgtaattcgttacgttacccttacttaccttacccggttacccaccgttaacttccgtaaggttaaccc

SEQ ID NO: 139073 - DNA, 756 bp, Homo sapiens
  misc_feature: GYAE6OF01A1VOS.46.67.G01.1.454.CMB.1.raw
tcagactagcagtacacgaccggtgctcgatttagagtatacatattggggtttgggggagtctcggtcaggacacagcatggacatgagggtccccgctcagctcctggggctcctgctactctggctccgaggtgccagatgtgacatcgagctgacccagtctccatccctccctgtctgacaaccggtgggagacagtcgtaccaccatcacgttcggtcgggacaaggtcggaactagttacgaacctaacctttaattttaaagttggtaactacaaactaagtaacggaacccgaacggggacccggacccctaagaccttacctaattacgttatcggcttcggacctaacttccgtaggttttacgacgtaaacgggtccggggtaccctaggttacggtaaggttcgaggtcggacgtagggtacggtacgttcggtagggaactaaggttactttcactctaccaacctatactaacgttaactcgtacggaactaacggttagtaaaggttactttacgaactttaactttacgttacgttactaacctaaataacgttaaactttaaccgttaaggtttaccggtttaccggaacggtaaaccggtactaaacgttaaccttaaaacgtaaacgttaaacggagttacgggtacgacttaccggaaccaaccgtttagttacgttcgtttaccttaccgtaactttccccggttaccccgtacttacttcgttacggtaaccc

SEQ ID NO: 139074 - DNA, 751 bp, Homo sapiens
  misc_feature: GYAE6OF01BNXJJ.46.67.G01.1.454.CMB.1.raw
  modified_base (663)..(663): a, c, t, g, unknown or other
  misc_feature (663)..(663): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgaccagtctccactcctccctgtctgcaaccgtgggagacagtgtcaccatcctacttcggccgggcaaacggtcggaaactacttagaacctaacctttaatttaaacgttcggtaatacgaaacctagtaacgaaccggaacggggaacccggtaccctaaaggtccttaacccttaaactaccgtaagttcggtccgtacggtacctaacgttacccgtagttttacggaccgtaaacgggttcggggtacccctaagtcggtaaggttcgagggtacggctagtgggtactcgggtaggactaggttacttcactcctacgacctagtctaacgtaactcgtacgaaccgtaacgtagttaaacgttacgtttacacgttaaactttacgttacttacgaacctaaagtacgtaactttaacgtagtttacggttacggaaccgtaacgggtactaaaccggtaacttaacggtaaacgttaacgtaacggtacggtacggtacncggttaaacctacctaggttacctttccggttaccttaccgttaccgttaccccgtttacccggaaacctttattaccgtaggttaac

SEQ ID NO: 139075 - DNA, 784 bp, Homo sapiens
  misc_feature: GYAE6OF01CVSNX.46.67.G01.1.454.CMB.1.raw
  modified_base (220)..(220): a, c, t, g, unknown or other
  misc_feature (220)..(220): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtccgggcccacgtactgggtgacggccttcggacgaccctgtcccctcaccgtgcgctgtctcgtggtcncctcatcgtagttagttggtttctcggtcggggtctcggggtccgctagtccgtaccggaggggaagggtctaggaactacgtagttagggaacgttcgtctcgtacgtaaggttaggtcgggtaacgtttaccttagttaaccgtacggttcccgttataccgtaacgaaaggtacgttacgacgttaccaaccgtattactcgtcgtacggtacctaccggtacaagtacctaagttccttaaccgtttccgaaggtaaacgtattacggttacgttccgtaggtaccgtaccccggtccgtacggtacgtaaccggtacggggtttacttttactaccggtgtacggacggagtaaccggtcgtattaagttgtaggttttaagttcggtaagtttacgttacttaccggaacctaccggtaagtaccgggtaccggggacccgggttccgtacccgggaccccgggtaggggtaaccccgtagggttaaaccgttccgggttaccggtaccccgtaacccctttccggttacccggtacccgtccccccggtaaaccggg

SEQ ID NO: 139076 - DNA, 868 bp, Homo sapiens
  misc_feature: GYAE6OF01DMS3G.46.67.G01.1.454.CMB.1.raw
  modified_base (303)..(303): a, c, t, g, unknown or other
  misc_feature (303)..(303): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtccgggcccacgactggtgaggcctttcggacgacccttgtccctcacctgcgctgtctcgtggtcgcctccatcgaggttagttggttttctcgtggggctggggtccgcagccgtccgaggggagggctggaatacagttggaagtgtctntcataggtggtacggttctattacacgttccgtcttctacgaagtacgtacgacgtaccgacctatacttcgtcgtacgggaacctaccgtccgaagaccgtaaacttaccgttacggtttttttaccccaaggtaaacgttaacgttagggttaacggttttccgttacgggttacccggtaaccccgggtcccggtaccggttaacgggtaacccgggttaaccgggggttttaaccgttttttaacgttttaaccggtttgggttaaccgggtaccgggtaaggtaaccggggttacggttaccgttttaaagttttacgttagggttttaacggtttttttaggggacgggtttttacgggtttttaacgttttacccggaacccgtttaaccccgttaagggtacccggttaccgggggtacccggggggttacccttaccccggggacccccgggttagggggacccggtaaacggggttaactttacccgggttacggtaccccgttacccggtttaccctttaccccggttaaccggtcccccgttaaacccccggg

SEQ ID NO: 139077 - DNA, 742 bp, Homo sapiens
  misc_feature: GYAE6OF01BUS05.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtgggagacgagtgtccaccatcacttggccgggacaacgtacggaacattgactaccttaatttaattggtatcaacatagaccgagggaccggccctaagctacctaatctatgctgctactccgtagttgacgtaaggtcgggtcccatcggtacggtactaggtcggactaggtggacgtcggtgggtaaccgtagttaactttccaccgttaccttaccgaaccctactaccgtaagttaacttccgtacgtaaccgtaacgtaggttaaacgttaagtttttacggaaccttaaacttttaacgttaccggttaacttaccgtaaaactaagttaaacttaacgttaagtttcggttttaccggaaacccgtaaaggggtaaaccaacccggttaaaccttaaaacgtaaaccgtttaaaacggaaccgtttagggttaccggttaacgttaccgacccggtaaccttattacccgttccggtttaccttaaccttaaccgtttccccctaacccccgggttacctaacgttccgtaccggtttaaaccg

SEQ ID NO: 139078 - DNA, 621 bp, Homo sapiens
  misc_feature: GYAE6OF01C6XZ3.46.67.G01.1.454.CMB.1.raw
  modified_base (359)..(359): a, c, t, g, unknown or other
  misc_feature (359)..(359): n is a, c, g, or t
  modified_base (604)..(604): a, c, t, g, unknown or other
  misc_feature (604)..(604): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggacgaccctgtccctcacctgcgctgtctctggtgcctccatcagtagttggtttctcgtgggcgtgggtccgcagcctccgaggggaagggctaggaatacgagttggaagtgtctcgtcatacggtggtacgttctattacgagtccgtctctcaagtgcgagtacaccatatctacgtcggtacacgtcagactaactcgtacgttttaccgagaagtntgtattcgtgacgaccgcgctcgacgtacggtcgtttaatcgtgtgcgagagacgtactagttgtagttagtttaggtagttgttacgttacgtactacgtagcgtacgggcgggtcctcccggtacccggtcggggaccgtaagggtactacggttcgaccgtaccgtccgtactaccgcctacccgaccgtacgaccccgtacgtccccggttccctcccccgtgtacccctccccgttaccncccgaggaccgtacccg

SEQ ID NO: 139079 - DNA, 737 bp, Homo sapiens
  misc_feature: GYAE6OF01CMBTR.46.67.G01.1.454.CMB.1.raw
  modified_base (419)..(419): a, c, t, g, unknown or other
  misc_feature (419)..(419): n is a, c, g, or t
tcagactagcagtacacgaccggtgctcgatttagagtatacatattgggtttggggagtctcggtcaggacacagcatggacatgagggtccccgctcagctccgtggggctcctgctactctggctccggaggtgccagatgtgacatcgagctgaccctagtctccatccctccctgtctcgaccgaccggtgggagactaggtctccacctatcctacgttcggcccggggacaacggtaccggaactagttacgaacctaacttaattttaaagtggtaatacaacagtacgaccgtagggacccgtaccctaagtcctactatactatcgctacgctacttccgtagttagacgtaaggtcgggtaccagtcgagttcaggtacgtcgaggtgtacgtcgtacggtactagtnttaccgtaccttacaccgtactaacgtacctaagtactctacgtaagtaacgtagtaagttatttacaacgttaactttacgttaactagtaactaacgtaagtaacttaacgttacgttacggtttaaccggaaccggtaaacggtaccgtaaccgttaaacgtaaacgttaaaaccgttaacgtaaccggttacgggtaccggtacctagtacccgtaaaccgtccgtttaacgttacccggtttaccctttaaccgtaccccgttttaccccgtaccccgttaaccctaaccggtttacgtacccgttaaaccgg

SEQ ID NO: 139080 - DNA, 708 bp, Homo sapiens
  misc_feature: GYAE6OF01BQ16F.46.67.G01.1.454.CMB.1.raw
  modified_base (339)..(339): a, c, t, g, unknown or other
  misc_feature (339)..(339): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctcatcagtagtgttctcgtgggctgggtccgcagctccgagggagggctaggaatacagttggaagtgtctctcagtagtggaggttcctattacagtccgtctctacaagacgtcgagtcacctatatctctgacacgtcagcaatctacgtttcccagaacgtntagtagttcgtgtacgacccgtccgtctacggaccgtacgggttacttttacgttactgggtcgtacgagacggtacggtacttaagtttacgttagtttagtttttgggtaagtttggtttacgtttaccgaaccgttacccgtaagtacgtaccgggaccggggtcctacccgggaaccccggtcggggacccgaacggggtaacttaccggttacgtaccccgtaccgttccgttacccttaccggtccccgtacccgtaaccccggtaccgggtacccctacggttccccggttaccccgttccccccggtaccggtacccccttacccccgttacccctaccgtaaacccggtccgtaccccgg

SEQ ID NO: 139081 - DNA, 699 bp, Homo sapiens
  misc_feature: GYAE6OF01CCIJH.46.67.G01.1.454.CMB.1.raw
  modified_base (190)..(190): a, c, t, g, unknown or other
  misc_feature (190)..(190): n is a, c, g, or t
  modified_base (214)..(214): a, c, t, g, unknown or other
  misc_feature (214)..(214): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaacgtggganacagtgcacatcacttggccgganaagtcgaactattgacactatttaaatgtatacaacatacgaccgagggaccgacctaagcctactatctagtcgcgtgctactccgtagtttgacgtaaagggtcgggtccctaagtacggtaggtttaccgaggttacgggcgtaaggttcggtactcggtacgggaacgtaggtaacttttcaccttctaccacctagtacgtagtaattcgtagtacgtaacggttacgtaaacgttagttttacgaactaacgttttaacgttaacctttggtaaccctaaacgtaacgtttaaactttaacgttaaagtttcggttttaacccggaaccggtaaacgggtactaaccggtaaacttaaaacgttaaaacgttaaccgtaaacgttacggtacggtaccgtacgtacccacgttaagttccgttcgtttacccttacgttaaccttcccgttaccctaccgttactacgtacgttaaccg

SEQ ID NO: 139082 - DNA, 622 bp, Homo sapiens
  misc_feature: GYAE6OF01E2T3N.46.67.G01.1.454.CMB.1.raw
  modified_base (193)..(193): a, c, t, g, unknown or other
  misc_feature (193)..(193): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatccctccctgtctgcaaccgtggganacagtgtcaccatcacttgccgggcaaggtcgaacattgactaccttatttaaattggtatcaacatagaccagggaccgccctaagctcctaatctatgctgcatccagtttgacgtaaaggtcgggtacccagtcgaggttcagtggcgagtggatcgtgggacagtacttcactctacgaccatctaagtatcgtagacgaacgtgtaagttattttagacttaacttacttatcgtaactaaactaagtaatttaacgtagttcggttttaccgggacctaaaggggtaccaacggtaactaaactaaacgttaaaccgtaacttaggtacggtacctacgtacctaaccgtacttcgttaccgttacctttacccgttacgtttacccctttccccggaacccttacttcccgtgttaaacccg

SEQ ID NO: 139083 - DNA, 642 bp, Homo sapiens
  misc_feature: GYAE6OF01DT2GA.46.67.G01.1.454.CMB.1.raw
  modified_base (194)..(194): a, c, t, g, unknown or other
  misc_feature (194)..(194): n is a, c, g, or t
  modified_base (220)..(220): a, c, t, g, unknown or other
  misc_feature (220)..(220): n is a, c, g, or t
tcagactagcagtacacgaccggtgctcgatttagagtatacatattgggtttggggagtctcggtcaggacacagcatggacatgagggtccccgctcagctcctggggctccctgctactctggctccgaggtgccagatgtgacatcgagctgacccagtctccatcctcctgtctgccaaccggtggganacagtgtcaccatcacttgccggganaagtcgaacattcgactacttatttaatgtatacaacatacgaccgaggaccgaccctaagcctactaatctatgctgctatccagtttgactaaggtcgggtaccagtcgagttcagtcgcaggtgatcgtaggacagtctttacgacttcacacctatactaagtaacttcgtacgtaacgtaacgttagtaagttacttttacgaaacttaacgtttattaaccgttagtaactaactaagttaacttaacgttaatttacggtttacggaaccgtaagggtaacctaacggttaaaccttaacgtaaaacgttaaccgtaacgttaggtacggtactacgaaccgtacctaagtttaccttcggttacttaccgtactttcccgttaccccgtacttaacgttccgttaagtaacccg

SEQ ID NO: 139084 - DNA, 616 bp, Homo sapiens
  misc_feature: GYAE6OF01B3BQX.46.67.G01.1.454.CMB.1.raw
  modified_base (211)..(211): a, c, t, g, unknown or other
  misc_feature (211)..(211): n is a, c, g, or t
  modified_base (369)..(369): a, c, t, g, unknown or other
  misc_feature (369)..(369): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtncctcatcagtgtgtttctcgtggggctgggtccgcagccgtccgaggggaagggctaggaatacagttggaagtcgtctctctagtagtgggtaggttcctattacgacgtccgtctctacgaagtacgtcgacgtcaacctattactctcgtggacnccgtaccagaccaagtcttacgttttcccagaagtagttcgtacgtttcgtggtcggacccgccgcgtacgaccgtcgggttacttttaacttacgtgtgcgtagacggacgtcttattgttgttagttttggagtttgtttacttcgactaccgtagtacgtcgggacgggtcctcccggtcccggtgggaccgaagggtactacggttcgtaccgtcccgttctacccgttcgccctaaccccgg

SEQ ID NO: 139085 - DNA, 661 bp, Homo sapiens
  misc_feature: GYAE6OF01DUEYS.46.67.G01.1.454.CMB.1.raw
  modified_base (195)..(195): a, c, t, g, unknown or other
  misc_feature (195)..(195): n is a, c, g, or t
tcagactagcagtacacgaccggtgctcgatttagagtatacatattgggtttgggggagtctcggtcaggacacagcatggacatgagggtccccgctcagctcctggggctcctgctactctggctccggaggtgccagatgtgacatcgagctgacccagtctccatccctcctgtctgcaaccggtggganacagtgtccaccatcacgttcggccgggacaaggtccggaactagttacgactaaccttaattttaaagttggtactacaacataagaccgagggaccggccctaagcttacctaatctatgctgctactctagtttgacgtaaggtcgggtaccagtacggtaggttacgaggtcggacgtaggtacggtaatcgtacgggactagtctttacgactctacaccatacaagttactcgtagacaacggtagtaagttatttacgaactttaactttaactttacgtgttaaaccaaacgttaactaaactttaaccgtaaggttttacgttttcccgggaaccgtaaggaaccgtaacgtaacctaaactaaaacgtttaacgaagttcgtacggccttaacggacctaactattacgttcgttaccttattacccgttcctacccgtacacttcgtacgttaac

SEQ ID NO: 139086 - DNA, 766 bp, Homo sapiens
  misc_feature: GYAE6OF01BWVW0.46.67.G01.1.454.CMB.1.raw
tcagactagcagtacacgaccggtgctcgatttagagtatacatagttgggttgtcctcctgctggtggcagctcccagatggtcctgtcctggtgcaactgcaggagtcgggcccacgactggtgaggccttcggagaccctgtccctcacctgcgctgtctctggtcgcctccatcagtagttggtttctcgtggggctgggtccgcagcctcccgaggggaacgggctaggaatacgagtttagggaattgtctctcagtagtggaggttcctaattacagtccgtctctcaagagtcgagtcaccatactctctggaccacgtcagctaatcgtacgttttccagaacgtagtgtaagtttctggttacgacccgtccgcgtacgaacgtaccggggttacgttttaattacgttggtacggtaccgaaggtaacgtaccggtacttaacgtttagttagttagtttttaggaaggtttaggtttactttaccggtaaccgttaacccgtaaggtaccgttacggggtaccgggggtacctacccgggtaaccccggtacgggggtaaccgtaaggggtaaaccgttacggttaccgggttacctacccggtttcccgttacccgtttaccggtacccctaaccccggtaaccggtaaaccggggtccccttaaacggttccccgggttaccccgtttaccccccggacgttacccccgttaacccccttacccgtaaacccgtaacggaccgtaaccccgg

SEQ ID NO: 139087 - DNA, 751 bp, Homo sapiens
  misc_feature: GYAE6OF01COR0Q.46.67.G01.1.454.CMB.1.raw
  modified_base (218)..(218): a, c, t, g, unknown or other
  misc_feature (218)..(218): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtcctggtgcaactgcaggagtccgggcccacgacgtgggtgacggccttcggacgtccctgtcccctcacctgcgctgtctcgtggtcncctccatcaggttagttcggtttcttcggtgggggtcttcgggggtcccggacacggcccgtaccggaagggggaacgggcgtaggtaatacgtagttagggtaagttcgtcctacgtacgtagtaggtacgggtacgtttacctagtttaccgacgtcccgtactcgtaacgtaaggtacgtcgacgtcaaccgtattactctcgtcggaacctcgtaccagactaacgtccgttacgttttaccgagttaaagtacgtgttacgtttcgtacgttccggacccgtccgtacgttaccggaacgtacggggtttacctttaagtaccgttggtacgacggacggtagacgttacttaattgtttagttagtttaggtagtttagtttacgttccgaacgtaccgtagtaccgttccggggacgggttcccgtaccggtaccccgggtagggacccggtaacgggtaacgttaccgggtacgttaccccggtaccgtttcccgttaaccttccccggtacccttaaccccggg

SEQ ID NO: 139088 - DNA, 635 bp, Homo sapiens
  misc_feature: GYAE6OF01AV4XX.46.67.G01.1.454.CMB.1.raw
  modified_base (193)..(193): a, c, t, g, unknown or other
  misc_feature (193)..(193): n is a, c, g, or t
  modified_base (199)..(199): a, c, t, g, unknown or other
  misc_feature (199)..(199): n is a, c, g, or t
  modified_base (218)..(218): a, c, t, g, unknown or other
  misc_feature (218)..(218): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgccaaccgtggganacagtntcaccatcacttgccgganaagtcggacattgactacctatttaaattggtatcaacatagaccagggacggccctaagctacctaatctatgctgcatcctagtttcgactaaacggttcggggtccccagttcggacggtttcaggtggcgaggtcgggacgttcgtacggggacaggtactttccacttcctaccacctatacctaagtaacttcctagaccgtaaccggtagtaacgttattttacgacttaaccgtttattacgttacgtactaaactagtaaactttacgtaagttcggtttaccggaccgtaacgggactaacgtaacttaacaaacgttaaccgaacgtcggtacgcctagaccctaacgattacgttcgttaccttacttactacccgtttcccccgacttacgtccgtgttaaccg

SEQ ID NO: 139089 - DNA, 603 bp, Homo sapiens
  misc_feature: GYAE6OF01AYIAE.46.67.G01.1.454.CMB.1.raw
  modified_base (194)..(194): a, c, t, g, unknown or other
  misc_feature (194)..(194): n is a, c, g, or t
  modified_base (356)..(356): a, c, t, g, unknown or other
  misc_feature (356)..(356): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatccctccctgtctgcaaccggtggganacagtgtcaccatcacgttggccgggacaaggtccggaacattacgactaccttattttaaattggtatacaacatacgaaccgagggaccggaccctaagcctacctaatctatcgctgcatcctgtttagacgaaggtcgggtacccatcggtaggttcnggtggcaggtggatcgtgggacagtatttcactcgtacacctactactaagtaatctacgtacgtaacgtagtaagtatttacgtacttaacttattacgttacgtactaactaagtaattactaagttacgtttacggtaacgtaacggaacgtaacgtaacgtaactaaacgtaaacgaacgtacgtgacgtcgacgtaccactctcgttactctactacctacgtacccccccctatctgtacg

SEQ ID NO: 139090 - DNA, 733 bp, Homo sapiens
  misc_feature: GYAE6OF01BLF0H.46.67.G01.1.454.CMB.1.raw
  modified_base (365)..(365): a, c, t, g, unknown or other
  misc_feature (365)..(365): n is a, c, g, or t
  modified_base (675)..(675): a, c, t, g, unknown or other
  misc_feature (675)..(675): n is a, c, g, or t
tcagactagcagtacacgaccggtgctcgatttagagtatacatattgggtttggggagtctcggtcaggacacagcatggacatgagggtccccgctcagctccgtggggctcctgctactctggctccgaggtgccagatgtgacatcgagctcgaccctagtcctccactccctccctgtctcgacgaaccggtgggagactagtcgtccaccatctacgttcggccggacaaggtacggaactattcgaacctaaccttaattttaaagttacggtataacctaaacgtaataaccggaaccgtaacggggaacccggtaccctaaaggtaccttacccgttaaatccttaagtgccgttnacgtaacttccgttaaggtttacgaaccggttaaagggttccgggtaccctagttacggttaggttacgagggtcggactagggtacggtaacgtcggtagggtacctaaggtttacttaccgtacttaccgtaacctaaccgtataacgtaacgttaacgtctaacggtactaaacggttagtaacgttactttacgaactttaaagttcttacgtataacaatacgttaaattacagttttcgtaaccggaacgtaaaggaccctaagtaaaccttaaactaaacggttaacagtcgtacgaccgtanaaccgtactacttacgttccgttactaactccgttcccttacgatacttcgtataccg

SEQ ID NO: 139091 - DNA, 732 bp, Homo sapiens
  misc_feature: GYAE6OF01AZLMY.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgacaaccggtgggagacagtgtcaccatcacgttgccgggacaagtcggaacattgacctaccttaatttaaattggtatacaacatacgaccgagggaccgaccctaagcctacctaatctatcgctgactactccgtagtttcgacgtaaacggtcggggtacccagtcggtaggttcaaggtggctaggtaggatcgtagggactaacggtatttaccgacttcctaccgaacctaattactaacggttaaattccgtaaggaccgtaaacggttagtaaaggtttacttttacggaaccttaaactttactttaacgttacgtaaaccgtaaacgtaataaactttaacgtaagttttacgggttttaaccggaacccgtaaaggggtaacctaaaccgttaacttaaaccgtaaaaacgtttaaaccggtaagttacggtacgtaccgttacgaaccgtaacccgttagttaccgttacgtttaccgtttaacccgaacttttcccccgttaaccccgtacccgtactttccgttaacgttaaaccgg

SEQ ID NO: 139092 - DNA, 887 bp, Homo sapiens
  misc_feature: GYAE6OF01CYYBN.46.67.G01.1.454.CMB.1.raw
  modified_base (209)..(209): a, c, t, g, unknown or other
  misc_feature (209)..(209): n is a, c, g, or t
  modified_base (226)..(226): a, c, t, g, unknown or other
  misc_feature (226)..(226): n is a, c, g, or t
tcagactagcagtacacgaccggtgctcgatttagagtatacatattgggtttgggggacctcctgtgcaagaacatgaagcacctgtggtttgtcctcctgctggtggcagctccagagtcgggtcctgtcccgtgggtcgcaactggacgagggacggtccggcccagacgtgggtgacggtccgttcggaacgccctcgtcccacnccgtgcgtctgtctcgnggtccaccctcaagtcgtagttcggtttgttccttcgggtggggacgtggggtccccgatacggtccggtaccgggaagggggaacggtcgtaggaaattcgaaggttacggtaagttcgtcctacgtataaggttagggtacggtacttttacctaacgttacgacgttcccggtcttaccgaaggaacggtaccggtacgtaaccgtacctaaaccgttagttaacgttccggtacggaaacggtaacccgtacccgtaccgaagtaaccgttaattacccgtttacgtttccgaaaggtaaagtcgtttacggtacgtttcggacgttacccggaacccgtccggtacgtaaccgggtaccggttaccgggttacgtttttaacgaccgggttagggtacccggaaggtacggtacggtaacgtttacgttaaggttttacgttaggttttacggtttaggggtaacgttttacgtttaaaccggtccgaacccgtttacggaacggtccggttaccgggggtacccggttacccgggtccccgggtaacccgggttagggaaccggttaaaccggtaccgggtttaccgacccgggttaaccccgtacccggtttaccccgtacccgggttaacccgtccccgtaaaaccccggggg

SEQ ID NO: 139093 - DNA, 592 bp, Homo sapiens
  misc_feature: GYAE6OF01BBBU6.46.67.G01.1.454.CMB.1.raw
  modified_base (338)..(338): a, c, t, g, unknown or other
  misc_feature (338)..(338): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggcagcctcccgaggggaaggggctggaatacagttggagtgtctctcatagtggaggttcctattacagtccgtctctcagagtcgagtcaccatatctctggacacgtccagcaatctagttttcccngaagatgtagttctgtcgaccgccgtctgacacgggtcttttattacgtgtgcgagagacggtctattatgttagttttggagttggttatttcgtacctacccgtagtagtcggacggggtccgtccgtaccccgtggggaccgaagggtactacgttcggtccgtaccgtccgtccgttacgcctccgaccgacgggtcccacggttcccgtccgttccccctcggtcccaccctccctccgagcgtacccg

SEQ ID NO: 139094 - DNA, 571 bp, Homo sapiens
  misc_feature: GYAE6OF01EFR4L.46.67.G01.1.454.CMB.1.raw
  modified_base (193)..(193): a, c, t, g, unknown or other
  misc_feature (193)..(193): n is a, c, g, or t
  modified_base (298)..(298): a, c, t, g, unknown or other
  misc_feature (298)..(298): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatccgagctgacccagtctccatcctccctgtctgcaaccgtggganacagtgtcaccatcacttgccgggcaagtcggaacattgacacctattaaatgtatcaacatagacaggacgccctaagctcctaatctatgctgcatccagttncaagtgggtcccatcgagttcagtggcagtcgatcgtgggacagtattcactctcaaccatacagtaactctagacaacgtgaagtatttacgactaacctttattaactgtactaactagaactttactaattgttttaaccggaccgtaaacgggtactaacggtaaccttaaacgtaaacttaaacggaacctaggtagaccgtacgaccgtaacctattcgttcttacgtttacacgttccctttacccgacctacttccgtgtaaacc

SEQ ID NO: 139095 - DNA, 728 bp, Homo sapiens
  misc_feature: GYAE6OF01EPE5W.46.67.G01.1.454.CMB.1.raw
  modified_base (194)..(194): a, c, t, g, unknown or other
  misc_feature (194)..(194): n is a, c, g, or t
  modified_base (641)..(641): a, c, t, g, unknown or other
  misc_feature (641)..(641): n is a, c, g, or t
tcagactagcagtacacgaccggtgctcgatttagagtatacatattgggtttgggggagtctcggtcaggacacagcatggacatgagggtccccgctcagctcctggggctcctgctactctggctccgaggtgccagatgtgacatcgagctcgacccagtctccatccctcctgtctgcaaccgtggganacagtgtccaccatcacgttcggccgggacaacggtcggaacattgaacctaaccttatttaaagttggtatacaacatacgaccgagggaccaccctaagcctacctaatctatgcctgactctacctggttacgacgtaaagggtccggggtaccctagtacggtacggttacgtaacggtcggactagggttcggtacgttcggtacggggaactaaacgttacgtttaccctaaccgttcctaacctacctacgttaacctaacggtttaaactccgtaaccgaacgttaaccggtaggttaaaacgttcgttttaacggactttaaactttactttaacgtacgttaccaaagtacgtaaactttacgtagtttcgtttacggaaccggtaaggtaacctacgtaaaccgttaaattaaaacggtaacccgtaagttacggnggtacttaccggtaacctacgttacgttccgttcgttaccctttaccgaacctttcccctaccccgttaatcgttcgttacggtaac

SEQ ID NO: 139096 - DNA, 686 bp, Homo sapiens
  misc_feature: GYAE6OF01CGNRC.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtccgggcccacgactggtgaggccttcggagaccctgtcccctcacctgcgctgtctctggtcgcctccatctagtagttcggttttcttcgtgggggcttcggggtccggcagccgtccgaggggaagggctaggaatacagttggagtgttctctcagtaggtggtacggtttcctagttacgtacgtcccgtctctacgaaagtcgtacgagtccaacctattactctcgtacggacctaccgtcagtactaactctacgttttccagaagtagtgtacgttgcgtcgaccgcgtcgtacgacgtcgggttactttagttcgtggtcggcgaaggtaccggtacggttatttaagtttgtagttttaggtttcgggtagttttacggtttaacttcgtaacctcccggttaagtccgggtaccggggaaccggggttccctcccggggtaccccggtaggggacgtaaacggggtacttacgggttccggtaccgtcccggttacccttacccgtccgtccccgtaaccccgg

SEQ ID NO: 139097 - DNA, 647 bp, Homo sapiens
  misc_feature: GYAE6OF01DQD33.46.67.G01.1.454.CMB.1.raw
  modified_base (193)..(193): a, c, t, g, unknown or other
  misc_feature (193)..(193): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatccctcctgtctgcaaccggtggganacagtgtccaccatcacttggccggcaagtcggaacattgacactatttaaatgtatacaacatacgaccgagggaccgaccctaagcctactaatctatgctgctatcctagtttcgacgtaaggtcggtacccagtcgaggttcgagtggcaggtgatcgtagggactagtactttaccacttctacactatactaagtaactcgagtacctaagttagtaagttattttacgacttaacgtttattacttagtacgaaactaagttaaattaacgttaacgttttacgggtttaaccgaccggtaaaacgggtacctaaaccggtaacttaaaacttaaaacggtttaaccgaacgttacggttacgggtaccttaggaaccccttaactaacgttccgttacgttaccttacttaccgtttccctaccccgtacctagttcctgtaaacc

SEQ ID NO: 139098 - DNA, 808 bp, Homo sapiens
  misc_feature: GYAE6OF01A326V.46.67.G01.1.454.CMB.1.raw
  modified_base (193)..(193): a, c, t, g, unknown or other
  misc_feature (193)..(193): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtggganacagtgtccaccagtctacgttcggccggggactaacggtccggaactagttacgaacctaacctttaaagttttaaagttggttaactaccaaactaacgttaaccggaaccggaacggggaacccggtaacccctaaggtacccttacccttaaacttccttacgtacggtccttacggcctaacgttcccgtacggttttacggaaccggttaaaacggggttccgggggttaccccaaggtttaccggttaacggtttccggtaaggttgggtaccgtagggttacgggtacgttcggtacggggaaccttagttacgtttaccgactttacctacctaaccgtaagtacgtaaagttacttccggtacgacgttaaacggtacgttaaatttacgttttaggaaaccttttaacgtttaacttaccgttacgtaaactaaacgtagttaaacttaacgttaaggtttcgttaccgggaacgtaaacggacctaaacggttaaactaacgtaaaacgttaacggtacgttaggtcggtacgtcgaaccttactagttacttcgttaccttactacccgtttacccgttcccacttaacttggtaacttacg
